United States Patent 10,407,724 (METHODS AND COMPOSITIONS FOR SCREENING AND TREATING DEVELOPMENTAL DISORDERS) - sequence listing, part 88

SEQ ID NO: 2593 - DNA, 1468101 bp, Homo sapiens
ctgcaaacaactctggcgatgccaaaattcccctccaagtgacacggctttgcgaaggaggtttcctcaggctgggctctttctgtcattcccttctgcctttctcggcgacgataaaaggctttgctctggcaataggaatttagaaaaaaagaaaaagctgcgctaaactccaccgtgacctcaaactctttggactgtttgaaaaaaaaaaaattggaagaaaatccatcctccaagagaatcggcataggaggagatggaagttttcccctttctcttggttttgtccgtctggtggtctcgaacctgggactcggcgaatgcggattcgatcattcacatcggtaagaaagtgttggtgcagctcgtggttacttttaccgtttcagttctcaaatgtttccccttcgctttccccctctccggtctctgtgtgtcttgttggaggtggcttcagttcattgccccttcccgctacccttccctcacacttgctcagttttctgaaaggatgtggatgctcgaacctcgactgacttgtgctgttgttttgcagtgattcgtggaatgtggctggatgcgtgggggtctcgagttgacctgagtgtgagtgtgtgctgggaactgcagggggattctaagtgtgtggggaaagggagtttaattgactcttatcttccatattttttttcccggatgtacatttgctccatttaaaaatttatctttgggggagcagagaagctgtcacctgtgagatgaaaagaactgggctggggggtagggggagctcccttcggatcgaacaggtggttttgcaacgtgagccggctgagttcgccgcagcttagtgcgatggtgacgggggtgccggatgcgcccccagccaccctctcttctcacatcttcttggctttatgatccttgcgtgtagtctttgagacggtggcaggaggggctggcggcagtgtcgccaaggactgattgtcgcgtgcctcgcctcctcggacacgctcccggggcctggcgcggcggcgaaactgaccccggggcgcttgggaaacgcggggaagcgaatgcgcgcaggctgctcccgaggtctgcttagcagatatccgccttgcctcgcctcgcctcgcctcgcagtcaactccgagtagccgcgcaaggcagacagcgaaggcgccgggactactgcgggccgcgactctgagaaggactgccgagcgggctccgagatgctggtggccccacctattggcaaccagacgggccgggactggccgcggcgagcaggggcgggcggggggctgcgcgtcattatcatgcacagcgctcgcagcttcaggctccaactctactcacttgctaatccgtgagagctgagcgggagacaggctcttgcagccttttctgcgttaatgcgacgatttctttttcggaaattcgcttaccgagccagcaaggtttctttgctgggctgcagagaggtccctttgggggaatttttctgggcacaggacttttatctgtacgcatggcttggtgttctgcaaattgaggcgacagatgggtcacagcttctcccctttctgtacccctgcttctccaccgcacaacacgcatacacatacacacacgcacgtacacatactcctggtaggggaatctgctgcaggtggcgattgtgcccgcccaagcgagggatttctgtctagcgtgcgcgcccacagtggccagcccctccgctccagggggctccctctcttggtctcagaggctgtctttgtaaacatgtctgccattctctatcatttatatcagtagaactgtctgtctctgtgcaaggggtaatgaggtcaggattcagaaaacctagcgtttgtgcattaagtaagtcaagcactaatagcttgcctgctggatcccgttttgcctgggggctaacagtgcctacagattcagaacttttcagcaagaaattatggtctcattgagtggttcagcaatgttctgatagagttcagaaatgaactatgctccttttagagaaatggcatacatttatatctagttgtaaatgattggagcaggaatgcagatatataatcataatacctttatattcattgtatgattagggatttctgatgtaggctcctcatctctcaggagggaaagcctgtggaagaatgctttttttaaatcgcttattctgtggtctgcatgataaatacattatttacaaatacctacagcttttgctatcccttactagttaaatattattttgcaatgcagtctggacatctgtttcaaaatagaacaaaactgttgtattttttagtttgtatactgttgtctgtcagagtggctataatcacatttaaaaattaactgtgtacaaattacagatttctttagaaagttggttgtatacattaactgtgtatatcctactaacagatatagttacttctgagacaattaatttgacttgaatataattagtacattagatgagataattagctgttttatagactacctaatattgtcatgaggctagcaaattgtttcaaaaactttatcttttataatatatcgaaaaacattaactcctaaattaaaaaaataaaaaatgatgacgggtagtatgtgtgtaattcagtgcctccacccctactctcagcaaaagtatagtaaattcaaaaccgaatgtccatattaaaattgtaaagcaccagttaacatgaattggattagtttccttacttgtttgaataggaaaagaattaattttctttaggaggtgttgccttcatttaaatatttaatgtgagaaatatgtttctggggaaatatattagttcaggactgaaggaatgaatgtgatgaaactggagggaaagggaatatttcacctctagcgatggaaggagatatgcagaaatgaaaggttttcccagcctcatgtgatgtgttcaagcagaaagtagctgcaatatgtagttcaggcaaactggaaagatgaaaagacactgctctaagaggctttttatatattgaattattttggtattgaaccaacttatatatacatgaaaatcatctccttctttctctctttctcttcagtttttacctcatgccggtagtttaataaggtcaattacacattttaaactctaatatgttttgttaaacatattgattcactacagtgatgaaacataatggttaaaccataatgattgaaatgaaaatgtatttattttagtcaaaaatgcacaattttatgattactttgagtttcaaatatttaaaaatatttaatcattacgtatatttttaatacacatccacacacagatacacaaccatatagtatttaaaaatgaatcacttccattgtgatcttctttgccccaattaaagaaaggtcttttgacatataaaaactatgcaattttgaattatgcttctactttgagcctatgcattgattgagtaatttcatcagacccacattacttgattgcttagaagtttcctaatgatctgcatgctgtaggaagaaccaaaaagtcgtgagtggaatggcaatgatactgtgttttatgaggctattcagaagtcgctctgatttatgtagctagaaagctccaaagtctttgagattagccacgctgactgctattttcttcatacatcagtcgtcccacactctttactccctaaacacaacaggagtttagagcactgctttaattcagcagggattaggtggcatttccagtcaactgcacagtttgtgttttgcttcatatcaactatggaagatctcatgttttaacagtttaatatatgctcctttctttatctggttcctgtgctcacagaactgattgtaaattagctgtcctcagttatacatctctacaagggaacactcaaacagtgtacttattcatatattatacaaatcactagcatatttttgttgttttcagtcatagtaaaataccttatgtcaacatggagtagaaaagatgcatttattcatgtttttctcacaaacagatgatactttatcctctgaaatcataatcagctgtgatattatatttgagaaacctaagataatccacagaatattttcactatgagaatgttcaaattaaagtacaaaatcgggtaaataaaaggtgtcaacacattaaaaacaataatagattgtaaatgtaaaataccagttattcttacttctgcactaaggattattttgacaattacagcatataaaagcattcccagaagatgtgctgttcttttaccatttttttttttcagttgactacatgatttgcattggttaatgataacccccaggactcctcaaggattttttggattgtgtaagatgtctcaatgatattttatcctttttctacttatagtagttgtttgttcctgaagttcttgataactgtgtaaacgtctagaatgtactaagggacttggctttactattcttctctgtatcattaatacagttatttgaagcacaattcaagtgtgtattaagttagacaatgttgttattaatcaaagataccaactatgacatgactaataagccattacactaagggcctttgctttctacgccaggtgaaatgtacatccactaaatatctgttataaattttaagccaaataggaataaaaatccaggtgattaacttttgatttattaaaaaataaaagccaattgaaattgttaggagtgatggaagatacattttattccattctgatatctcaggctaattttatcatatggtaattttatcttaaagggccattgcaatttcaaaagcacactttttaatccagaagttttttttcttcacctacacctacgtatatgactttattttaaaaagtaagatattcacatttctattggatcatcatgatattttagattacagacagcatattggtgagtagcaatacttagaatgtattactatagtataatgtttattagaaaatacatttatggcctataaagatatctttgccattaggtgtcactgcattctgagctgtatttttttttttagtactacttgaaaaccacatgaaatatttttaaaaatctcagaaaaaaatgtcattttaatgaggtttgtgatgctgtaagaaaataggtagtttttattttcaaactagaaaaataaatatgatccctgtctcttattcttgtaagaatttaatgctaggacatatcaacacacctgataccctctaaacaaattagattgctagacctagtgatacaattttttttcttatatttaaaataggagagaaatatcttcttaaactaatacttattctctatgaataaaatctaagacacctggaaggatgcaagtgtgtttaatactgctggagtaaacacacattagtgaataaagtagtttgttaagcagcttctaacggtggtagctctgcttacctatgggatacttgaggtcccaaactgattgttgtttttgagacaaaacatatgaaaatagagttgtggggaaaaaaaaacacatggacacaaatacatctaaaaataatgtcaaccattgagttttatgaatgaccatatatgttttcagataatttttgcctggttaattgtatgcattgtatcgattccttgcatagttgcacctccaccactactatcactacaagtaccacaattatagggtttatttgttcatgtaaaactcataactattctcacatagtaatttatttgttttgtaaaaaggcactatcttccttctagcatatttcattataagaataatggaggatgaaatttagggcaacttttaatctgataatttagttttaacattggcaaactcacattattagagaatgcaacactagtttaactgaatgaatggtttgtcttatgttagattttgccctatgccaaagttcattaattattggaaaattaaatgattagacagatgtctaaaagataagaaaaaatactaaacagttctggaattgattattagaacatctatggattcatgtcattaaattggcaaattttagcatattgatgtggacacacatttcagagaatttgacaaacatatgggcaatgttaaggtataataaaaaaaagtattctggattagaatttagaaggtattggactaaatctcaatttataaatagctaattgaatacattggaaagttatttaatttttagtcttcatttttatcaaccctaaaataagatttagactaatgttcatttaatctctaagattatatgaactaaatggagaacaattgctatatttaaggaggaacagaaaggaattgggagaagagatacagtcaagtgtggctatatttaatagctgccttagagtgaccttcaaaaaaggaaatacaaggggaaataaggaacatgaaatcttaattacacaagttaagaactctttaaattgaagatgtctttgttgcaaacaagaattatgtacatttcttcatcaggtattctggataactagtatctgattgagagagctggatttgttttttgttttcgattttgttttcgttttgtctattattagtaccaaggtgttacctacagcatcactcctatagaacactgcaaaattagtgtttaacactaattggagggatgaatagtcttatgtatcaactatcattgtgtatgtacacttgcctttagaatttgcaaactgggagtgcatcaggaatattaacatatgctttatatcactacaaacaaaagtagagtataaagaaagcaaccaattcaaagttcttcactatcctggactcctgcttcaggtttttatgcttttatcctactgttgttcaccaagtagtcatcaatgtgaagctgaggctgagttgaccccgaaagcttcttgagtagatacagggaagccaagtgaacaccagaagctaagcaccaaaggcctacttatggtcttaaatattcttaaatcactctgtagtcaagttccttattaacagatttttaaaatgaaaaacattaggtagtaaattatattacaatagcaatttgcatatgtttttctttaaactaaaataattaaaagtactattttaaaaaataatctcattttattgagcagagtacctgatttttttcataagtaagcttaaataagatatttgcttcattaataaagtcattataattctagaagttaatattcctgaaagtatatggtaatataagcattactaccaacatgtagtatgtgtgctaattgggagaatattcttttattcagcaaacattttattctgaatttactctgtatgaagcattgcttttagtctctaaaattaaaatgttgaaccaacaagctatgtttttgtatttaaggaacttacattctcatggaagaggcaaccagataagaaaatatatgatgtaatgtcaaatattgataaatgctatgaagcaaaatgagggaatgaagggtgacaaagtatgttttcattggaacagagacttgatccaaagaaaggatgtgaaccatgtggatatctgatgaagaataattcagtcagaggatatagcaagaatgacggccatgagataagacactaagaaaatctgcttagtttacttaagaaatatattcaaaggcaattggagtatagttcagtgagaaaagcaggaagtggaagtaaatggggtctgagagggcactgaggaagattctgtagggacttacaggccatggtaaggtatttaaatcttctaggtatatttgggttaagataaaatgtgtgatatgaaatagtttgtattttagaaagataacattctttgcttaagtgcactggatagagtagaagtataaattgacaatagcaaattggatcaaggtggtagcttagctaaatgtacagttatcagattgtggacataatgtgaagatcggaaaaacaggattttctgatagatgagccaggtgggagagatccagagaaagtaaagaggcttccaaggtattttacccaaatacatggagtaaatgtgttactgttgactaatattcggaatatgggggcatgagcaagtttagggtacaaatcaaaatgtgcatttattaaattttgtattagacatcaaacttgagagtttaaattggaagtttattatatgatcctgaaattaagaggtgagtttgggatttgagctgtacatttggggaatatatcattgtaaatatagactcctgtaagaatagtcataatcaaagaatcaaaaaacagtagatgttggcatggatgtggcagtcagggaacacttctacactgctggtgggaatgtaagctagtatagcaactatggaaaacagtgtggagatttcttaaagaactaaaagtagaactatcatttgatgcagcagcaaccccactactggatatctacccagaggaaaagaagtcattattcaaaaaagatacttgaacatgcatgtttatagcagcacaattcacaatagcaaaatcatggaaccaactcaaatgcctgtcaaagaatgagtggataaagaaactctgatatgtgtgtgtgtgtgtgtgtgtgtgtgtgtgtgtgtgtgtgtatatgagatggaatactactcagccataaaaaagaacgaattaacagcatttgcaatgacttggatgagattagagactattattctaagtgaagtaattcaggaatggaaaactaaacattgtatgttctcactgatatgtgggagctaagctatgaggacacaaaggcataataataatacagtggactttggggacttgcgaagaagggttggtggggataaaagacaacaaatatggtgcagtgtgtactgctttggtgatgagtgcaccaggttctcacgaatctcccctaaagaaacttacttatgtaaccaaataccacctgtaccccaataacttagggaaaagtaaaattaaaagaaagaaaataataataaaataaataaaaataaaggaatggaggggaagacgtgcagagagagaagagttccaagactaggtcatttagcattccaaaagtttgagtccaaggagagcagcggatgcaggaaaagagaaatattagtagcctgggagacaggaggaaaaccaggagtacatggtattctggaagccatgtgagaaaagtaattctagaaggagaagtgagaaaccctgttgaattgtatgtatgcaaatggagatttgattgctgggcttgaaaatgttgaggacaaagatgactttaaagaaagtgctcttagtggactacaagtgacaaaatactgattgtagagaacccgaagatttaatagaatatgaggaattctatgagttttgtcataagaaagtggtaaggaaggggatattaggttaagggaaggatttccttttacagctgggcattggtatatatatgtaattttctgaatattcagtcctaagagaattatcagtaaaatgatttaaaattgatacacctttttctttcaacttatataattcctgagtttggatagaaaacgttcaaatagaaaggaaatctgtttttttttctttttctttttcttttataaattggatcaagtgacaccaggccaaacacactgaaattaacctgagagacaagtttagagtttagatttcatttagtttcccagattgccattcaaatttcatagaaattttttatctgaacttaagagcagattacattttacatagtattgctataacattacaaatgtcataaatatttagtcatttggtaatgtactaattccaggaacacacaatatttctattctgttagtggtattaaaatgcataaaattcttgttataatagacaaatttaaatccattgtaaatttcctctgagtgcattctgttatgaatttgatttgcttcaaacatcactttggaaacatttttttaaaaagtttttaatgtgtagagggacaaaaaggatatatgtgttgaggatacctaatccagaaatctaaaatccaaatgccccaacatttgacacttttcaacactgacatcataacacaaatagaaaattccacacctgacctcatgtggtggatgcacaaaattatagaaaaaagttgtatgaaattatcttaccttctggctatgtgtgtaaggtatatatgaagcataaatgaacttaatgtttacatttagtactatccccaagatatctcattgtttatacgcaactattccaaaatctgaaaaaattctgaaaaccaaaacacttcaagtcccaagcatttcaggtaaaggatactcaacgtgtagtaattacagggcaaagtttatcattgcagcatagaaattaaatagatacaataaattcatttggcatatcatattcatatgatttctgtgacacatttaaatatttccttttatggatcttttacttatttgtgctaaacaatggatgatagattttcagtcataggtggacatgaggaaaggaaatgttctaaatttagtaacctcagaattcagccttttgaatatgaatcttagttctttcattagtattaatataaccataagttgtgtattttgattttgcacctaaaataataatatctgtactaaaataagcatgctaatagcaggtgaattatattttttgtgttctttgttgttgtaagtgttatgtcctctataaaaacatttcatcatatggaaacaatgtgatatggatgtcagatggttgtttctgctctgatacatctgttaattgatatgtaaatatggaatatttgaacaatgagagggtaggagtcttatagtttgagaatagcaatgactcacaaaaaaagcaaattgtgttctggctggagcctaggaacttaattgatgaaatacagaacattgaaagatattttctatttactagttcatagcttcttggggtggtgaaatatcatttgaaggaaatgctgcgtggacttaaatccaaacttaagttggaatgaacccctaaaactggtgaagtgtttactatatataacttcaacatcattaaaatgtcatgtcattgattgacttagtatcttaaaatccaaagaccaggtaataccttagtagctttggtgagacaagagaacttagtcctggccatgcacggtggctcacgcctgtaatcccaacacttcgggaggctgaggcgggtggatcacctgaggtcaggagttcaagatcagcctgaccaacatggtgaaaccccgtctctactaaaaatacaaaaattaactgggcatggtggtgtgcgcctgtaatcccagctactcaggggctgaggcaggagaattgcttgaacccaggaagtggaggttgcagtgagctgagatcgcaccattgcactccagcctgggcaacaagagtgaaactccaactcaaaaaaaaacaaaaacaaaaagcaaaaaaaaaaaaaaaaaaaaagaaaagagaacccgttctgttgttctgttgtatgacatttaaagcgaattaaaatccagaagactgattcctgcttctaataatctctgcaatctgacaaccaacaaaattgggttagtggtttagtggcagttgctgtcttgctactcagaatccagatattctttgctgcttctgtgaatggaaataacagaaaccattgaattttctttttagatataccaacaactctcagcatagcccagtagaagcatggcctatataagaaccattatacatttcttcttaaatggtttttcaatttttaacaccttattaatgtgggtgatgcttcatccacagatgtaagagggactgctcttctgttctcttgtggtgtagtcatggtgagttttggacattttctataatccattaatttcaagctgagaaattatgactcaaatctcatattccatttgcagaacatatcaatttagggttacatgaaaccataacgtgacatttttgggtgtgtcaccagattttttttacacctattgtgtggttataagaatacagatcattgaaacaagacacgtttcatatccttagaactttcaggagtatctgccttctaagaaaatattataacattaggaagctgaaggtagaacaattcagaactcccagctgaacgactgtggtctactatggcactggagattgtgataattcaataaatgccatttttatagtagcctaaaggtgccataaaaacatatatttcagaaaaagacatagaaatgggatcaggaggttatcacatacaaatggtctttatagtagaaatctcatttctcagctttctgatggttcaccatattgtagctataggctacaaagtaaatacaatcatgccaatttcagatctaaggaagaattttttattattttaattcttttattttttaaaaatagatgtcagtaattctcatgcaagcttaagtaatgaaggaggaggcgttaagatgtggttatttggtaattaattaagctaatgagatcttttctaaatttaatactgtatatcagatattgcattaagcatgatttcttgggtatagaaaaataaaattgccttttttactctcacttctgaagttaatagtacactgttctttcatattactaatctatcctcactgctgtatgtataaaacatcagtgaaaatgacagttttatgacatttgacatttatgacatttgacatttatgacttttgaccatgacagaataatctacctcatggcagaagtaaaataaagtttctttacaagtggcataactattattaggaaaacatatttatatagacttttaattatataggtgtaattgaaaacagggaaaacattgaaaactgaacataacagattgttcgcaaactaactgtccagtgcttctatttttctccacaagagttcatgctgtggttaataaacagttaataaatagcaaaactggctgctttgattttttctttttatttttcctgtctacccttcagtggcaatactaatgagcagtgaaatggccaaaagcaagaaaaaaggagcaaagggttttagataatctataaaccagaaaatcagtccctgactgctcgtatgcacaggcttgctgagaagaaatagttttattttctcaaaatatcacccagattctgaagatagaacttgctcttggctgctgagttagtgagacaagtgaagcttttgggccaccaaagaagaataagctgaatgacactgactgggagcaaagtgaagaatattatcactgaaaaaaactgccctccaggggtaatgctgctgacaaccagggccccagtgattggctcagttgcttgcatcatatttatggtgatttttaaaaataaaatgcaatataaattgcagctatactacttaaaaactttagataattatgtataaactgggttgtattgatattcctgtcaatacacattgagtcttgagcatctacattgtatataccctgttgacctcctgttgatggtatattatagaccatgaagaggaatttgaatattgcactcttaaaaaggaactgtgaagcacatgacaatgataaatgcaaaaatctgactagcaattaatagagggaaaagggaaggtgatgtgatggagaggtacatagtttcaacattattgatggtgttttatttattaagttgggtggttgtttcacaagtgttggatatatatgtgtgtatatatatatatatatatttttttttttttttttggtaagcaatattatatctgttgttactctgctcacagagaaatcgactggttcagttcacttccactttagttagggaataagttgttttcttttaggcccctccatcaggtaggttggctaagtttacaaccctctttggagggaaagagagtgcatactatatgcctatatgccaggactttttttttttttttttttttttttgagacagagtctcactctgtcacccaggctggagtgcagtggcacgctcatggcttactgcagtcttgatctcctgagctcaggcgatgctcccacctcagcctccctaatgtttgtattttttgcagagggaattttctcatgttgcccaagctggtctcaaactcctgagctcaaatgatctgcccacctcagcctcccaaagtgctgggattacaagcgtgagcaccatgcccagccagcaggactattaaatagcaagtcagagaagaattcaggagtctgtcttcaagcacagtgatccctgtggtggattcaacaatccagttgcctttcgctaccatttagaacagcatctttgaatctttgtttcttatttggtgtaggcagggagctcccttaaatgttcaaatcaaagagaagagaggaaggaatgtacagagggaacaactggtttgatgctatgagaggtggtttggcatatttcgtgttttgaatatttcataatgcgtattttaaatgagaatgtataatatttttgttagtgatattacactacaattattaccttctatctcactcttggataagaaaatatgaacaattattttataatgtatccttagagatacttactcctaagaagtgaatttttcctttatcttatatgcatgttattcttggtttgattaatcaagaataattgataatgagtctaatctacctaaatgatttcttgatattttaatattatgtgtcattcactcccaattcaaagtaagatgtactgtaatgatgaaagaaaaaataccttcttgcagccaattgagcttcatgatgtggcccttgattgaatttccaatggaatagttcattttaatctgtacaaattggaagcaatgagaggaagaaaagtttccatgaaacatccttagaggcagcaaagaggttcttttagaatgtcaggtcattcaggcctttggcctgaggattagcaggggagatgcctagggaagctaataggttctcaacgctgccagaatctgcctcttggaaaatagttatctttaatttttggtgccatttaacaaaatgttgtatcttttgtgcttcctgtctggacaaagcagagaagaaataatactgtcatataagaaggggacctatgtttgggaagtcagagacaatattttacatccctgaatttcaaggactaattcagtgtctggcagaatacatacagttatgaaattttacattgtttgtcacatgtccatatttgctttcaaatcttagtttttcagttttaatcaggaataataacaatagctcccaccttggctgggtcatttttaggataaaaagtcattatgtctgtaaatatgcttattgaactctcaaatatgctgtaaatataagagaagaaatattggaatactgcatttgtggtggaaggtgttgcttaggagagaggtgagagaggttgcagccagtgtactgatcattcttttgaagtgggagtaagtacagaaaattcaatacaggaaaccaagaaagagaaaccatttcgggagagaaatggagttcagttttgaactcaaaatgattttggcataactgtgaagtgtatatctcagacagtggtttcacaatgatcccctttcctgcctcagatggagaaaataaagattatttttcatagtggtcaattctattttgacctaaaaaaggaaacagtgtttttctagtcatctttttctagcttttcctcaaattcaacgttaatagtgtcatttcctatttaaaatgtgaaccatttaaagtatattcagggtacttatgttcagaaaatactaattctacaccaggaggcttatgatctttagttcctgtgtctacttatgtctcagtttagaattaatttcgaataatattacctacttttttttctcttttttttgagacagagtctcactctgttgcccagactggagtgtagtgtcgtgatctctgctaactgcaacctctgcctcccaggttccagtgattctcttgcctcagcctcccaagtaacagggattacaggcacacgccaccaacatgcctagctaatttttgtattattagtagaaagagagtttcaccatgttggccaggctggttttgaactcctgacctcaagcgatccacctgcctcggcctcccaaagtgctgggattacaggcatgagccaccacccccagctgatattacctacttttgaaaatatttcttttttcttagtatttctgttttttactataagtgtacattttaaaatcaaagtctggtcctaatttaagagaatggcaccattaatttatttgctgttgatttccagtcaaaagagttttaaaacagaatgatctttgatggaatcttaggttgtcaaatataaaataaaaagataatttttatttcttgttcataatttcttttatagtttcatattgaatgtataattctcttacataaattaatagaattacatagaaggatcgaaatatgttttatagaattttgtgttctttagttacattttctctgaaaacataattagctagaggaaaggaaacttgtgctccaaggatggcagaagtaaagcctgaagtgggacagagatcccatttagaaccaaactaaaggaatcttgttgggacttcgggcctcttttttccacctcccctagaagactccaccttcattgttaaggacctgtgttttctgataagaaaagacatttgcaaatactgatctgcagatggaagaacgtgaaagcagaggcagtgtgcttgtgtgtgcgcaaaaacactgttcaaactgagaagtgggatagagtggatccacgtaagccaagtgttctttctgtctctttgcatctttgtttagagtctagcttttcagcatgttttttctaatatgtaaagtcagtgataacttcaataaaaacaatttaggtatgaaattattggaacttaatttgaccatctcattcttttttgctcttaataagtcggtccattgtaaaagagccaagagtggaaaattgagtgctccaatgggaaggaagggtctcagcatctttttcttgctcccaggcagtctaatgaatatcaaggtagattaaatataagaaatttagaatcaatggagcataacttgaatgagttgacccagtcaaaaattgtgatgattggtcatttttataaacagtcagagtaggatagagtaggaaaatataagcgttgtatttgatgtcaggcttatatgttcaaatcttgccttggtctttttctacttcctggctgtgaagtccttggatgagtgatggaattttcaaagtctcaaatttacctgctccacctcatctgttatatggatacattgcaataaaatttaaaatatggacttatggactattgcaaataaggttcatatttcaggaaattgaacttgcaacttacatgtactgctaatcagggtcctagattaggcattagaaagtgacatgagaaacatgagatcaaatagggttccctgtttatccctgttcctgaaagatttagatttataactatggcttttctacaacatataaatcaaagttgaaagcctttctggtaagtatgtggatttaaggttaactgttctttcaaagatgatatctcattataaatttacatgaagtagatggctaaaatgtttgctagggctgattctgatgtttagctctgtcttggtggcgacactcttttcttagctttggtctaatataggatgatctcctaaatgtattgtccagtttattgtccaaaccaggactcctttcggaataaaaaggataatatactattaagatagctcttggcaaaggaaaaatgcttgaggtgatagatatcccatttaccctgatgtgattactacacattgcatgtgtgtatcaaagtatctcatgtaacctatacatatgtatacctactatatacccacaaaaattaaaaagtgttgctgttggggtgaaaaagacacatttggactgattggaggcaaactggggcaaataagcaccctagtattagaatactgcctatgggcctgtgatcagcttgaagtttggctcagcctcaatgttcccctaggtatattctctttcaatcgccaataattctgtcttagcagcaggttattctttccttttatgctgattaaagaaacaaattatattttgttttggctatgttttatttttaattacttagaggacttttactttttccttcacaggcagcagaaaaaaggacaaatagctaagtataagttgtcttccttcatataaacatatttaactgatttttaaaaatcagaatctagtgcctgtaattgctccctttattattatttttttgtcctttctccctatctgctaattgagtgcaacttctagcagaactgattggacattggcaattgcatgaattcatacccaacctcaaatgcttttacaagtattctcacatggagtgtactgttttttaaaaatgtaaagatagtttaccaaaaagattaaaatttgctttaccttgagtcccaagaggagaaatcatcaagtaaccaacagttttgatcatttttattttttacagaactctattataaagtaacaatgacttcaaataagatgttagccttaacggttaaggtttcataagtgtatatacatttttaaaaggctatttgttatagataataactataagatattgtcttgcatttttgaattaattcttctctagataccatgttatctaatttattcaacctctacaaacttttgtctcaggtgtgccctttctgtttcatgtagaagtcattagattctcctaaaagttttttttcctatctctgttccaaagtccagttttacctgaagaaatgattgtgtggtagcctgcattggtctcttcccctcattctcttgctctttcattgctggcctactttatgtaaaccttactccttgttttacttctggcatcccaggttttttgtggtcttatcactttctatgttttccacatgaaactggctttgagagcatcattctcacactgtgctctgaagcttgccaccttcctcctttcttcttctctggtgattttggcctgatccttaagtcactttcctttagaaattacatgatcataggctcattcatggaaagactgttagagattgtccagagcctaggaccctcttttgctcatgagcacattgagaggttaagtggctcaaatgcttcacaggtaggaattttttgaatactctatgaatttttactaaaaataggaattatattcatatcatcaaagtaatattaatgtggcctattaatgtgggctatctaggagatagaaatagcccgattatgtagaatttgttaattgttttcattacatgggatccatttttacctgtgctctactatattgtattagagtacaataattaattcctttgaagcctattgaatataatgtaagaggtaactaacccagtgtttggagaactattcctacaacctgctaggtgcagtgaatatatcatcctctaggtttctcacagaatttagaacccagcagagtttactccagttccaaatcctatttcttttcatgcagatccaaacccttttccacagcttgcactctccactcttctttcctactgtctctcctgcccatcctttctctctgtccccaggctcagattggaactcttttcttcccagattaactaaaattaattcagtgtctatcagaaacatgtcactatgtatacatgtatttgcttgggaatattttaaattggtgctaaatgataattttgtgttgtaatcctcttatttgcaaaggctacataaaatattcttgattatattcttgcatagcctataacatgttcttaggtttcctatgctatgtttatcctcaataataaacttttatatacacatacatacatacagacacacacacacacacacacacacactgactttgcacagcatcttctgtatcactgtaggaagccttaaagtaatactaaattaacaaaaagatgtgtatattgcaaatgcaaataacatctctatgatttattcaaattatagtgaaaatctatatatgctgatatggatatgcatttgtcaccaggactggtttgttgaaggttttaatagtcaaacatagtttgtaattatgttaaaaagacatgagataatttttcatagttttcacatatcatttattgaacaaataccattgtaataatattagtggaaatcagagttcaaaattatcacactatgtaagaaaaatctcttccaaaaatccaactatacaaaaaataaatcagctttgcttttacatatttccttctgatttcagtctttgtgcatgcacaactgagcatgctgtaatatatatacagtatatgattatatgttatatttaggcacccatctctatcattatttcagtagatgttactaatcttggagctttaattgttaattcattgaactaaaagtcatggagcttgtcacatgtgtctcagctcaaatgccattttacccaaattttagcacttatggacaattaattttaaccttctttaccgtagtgtttttatatgtaaaatgtagatatgaccacctagcttgaagggtcaaatgaaaaatacattaagtaaatgaaacagattttgaaagaatgaaagtgactggcccacaatgaattttcagtcagtattagctttccttcccctttcttctgtgccttccctcaaaacttcataaatataataaatgtaatagactttatttaaataattgtacattttacttcagtctgttttgtgcacatttgccaaatatcttgaggctagagttaattgatttttgtaattatgtcaagtgaagaaaactgcctatgaatatatgagttatttatattcccattttcaaactcaaacaaagagatttgctattagtttaacatgacagaaaacacctagtacaaatttttgttattttttttattctttctccttttggcttcagaactttcataaaataggaatctttccagttactgataaacccataatctttttactgcttggactcattttaagatataactcttctttcatgaccatttaactttatacttttatatctttaaagtcataatctcttcaatctatattgttttctgatttttaatgttcatgtttcagcaatcaattcttaatttcttaatttcttttaactttatttaaacaattatccacattcccgggtctactctttttctaaaacttctaatatatactgtactgaaaagtttgttttctcccatgtttatgtaagataattctacacatgaaaagtatgcttacatgaaaaaaaatagagggagatagaagttacagggatttaggtaagcatttaattctcctggcagttttacatactggaactgatttaccaactgttcttttataaaattaaactagacttgtctttcagaattgagctatcactgcaattttaatcaacaaaactagttcctagatttataactgattaaaggtcagtaacttattgagacatttggaggcaaatcagaacaatgagcataagtacactgaacataagtccacaatactaatttaaaggcattttaatgaaaaatgacttttattgtattgtagatttagaattattattactaaaatacagctaaagtatttctatggtgtataaaggattactgaactagtttgcccacctttggtgccactatcatgaatgtaataaataaatacagtctccttaaccctactttatctgttagtaaaaatacccagtgggattctatagaagtatagaatatatagaaaggataaagtgaaaatgactacatccataatctgtaatgaaaatgatttattacttgttattcatggtcacctataaaaaccaaataatcagagtaacatttattaagtactcacaatatgccaatcattgttgcaagcactttctaggcattatctcattaacgtgtagcaataatcttaataatgctggtgttatacccattttgcagaggagataaaggaagttaaacaatgctatataatttgcataacttctctgaggcacagaagataaataatactgtccgatatctgtgcttatttgtccccttattaactgtgtcaagaacagttttcactgggtttgtatcctttccatgcatcctctgcacttcttttttcctcaggtagtccccttgccaacaagaagccacattctttcctagagccctctctgattttctgatcactgtgatccaggttactccacacatttctactacattgccacattgtagtgtttggcacctctttgctgccagccgtaaaaaatttaaaaaaggcaaaatatttcttctactgagtggtcattaaaatatcctagtttttgtttcttttttggtgctttacaaatagctataattttaaggtagcttttgctgcatcacacaatgtcagtgattactctgaaatcactaataggctcagtgtctacccctttaagtatctgttcacttctctccagtttgtcagtatcaagtagttgaagctagcatgcactttatttcacattattcctagataattaaatatcagtttttaacaacattcctgcctgtaatcctagattttgtgtgtgtgtgtgtgtgtgccttctcaatctctagtcccaagttaaacaatttcactcagatccccattttagagtgtaccacatggtagggagtaactacacatatgtcacatgtattctatgttttatctttctttctaactgagagataagagtgcttagttagccatgattccttggcctagtgttatggaaatttgccagatctttatagtaaactagcccagtcctacataaaacatttaaccaatattcttcccttattatgaaaaaaagattaaatttaattatttcacagaaatatttcaactgttatagtttcacatttttaaaaaataaaatttttagaacatatgtttcaatgtgtttcttcctgaaattttgttgtcctctaatccgcaagacatttcaacattgtttctgaacacgtattctttggctgttcccctcacgtagagaatagaaagaaactaaaaaagaaattaacaatgattaaaataatacatgaaataggaagttaagactatagtgcattatttacagtaagtcatttttatttggtaagatgatgcgctgtgttaaggtcatcaggaaaggaaaaaaaggaaaacataaaagattatttttaccattatattttcagtttgcttctaatatatgttaatgtataaagtgataaatgctcattcatttgaaaaggggctatataagatagagacagggagaaatgtcaaatgtcaaataatagcaaaaacaaataatacacacattcaagagggagaatgacctttagaatgtctaacagctgcatgtggtctaggtctctgctggaacaggataaggactgcatcttatgccatgttaaatgttcttctctgcaggagtaccagagcaggggaaaggtgcaagagagtgacaggtcatttcagctaatgtcagccagatatgtggactttatcactaaagataccagagatttatggaatggaacactttgaagttcagccagagtggttgaaaataaacattcagaagtaatcacagcataacggacttgcgttcattaggaaaatgatgacaacttgtttctgttatatgtggttatactcctaccatatttgcattaacctctgctagcttctcaagtaatcatgccaaggacactggtatctctttcactagagacgatagattggattctaaatttactatagcattaaacttgtatttttccctggattgttcttgaattttcttgttttgaaaggtaattttatgcccgtgatcacaaacagcataataaaatgtaacctgagaaaaacctttgttagcttaaggaactaaaaacaacattattttgtttttgtttctgttgggtgttcggaataaatttaaaaagcagaagtacctgtaagaaatgaatcttttaggagtgtgcttttctaactgctacagctaaggattagttaatacctactgggaagtgttttctcaatattaatttctgttttcatgtttcctctttatgtccttgtaaattatttgttcatttttatttttagcagaaaagagaagattggacttgaagctggaataaattattatttcacattatttttaaataatttactctctggatgtccctagtctcctgggtagagtttgctctgtgtgcacgtgtatatatatgtgtgtgcacacgtgcatgctaattttacttcataatagtcattttttccatgtctagctttcactattcaagattattaaccctaaattgttaatattccaagaataataattccaaatggttaagcatcacaagtggaatagtaccaaaattcttaaactttttttttctgaggttctgatcctctaggaagctgatagtacagaactgtgcttgctggcttctttttaagccctctctatttaaactttggagtttattataaaaggaaagaaaaccaaagatgacatctacatactttatttccctattttagcttccccagagtcatgctgaattgcatgaactcaattcaatcatattgatgtttctccctgcttgctcacttttaatactcatttacttagtgtctgtcctgttggtcatttgtaagataaaattggcagaaaattttatgtaattattatttcattgcatttaaatctcatcctgtctactttatagagttgttaggaggcccaaatgaaaaattgcaaagcacaatgatatatattgattattttgatatttagcacattttgtagaatatctacatatgccctgggtaaacaatgataaacaaaatagaaaaaacactcaaaaatcttgtcttcctgcagcttacctctaaaatggaagacaggcaataaaggaatgatgacatatggaggtctatgaagaaaaaacaggagcaaaatggggtagagagtgatagaggatatgaatttagattagggggccaatgacattgtgtctgaggaaatgacatacaacagagactaaaactaagtgattattcaggaatagattattctagtgggaagaaagagtaagggaaaggagagaagagagagagggaagagaaaggagaaaaaggaagaggagtatgggaggaaagagagagagagagagagagagagagagagagaaacatgctagacattttgaagaaccagcaagaatgttagtgtagccaacagtgaggcaggcaaaggtgagtaaggtagattagttcagggaagaaaacataacattatttaatccattgtgggccacattgcactatgataacactatcatgtcatagagtctcaccattgtttaagatgtttaaattttttaatacgaatatattctcacaccctccgttttttagtcaaaaacctctccctgaatatcctgacaacatgacagaggatctgctgttcctcttcagagttagtttccttgcttggaaggctccttgacagcagtaaccagaatcttgcagtggtttggatggctggttttagtagtagtgacctctgtacaagcgtgtctcactttcaatggaatgtccacaaggcacagattacagattacctctacatgttaattggatctatcatactacttgggcaatatttataaatagagttggtaagatttcaagaattcctcccctcaagaaagaagaatgcttagataaatttttattcatagagacaataattggaaacgtcttattcattattccaaaaagaatcttcttgtggtttctataaacaaagtagctaatataatataaacttaagtttaaacttgactttatattatttcttttgtgaaaaaccattttatatatatacatgtcattataaaatatatatataatcatatagcctgtgaattacagtggaaattctaagttcttgaaacaaatttctagctagtaactaaagagaaattagaatgtgaaaaagttctgaatttttttcaaactcatcttctcaaatgtatatgaaaatgatctcaaattaggatatttacatttctaggaaaatgtggtgtcctttaaaagtatgcactggaatttcacttatcaaaattcatttaaaaactctttattgagcaattactactctgttcaaggccatgtgttattcactgtggaggtactatattaaataaaattgtagagtttgtcctacttgtagttcataggagattgagatgtataaagaattgttgcaaaacacagatcatgcagtttgaatcattattgccaaataatgtgtcagactgaccttgatttactttttgaataaagttttaaatggttaaaatatattttaatttctattaaagttagcacaaactctatatattatttttaagtagaaaggcaagagaaactatgtgctaaccacaaaaagtgccagtggataagcagtctgaaatttagacattagaggtgaaattcaggttacggcacttagcccgatctgtcttactttagttagctgagcattgatctgtcttctagtatttgtgttaccccagaaggaaaagaatttgccttacatattttgctgctcccatgaggaatggcgctttgcttttcttttattgagggtaagcaaatacttgtgaaataatagaaagataggaaaggaggaaggaagaaagggaatacatgcagacacacagtatctactagtttttcatttgttatttcttctaaattcagaaaactggaatgactcaatagctgacacaatttatataaaaaacagtcaaattgctactgtttagagagcagaccctattgagccagacaatttttttaaaatcctggtttacataacactgtaatcttctacattttaatttatacagtagagttaattcctatttcattggacttttaggcttactttgaataagatgaggtatttacaaatctaacacacaatagaggcaggaacacctgctgcatgatttcctagcattattttcccctacctctttccagtatgtcctgatttcactgtggatatctacagatattgctgcactaggagtacagcatgtgacccagccttcattaaaccattgcatgtgattctcttgtcagtggtagttggtaagggggtcacacatgtcctaaactggcagagtttcagagagtctcagaaattatgcttgaagcttagaaacttgaacacacgtttacccattttcagtgatagtacttttctcagtccctttctgctgctataggataatatcacagactgggtagtttataaggaaaaaaaaatttacttggatcatggttttggtggctgagaggtccacgattgaggggctgcatcttgtgagggtcttcttgcagcatcatctaatggcacaaggcagaagggaaacagggcattcgtgagagaacaacagattgaactcacagcctcaagccccctcataatcagcattagatcattcatgaaggtggagccctcatgacttaaacacttcctgttagaccccagctcccaccactattgcactggggaataagtttccaacacatgctttctggggaacacattcaaaccacggcgttccacccctggtcccccaaattcacatccttctcaaattgaaaaatatattcatttcatcctatagtcccccaaatcttaacccattctaatatcaccttaaaaatacaaagtttaaagtttcatctaaatcaaatatgagtgagacttaaagcatgatttattctgaggcaaattattttccatctgtgaaattaacaagttatgtgcttccaaaatacaatggtgggataggcatagggtagacatttccatttcaaaggggagaagcaggcaagaagaaaagaataacaattcccatgtgagtccaaaacccaacaacgaaaacaaaattcttaaagctgtggaataatctcctttgattccatgttgctcatcctgggaaaactggggtggggttggcccttaaggcctcaggcagtcctgtttctattgctgtcctgggctcagtccactcagcagctctcacagatgggagttttgttcctgcaagtctacttggctggaattgtactctgggggctgtatagttctggggtcttgaaggcagccctgcctcccatggctccactaagcattaccctagtggagactctctgttgtggctctattcctgtaacaagtctctgcctggtctcccaggctgtctgagacatcctttgaaatctggatgaaggccagaatggccccacagatattgcattctgctcatctgcagagtcagcaccatgtgttgcttgtgtgtacgtggtgacacaagctgcagctgagcccactggagccacgattaggggtcagttgagccaatgttctggtggccaaggaacactgcactggaatgtagtgggcagagtaccaagctggccatgggcagtgaatgctgaggccccacaggtgcctttctggaaactttgtcctcaagatcttagtttgcctctaagatctcagaaatgcctttagggtcattctcccattatgttgaatagcacctgactgccttctatttgtactaatctttttagcagatggttgcttggacactcttggtttgctctcctaaataagcctttttcatctttacatggccaggctatgaattttctaaatttttcccttctgcttcccttttatttataaattatatctttaaataatttttctccatttgcatcttactatacatggttaaaactagacaaacaacttcttccgtattttgtttagaagtttatcccaccagataccctttttaaaaacatttcatttatttagttagatatggggtcttggtttgttactcaggctgaagtgcagtggcatgatcattgattagcatcaaattcctggtttcaagtgatcctcctgcctcagcctcctaagtatcttggactacatgcatgtgccaccacatgcaactaattttcttttcattttttagagatgaggtctcactatgttacccaggttggtctcaatcttctgggcccttgcaattctcccatctcagtctcctgagtagctgggattataggcacaagctacctagactggctcccaccaggtatcctggttcactgctcttaaattctgccttgcataaaatcctagggcctggacacaattcctccacattctttgctactttataacaaggatggcctttactccgttttgcaataacttgttcctcatttctgtcttagacctcattggaactgcctttgccatccatatttccaccaacattctgattatgaccacttaagtaatccctaagaagatttaggctcttgttacagctcttgttttcttcttagcccttgctggaattgcccttaatgttccatttatagcaatctgtgcttttgttagcctactccttcaaattcttcctgcctctatccattatctagttccaaagtcacttccacattttcaggtatttgttattgcaagaacagagatttatttcttatagttcttcaagttgggatgctcaagagcatggtggtggtatttggtgaggacttctgtactgcatcatcccacggcagaaggcagaagggcaagagcacatgagaggaagagagcaagaggagtctcaactcgtttttttttttaacaagcccactctggcaataatgaacccactctctttataatgacattaatgcccacaaggtagagctctcgtgatgtaatcagctcttaaaggtcccaccactcaacactactacaatggggactaagattccaacacataaattttgggggacacattcaaatcataacagtactgtatgtggatgaaaaacctacacttgctctctctatcttggctttcagcctgacaacaaagccagcatgcagaacagagctgagccaagaaaatcacagaggaacagagccaagttttgatagtactgtgaacctctggatcaaattgtgcctggagcctgccctccctctagagttttcattatacgagccaataattttctgttcaaagttgatttagttttcttttttattctacattaagaatttgaactgatacaataggtagtcaataaatctcagcttcatgacctcttcagcagttgactactatattggaaagggtcacattccttgtggctttttatcttgttgtttgaaagaactgtggtctaagaaaaattatgtttaaagttttaacttcagagttagcatcaagctacaccctttgcagaataagagtggtatattacaaagtttggcatgaagttactctcagcctgagtgggttggaatcccaatccttttagacacttgctgtgtgacctacagtgatttactcaacatatcagaacttgttttctcatcacataaaagatcttggtattcttttctcacagatttattgtcaaataagagaattgctgcaaagcactgagagatttgcccagcatgtaatgaactctcagtaatcattaatcattattatgatttatttttctttcagtctgactttggggaaaagttatgttaggaagctgctgaatctcaattatgattttcagtattaagcaaagaaatcacaggtatcttgtgttatgagtaagtcaatgcatttcccaattgatctgaagcactttttcttacttatgcaattaaaggaagtctaaagtatacaataaaaagttatttgtattttaaagggtataccattactggggaatattttctgccaaataaaaaataatgagttactcagagagatggttgaatgactagacttgaatggtaataaaaagccaaatgccaaatttgcacataaaaatcatcttagaagtgtaccctgagtgattgattccaagcattggtttatctgatgcttgagaagtcaataattgaatagtttttaaagagctatgtggtggtccatggaaggaaagtcactgttttttactttattttatgaggacaaaatttatgtgtatacactgacaaacttacaaatgcaaaaaaattaaattgctgcataattttattatttagggataagaatggctaacattataatgtatggccttgattttcattacatacacacaaatatttgcggtaatgtctatgttatacaagtacatatgtgcatgtgtgtacacatttatttgtaagtaatttagtgttctggcttcatgtatgcttagtaattcttagatgtcataaggacaccataatcttcatatatttagaactgatatccttttctaacccctttttcactcaaagcttcattatgatgtctgtttcagtgacaggcaacaacatctagcagttgggaaagccagatccctataaaaatgcttgaagcctcctttattctccaacctcctaaccaattaaacatgagtcccattgtttctgcttcctaaatatctcaaatctgtccattcctccacatttctacacttgatcttagccaaaaggttaagaagcaatcgttcctccacatttctgtactattccatagccagagttcccatcatctctgactttggctgctgcagtaacctcaaaacttgcatattggtgtccactacccctactcacctattctcctcagagtaatttgagtaatattttaaaaattaaaaataacatcatgtccctactgtgcttaaaatctgtatcttactatttggcctccatgggtcttaagataaaacagtaaacgttttacatgacttataagtctctagatttttagatctctacctcctcaccaaccattgctactcttatcttttgcttttttagtttctcaaaggtgtcatgctgcttcttcttcaggaccattgatttttttgcttcctatatctagatgactcttgaaacatcacacccatcatgccccacgattctaatcaaatgttatttcctcactggagtctttttggctttacggaccaagtcaggtctttcgttgttgtttttttttttttttttttttcatgaattttgcttatacttcacagcatttacctcagtagaaattaaaatgtgggggttctttgaaactttatataatatgtctctcatgctactatatacttcacaaggtcagggactgtatcttaacttgtcagagccatatctccattatttagcatagactttgctcgtaagactgcacataatcttttgtccttttattgtttcataaactctgtcttatcttttctaaaataatgtttttaattttggattgttgtttcactgttaagatagaaaacggtttatttaaccaagccccctgttattggacttttaaattatttttgtctacttattataaataatattgcgatgagttcaggaattcattgaattaaaggcattgtagcttaagttctctacaagcagagcctgagttggagattcttgggtaagcaatttattgaggaatgtgcccagaagaaaagtgaactgagtgaggaaagcagaatagggcagaggtagaagctaagtgtattagtctgttctgacactgctatgaagaaatggctgagactgggtcacctcagaaaactcaacaatcatggccgaaggcacttcttcacaaggctgctggagagagaagtgagcaagagaggagctaccaaacacttatgaaaccatcagatcttgtaagaactcactcactatcagaagaactgcttgggagcaaccactcccgtgatccagtcacctcccaccaggtctctcccttgatacctagggattaaattgcccaaggagatttgggtggggacacaaagcctaaccttatcactaggcaaataaatggttccagaagaagtctttcctgagccagattccaacgaggtatctggagtgaaaatagcaccacagtagttatcactcttagaaactaagcatctaggctgttacatccattattctttggccatgaactgcctgcgtgtgtgcatatgtgtgtgtctgtgtataagtgcacaggtgtaaacttacagtggcttgcctgtacatgggatctagaagaagcaccaacagtatctggtacaaaaaagaactagggatgctgcatggaagagatttttcttaagtattaagccttgggacatggtaggattttgatatatacttcagagggaaaatatgttctgaagagaaaaaacaaaagcacaataaggaaagtgctgagcatgttttagagaaattgaatagtttgttataaataaaatagaggtaaagtgaggtgtgagtatttggagacaaaaattataaagacggattgtacctataccataaaataacttaaattttaaactttatagaatatacattgtgaacagaaaagtttttcaatgaagagtattcacagatacattgcattcgtataattttgggttacttttaaaggtctaaatattgtctactgacacatagtttcttacagtattaattgagaaattatgatagtttaagtaagcacaaaattatataacattgttcctggtgttgagactcttacaatataggaacatacacaaaaacatacacacatatttgcatatatatagtatctctcagttttatgtgtattaaattcatgatacaaaaaagaattgttctgaaacatagctatctatctaaaacattgtatggtaaaaattcataaaacttacgtctatgttcctaaatgtcataaaaacaattgaaaattcatttttaaaggaaatgacatgcaaaatagtgtaaagaaaagcatattttgtgtacacgtagaaaatcttgtgttcataaacattatttaaaatcttaaattataatcttgactcctaaaacataaatctaatatttagttattctcaatttaatttttctcatttgtaaaatgctgttggacactctttattttacaggaggtgtggcaattgaagttaatgagttaatgtttatagatgctttttgaggcctttagatgaaaggtacaatataaatccaaaatattaatctttaggtgtgaaatactctaattacttcccattgccatagggacattattggagatttataccttcctctaaaatacctggaacaattgttatatgagaaagcataattttaggtgaaccattataattctgtagtcattaccatgtatcaaaaaataaagtatatgtgttatatattcagcaccttcttatttcccattattcatttattgatatacaaacattaagatgactcggaaagctgatccattatgctgttctatctatgttgctgctagaatcttttttatatacagaaataaggggaaaatatttttaaaaagaggttgagagagcagctactgtactccatatattggttttaacactagaccaattcaatattcattaactatcctatgatagcaaaggaagaaaattcgtcattgtagtagtattcttatatttaagtaatgaaagtggtaccatttatcgactatatatatttaccaggcatggtgcttatcatatttcatacattattatgatcctcatagtaaccctataaatggagatggaactgtggaatttaaacatgagcaaaggagacaaacaacaggtaattaattagctcaaggtcacagaagatttaaacccaggcaatgtagaatcctgagttttttctttaacccctgaagtatactaatttccccaaatgctaccactttattattctgtttatttcactgttatggatcctactgaatctagactgcacaagataattttaataacgaaataaaactcgaagaagttctcaccagaagcagaggtttcccttgccaagttattctacatgagctgcttatctggtttcttgccaaaccaatatgcataaacactgaaattgcagaaagaagaatgcaaatcacaaagctcgtttttattaggctcatgttgaaaacacataactgagcttagcacgtgtaaactgagtttaagaatggttgtggcattttcttgaaaactgggaaaaaatattgtatatttatactccacaaagtaaaccaaaaatatccctttgaagtatttaaatgaacaataaaaaataatgtattatttaagataattataaaataaagctattacttgtgaaaatttggagaaattatgattctagtttaaaagtggtatctcctttctcctttctttctatttcgctctcccacctcacccccatcatctcccatatacttgtacaatcacaatcaccgttcatgtaaatcaaatttctgaaaccaaaaacgaggtcttattcctgctcagtccaatctatttgccacattttcccgcatgagtgtcccaaagtaaatttgtatgatgttatttacagcatctcagagactccatcaacattcaattctgatcttggtgcacaaagcccttcttgatttggcacttgcttaatttccagttcactcctgccactctcagatgtgcttcctgatctttgactttccctgtagaaatgctacctgcttgttcatggcttggtgcctttcaccatgttgttctctctaactggaattctacatgatgaacacctactcattgctcaaaattcaatgtaaataaatagttctctgagaagtgtttctgaccttctccaaacagaaggatgatcacccctgtctagacgcttgcatagcactctgcatttactatattgaattataatttttattcagcatattgcattgcaattacttattcactaccatatttattatcagcctattaaaacctgtgcctgtggcttattggtcttgtttaccatgactggtacagtgcagagtaatgtctagacagttaaaatgggaacttctctgtctctgagtttttttctgagaccacaaagcagacaacagtatgggtcaagtatttttacattttagactgtctatatgagcttgtaaagggggttcttaaaccattcctgcagttttgtgataagcaaatattataaataagttaagttctaatacaatatcacctcagtattatatacaaaagggcagtatctagtatataaaatataaaatgtgtatactatacagtatatggtatacagtagatagtatatataaaagcgcagtaagctgctgcccttttttatttaatatatgtggcttatacatttgatggtgttaatttttcaaatcaggttagaaaatcttatcagtctgctagcacacttcagttttgcacctttattacttctgtcactgccatgttatgttactattgaaaataagccctgtatggtccaatgtgtcctacctaatgtggatcacttgctagtttagattcctacagcaagagatggcagttctccactgactttctaaggcttcagagatttttttcagtttatattcatatgctcagctatttcactgaaaaatgatgccactaaagtctagagctgcttctacccccatccacagcctacattgcaatccagcttccccaaggccactcaataataaatgtgatgataaatctgttacaagcagataaacacttgagaatcaaggttcatctattggacacctatggataaatgagtatttggggtatttaaaaaatttatgtggcccagcgtggtggctcacgtctgtaatcccagcactttgggaggccgaggcgggcggatcacgagattgagaccatcctggctaacgcacggtgaaaccccatctctactaaaaatacaaaaaaattagccaggcgtggtggcgggcgcctgtagtcccagcttcttcggaggctgaggcgggagaatggcatgaactcgggaggcagagcttgcagtgagctgagatcgcgccattgcactccagcctgggcgacagcgagactccatctcaaaaaaaaaaaaaaaaatgtttatgtagcaacttgaggataccaagatggtcatccattgtaccttgctggataatttttaaattgaggaataacaaacttatttaacattttattcattaattaaaaaatatttattattgtactactgcgctgggcactgagaattcaggaatgaacaaaatattccaagttgctatgctcagggaacttacaatctatttggggagacaaaaaatgcactaaaatgtaaatatgtatgtgtgtgtatatatatacacccataaatatttatacacatatgtatgtatatgtcaatatcatcaggagacttaacatccagttggagaaaataagttatatgttaaataaaattcaacagttaaataatgcatagaaatataaaataataattaaaagtcccaagagagaatggattttggtgtatttgtttaaatagtgaaactatgaattaagaggatgtgatcactctagcttgaaagggttattgaaggaaaggagacttgagcctgaagaagccatataattagagaagtcagtgatctcatcaatggctcattttagttaaagcatttagaagcaacagtcttacattagaactctagaatgtttaggaagatttactcataacctatacatatcaatagaaaggtgttcttggaaggaaattcattaaacaaaatctgatacatcaactaagactcaattctgagtgttccttcatagatttctgcctaaacaattttggtggagggaattttcagtaacaccataaagtgagtatattgattgtcactgtgaagaaaagcatacagattttcaggcaatctgttcattgatagatgtcttaataaacttcaaaactggcagctgcttcccaatatcctaatattactaattgtgctatattctcttcgtcacaaactatatcctgggaatgagttgacaacctatagaaagataaggatctcggtcccgtgtgttcactgtgtacaccacgaatgaatgggcaattgtggcatagtgtaataggcattcagtgaatatatttgttaagtgaatgaaatatataatatgaactgaaagatataaactgagtattccctatagtcctatggggaaatttgacatatttcgctataatgcaaaaataaatttaatttatcatttcttatttaagcttattatattctcaatatttctctcctgcttatctattggagttcctctgtaaatttaacttttttgtaaaacttcgattttcttctctgtgtgtttttttgcatggtgggtgatgttaccaactgcaaaaaaaaaagctcaaatcaaatcaacatatatatgtttgtaattatacacatgcttagtactattattatatatgtaatatttacatactatacataaacatacactatacacattataaatgtacactctctgtatttacaattaacccttgaacaatgtggagattgtggtactgaccccctgtacagtcaaaaatactcatataactttttacttcctagaaacttaactactcatagcctactgtagactggaagcctaactaatagcataaacagtatatataatgtgttatatataaaaatatgtgtttttaaatatatgtgtttatattatatatatatttggagatggagttttgctcttgtagcccaggctggagtgcaatggtgtgatctcggctcactggaacctctgcctccgaggttcaagcaattctcctgcctcatcctcccgagtagttgggattataggcacccgccaccatgcctggctaaattttgtatttttagtagagacagggtttcaccatgttggccagtctggtcttgaactcctgaccttgggtgatccaccagtcttggcctcccaaagtgctggaattataggcgtgagccagtgctcccagctatatatgtattatatactgtttccttacaaaaagtaagccaaagaaatcataaggaagaaaaagtatattttatgttaagcagaagtggatcatcataaaggtcttcctccttgtcttcacattaaataggtagaggaaaaacaggaagaggaggagctggtcttgctgtctcagaggtggcagaggtataagaaaatctgcatataagtggatctgtgcagttcaaacctgtgttactcaagggtcaacttataatttaataattataatacaatatacaatttttttaatgctaagatgaagccaggcgactgagctgatctgagactacattttctgtaggcatgccatctgggtttctttaagcacacctattccccttcctcaattttcaatagaaatgtgttatttgcccattatttgtaaataaaagtatttagagtataaaattaattgaggaccactgtgaaagggcttagaaattcttaactaaccactttcttccctatgagttttacatgtattgcatcattatatttccctttattacctaacatttttaagattcttggtttctattcaagttatcttttgctgcaaaatatctttttccttacaaacttagtggctcaaaacaagaagatttattttgctgaggaatctgtgatttgggcagtgctcgacagggacaactattcctttcttcactcggattcgagtggtgtagctcaaaggctacaggctagaattttctgccagcttgctcattggtggtgaatgctcagatcagttggaacctcatcagggatggggctagaatacctacctgtggcttttctgtaattccacatagtgtattgtctgaggtctcaggtgaatgtcccaaagagatagagggaagctttattgcccctgaagtcacatagccttccttctgccatcttctgtttattagaagcaagtcactaaggctggccttttttgaaatgtagggagttagataccacctttaaaaaaaattatctcaatagttttgtgggtccaggtagtttttgtttacatggataagttctttagcagtgatttctgagagactttagtccacctgtcacccaagtagtgtacactgtacccaatatgtagttgtttatccctcaccctcctttcagctttctcccctgagtcccaaagtccattatattattcttatacatttacaactttatagcttagctccctcttataagagagaacatgtgatgtttggttttccatacccgagctacttcacttagaataatagcttccagctcttataagagagaacatgtgatgtttggttttccatacccgagctacttcacttagaataatagcttccagctccatccaagttgctacaaaagaaattatttcattccatttatggctgagtagtattccatagtgtgtctataccatgttttctttatccactttttggtcgatgggcacttagattagttccatatctttgcaattgcaaattgtgctgctataaacgtgtgtgcatctgtctttttcatatagtgacttcttttcctttgggtagatacccagtagtgggatagctggatggactgatagttctacttggaaacttcgtactgttttccatagtggttgttctgatttacatttctaccaggagtgtaaaagtgtagacaccacctttaatggttaaatattgcagaaaatcatctcagctttctaagtcataaatgatattatggtaaagacaattttgaaatttcacagagaattttttaaaaattatctataacgatttcctgctattgccagtttctggatatcttctgcttatttaaagatgaaaaaagcccccaatacttttttgaccatcacacaaactatcttgaggtctcttgtaaattaaaacacaaaagttcttgaaagtaagcatcgttagccttctccttttggtttcttaattaaccccataatcagcatattcaatcatcaatctttttagtatacaaatgatacaaagtgacttatcaaaagtgttgttaataatttacaggtaatagagtaaatttatatgtttatgtacctcactttacttcttgggaaagacatttcgtgtcaaaaagcataatctgaacaaacaagaagcaccactactgattgggaaactacttactttagtgctaccttatcagctcttacctataagccatgtcagctcctcactggttttcatccctaagtgacatcagcagcagcaacagctattgtgttattgatttaaatccttctgagatcaattcaaaggaggagaggtctcatttccattggtttgtcctgtttatcttgtgtagggacacaagtctgagaaatcaaaattttattctcttgtttctaacaagccttacaacattatatttcattcatggtataatttgactcatattttattttctgaactttttttgttttgttttgtttgcgacagggtcttgctctgttgcccaggctagagtgcagtggtgcagtctcggctcactgcagccttgacctgccaggctcaactgctcttcccacctcagcccccacaagtagctggaactgcaagcaagcaccaccatgcctggccaatttttgtgtttttctgtggaaatggagcctcactgtgttgcccaggctggtctggtacttgaactcaagtaatccacctgccttggcctctgggattacaggcatgagccaccgtgcccagcctatttcctgaactttaaatacaatatcagggagaaaatcaacaatattttgcagtaaaagttcgaatattcatgtaaacatttgtactcttttcccattccattggaatagttaataaaatcagaatataaaaatttcatatgcaattaaaaaattcatgataagttaaaggagtttccatcttttagtttaatgatttaaagattttacttctaattattttagttgcaagtgatatgtatttatgcatatatctatctctcattatgcatctgtctctctatctatctcatcatcttttgatacttctcctaggctgaatgtttcacattttttctcttagtccagaaaatatgttctgctttcctgcttatatggggaaaatgaccactgccaatagcttcaagtttatttctctcttattccagaaggctggcagattgagattagaatctctcatccaattttagtttctgaggagcaactgatttgccaagctggtgtcagctttttagccctgaaccaaaaaattgtggccaaagaatgatgagttcattttaaataaatatatgactagaaatagcattcaatattaggatagttcagtgtggaatagagataattattccctgaaattataaagtgtgtgtgaggctatgcacatgcaatatgtgtgtgtgtagatatgcctccatattgtggtatggcagtggtggcttatttgctagtgagataaacaatatgtgtccactttgggatgttacatatatgcctaatcaatattttgaggatgagcctatttacttctctggttgatttaagtacagaaaagtgtaatgaataatacttggcttgaagatctagctatacttagaataggttgacagaaccattaatttcaaatgaatatggacctttattttgggtagaggattctattatatatttgccaacaatgcagaatgttgtttcttaataatagtattgagatctaaaaacatttacactgtactgtgtgctcagaaattacataagatgaaacattggtataacctataggaaggcgagattgagggatagttgttataaataagaggcttagcttgttaagaacaaagaacagagtttttctgttctttgagatgatttatgaaaagagacacctttcatacattagtgcattaatatatgaatataatattatattgtaatattacgtaattgtaatattacgttttatgaaataagctaatcatctctgaaaacagcagcagctttataaaataagtaatagtagcagactttaactgttttgttgagaccgattatttgccctattgccaaggcaggagtacagtggcatagtcatagttcactgcaacctctaattcttgggctcaactgatactccttcctcagcctcccaaatagctgggaccacagtcatgtgccaccatgcctggctacttgttttactttttaaaatttttagtggagatgaggtctcactatgttgctcatgttggtctcaaactgctgggctcaagtgatcctccctccctggtctcccaaagtgtagggattagtcatgagccaccatgcctgaccagactttaatattttaggcgaatccttctagttcttaacgtttcaaccttatagattttatatttccaagcattttacataaaccattttcagtgaaagagattttcaaattatttccttgacagggatgtagaattagtattcatttcacagaaagaacaatgatatgataacagaagtattcactgttagggaaaaaagttggaactcagagttcctgaggcatgtttgaatttattcagttaaattatgtttatttcagaaagactgaagagctaaaagagctagtttcagctttcttataattaaatcagtgctttatacctgttaggctaggtgtaaatgaaagaaataggggtgtagaaatacaaggtatgttaattacagttcattcataatgcattgcaaaggatctttcctaattgcagaagcatattttaagaaagtttcaggtattaagacatagtttatgagatcttgcacccaaacacataacgtctccaggccctaagcaaggtaaagataacaaccaaaagttgtccagtttaaattaagtaaacaaactctgtggaattatagtagaaagaaatttaatagcagagggtagataacaaagagattgaagataactaattacaatattaattagtacctttgttggccttaaattggtggacctaagagagtactctgaaaatgcaacatgtattaattgaacatgtgggaaactaccaatactagagtgcttttttttttgagtgcctatgattaattgtaatgggaagatggagaggttttattaatgaccaccactggctagctggctagtaagattcttgataaagaaatgttattattcttggctttttaaactacacaccaagctttaatctgaagtatatttcaaaaagttaatgttaaacaatttgaaaatgtgaaacatggaaaataacacaattatatgtttataagagatagggtagttttaatgacttcctaagcagaatggactaaaaatgactaaaagtttgtctaactctatactatcacaaaataattgacttgtccgtttttaatgagtatgcacgtgatcaattgtcaagttaataatgccaattattatctcagagatgtcagtctattattaacctgtgacagatattaactatacatattggtaaataataaagtgtgcaaggggaaattaattaaactaatatataaatgtgagtaaaggggagatgattgatatttttgtatatcaagattttacttttatttaaaacatattttatttttaaaataaaatgaaatttaaaatattttataataagcaactcaaataaatatatgaagaatacattttagcgcattattttgagaaatttatcatctgttattaaagattttaattagggaaatatttttaaaaatagatggtattttaatattttgtattcctataaaaatacaattgaggatgtttggaataatctgcaggggaaaacatttttaatcttttattataaagtaaaacacagataatgaaaaggaaacatgaaaaatgaaatagtttaaaaatttattgtaagccaaacactttcataaccacatcaaggtaaataaatggaattttaccagtaacccttaagttcttccacctgcttctatcccaatcacaaatttctctctgaaaaagtagcattctccctcttttttatggttctactatatgcattttgggaaggcatataaccattacatattacaatccattctaattttcattttcctttagttctataagtgaccgtaggtcagtgctcacaaccttttcatttttctgtgtcttgctactcattttgattgtctgaatgtcagttgttgaagtcattttttttagtatcatgcatgtattacctcattttttcatggcataaagcattggtgctgaaaagtctactcataatctgctattctttcccttataactatattgctgtttcctccaacaaatgcccaaaggatgtattgttattctttaatatccactactctctctctttctttataaaagaatttaacttgatatcagtctttctggatacttatttcagatagatagtgtgctcttcaatgtacaatttcacatttttaaaatcacttcagaaaagttttcttgaattataattttaaacatttgttctgtctccttactttcattttagtctccagggtaacataatatatgtatattgaatcttgcttgcctatcttcaatatttatctattttgaatctgttactttttatttgtttgttgacgtttaaaatttccttccttcttcccttctatctttcttaaagcataatatgttgtgataaaaattacattttcttaacagctttattgagatataatttacataccatgtaattcacccatttaaaatgtatactgcaatggtttttagtatatacatagagttgtgtaaccattacttacaattttagactatgtattcactccaaaaggaagtctatacttaatagtggtcactccaattttccccaaatgccccaagccctaggaaaccactaatcgactttctgtctcaataaattgcctgttctggatgtttcatataaatggaatcatataatacgtggtcttttttgactggcttcttttacttagcatattattttcaaagttcatccgttatgtagcatgtatcagtacttcatacttttttatggccaaataataatttatcatatggatataccacatattgttatccattcatcagttgatgaaaatttgggttgtttccactttttggctatcatgattaatgttgctattaatatttgtatacaagattttgtgtggacatatgttttaatttctcttaggtatataccaaggagtagaatttctggttcatatggtaactctatttttaacattttgaggaagtgccaaactcttttccaaaacagctgcattattttatatttctacaagcaatgtatgaatgcttcaatttctccagattctcaaaaaaacttgatattacagtcctttaaaagctttatttaatttgaattgacatgtaataattgcacatattaatggggtagaggttgatattttgatacatgtatgcaatgtataatgatcagatccaggtaattagcataaccatcacctcaaatatttatcatttgtttgtgttgggatctttcaacatcctctcttctagctacttgaaaatatataataaattattcttaactatagacaccctacagtgctatgaaacactagaactttttcctcctatttagctgtaagtttgtagccataaaccaacctctcccttctcttccctcccatttactatttccaccctctaataatcacagttctgttccctacttctgtgtcctcaagtattttggcctccacatatgagtaagatcatgcattatttatctttcagtgcctgatatatttcattaacataatgtcctccaggctcatctttgttgctgcagatgacaggatttcctcttgtaatgactcagtagtattctaatgtgtatatataccacattttcttatccattcatttgttcaaggacacttaggttgattccatctcttgactgttgtaaacagtgctacaataaatatggggggcagatatcatttcgatgtacttatttcctttccttcaggtaaataacaagtagtgggattgccggatcatatggtagtttatttttagatctatgaggaacctccacactgttttccacactgggtgtactaattcccatcaacagtgtattagatttcccttttctccacatcctcggcagcatttattttttgtcttttgataatagccattctaactggggtgagatgatatggcattgtggttttgatttacattactcttatgattagtggtgactatttttttcatttacctgttggctatttctatgtcttcttttagaaatgtctattcagatcccttgccaaatgttaaattggattattttattattattattattattattattatattttttgctatttagttgtttgagctccttgtatcttctggatattaatcccttgtcaggtgaatagtttgcaaatatttttcccattctgcaggtggtcctttcacttcgttgattgttacgttttctaggcagaggatttttagttttatctaatcccatcagtcaatttttgctttcattgccaacacaagttattttctgctttttgtgtttgttgtttcattatactaatccacttaggtgtgaagtggcatttcaagtggatttaatttgcatttccctaataactaatgatgctgaacatccattcatgtgcttattggtcatttgtaggtttattaggataaatgcctatctaagtcttttgcctatactttaattgggttgtttaaatttgttgttgttgagtagcaggtgttctttgtctgttctggatggtaaacacttttgcttttaacagattgattattaagtgtcttggtttggatctcttcaaatttgttctagtaggagtttttttcagatttctagatgcttttgtgtcttccatcaagtttgagttttggctaaaggtttttgttattatttctttaaatattatatctttctctttctcttcttctgatactcccagtaatctgtatgtttgtcctacagtttccttaagcttttagtttactttttctttctgctcctcaggcatgatagttcatattaacttaccttcaagttcactaactcttttgcctactcaattctgcttttgaactctttcatctccagaatttctttttggttattttttataatttttatctctttacttttagttttgttttgttcatacatagttttcctgattctctttattgctttatcaattttttttttcatttttcaacttaattaaagacagttgttttaaagtctttgtctagtttttccagtgtttgggcttcattagtatggtttctgtctatttactttcttcctttgaatggctgcactttcctgtttttatacactatgaggttatttttgttgaaaaattgacttttaaatattaaaatgtggtaactgtggagattaaattctcctccttcctcagggtttgttgttatttttgtttttggagtctctaatcatttgtctagtgacttttccaaactatttttgcagagaccatatttctcgtcttgtgtgcctccttgaagtctctgttccttagcttgtgtttaaacagaagttttcttgaacaccagtaattaaaatctaaaacaaataaacacacaaatagccatctttaccagcctttccagattggctgtgtgtggggcccctccttcaacgcttaaccagacttgcactgaacatatggatcagcccaagttaaaagcttaacatcttgttttgtcatttctcaacatgtgtcatgccctggtcacgcacatgacttcctaattgccctttccataacctccatatcgattgccctaatttcccaagaaaattccctctcagattttctgccaaagccttaagctgtctattatatttctcaaccataaacttttgcctcaggcatccgcagaatgttttgcagccttgcaatgttttcaagaaatgccgaaacttttccaatgtgagttccgatttaggcaaaaagagagacaaatgccatgtgctggctcttcaggtagctcccagacaggttagaacatatctacacaataatttgtgaaaaagctctgctctgctgcctccagaaccagggaccagcgttcctcactgggaacatgggctaatatcttcaagactgctacccaaccatcaatgagtggggcgaggacagataaatatgccatagagcttccctactgtttttaagttgactttttctggtttcagcatttacttggttgctgtgaacctttgactgtcttatagagttctgacaaatttggttttgatagtttctgctggtttttttatgtttctgtggggtacatgagcttgtagctgcctactctgtaattttgctgatatcactgaagtcttcatttctgaaatggtatcttatttttttcctgagtattattacattgtttctgtttttgcagtcagaatttctggtattctttcatgccttttactttttcttaatgttttagctaattttaaaagaatatattactcttctctgggtattattttgtttttcagtagtaaatatgaattagttttgttggagacatagattttatacattatacagattgtgtcagcaagtcaatcagaatttattatatgccaactgtatgtcaattatatagcatagaaagtaaaacaaacttggttcaattatttatgattaatgttgccctagacctgtctagacagttagaattagcagatactgctgtgatgattgcctaacataatacagacaaaatggagatgagaaatcttaaggggacttataggtcaatgaaacttttcttctgaacttaccacctcccacctttattacgctatcatttagaaaattgcttatgaagttcttctgcgcaaagtttatttctgaaaattgtgccctgcttgaaatccttgttttaagatctttacatgctgccttattcttgtcactcaataatcaattcagatgtcactcactcatggcgactcctcctcattatcctagctcaagctgccttttctaatcatcaatatatgatgctgttttttgaaatgtatttgttttcatgcttatcatctgtattttctctctagaatgtaagctcctttaagttggagatgttttcagccatggccacattacgtatgtagtttctaaaaagatacatagctcagaatggctgtagatttttctcttctttgaaatggatttttttttacctcattatttccttggactaattgataattttacataggcactgtctacataggcatgcaaaattttactacttaagtagtaagctagagttatattgtgtgcttgagcaattattagcatttagactatagatttttatgaagtaaatatttaaaatgttactacaactataattaaataattgaattttaaatttcttttagggtgactttcatactatgaagaaaaaaaggtcataagggtaatgtgtgctaacagagctgacttactctcatacactatttaactttacgttatgacatataagccaaaactctaccctttttcaagctgctttcctaacagagtgtttttcaaaacaaacaacaaaaatatttggaacaaattaattctcagtttcaatatttataattattccccaaatatagagaagttttaagatacgtaaaatagagataaaaactatgaagggtttgcctgttctctggaatttattgaggtcatttgtacttataggatatcaggtatgtgacacagatcaattctcttatatgtatttcaacttgttttcacaaacttctcattcagccctatagccatgccagacagtaaaatttttgttaactatatgcaaaagttgatctccatgtgcagattgttgaaggagaaaaaaacactggttataattttcaaaaactaaaatgctaaataaaatggcatttcattcatccattcattcattcataatattttgaaatctagatcttatatttatacttggtcataacattttatttcttttattgaggatatttctttgtattaagttggggaaatttatttgctaactttcatattttaaaaaaatgtgtcttcaaataaaattttatataaaatgacagagtaaagaaatttcctccaaatttattggggttttttggttcttctgaaacaatagttttattgtatttgatgcaaaatttaaaattctgctttgtatatatattttctggttttcttatgttagagttcactattttaagtgcaaaacaaactgttctttgcctttagctatatatttatatattttttaaaaattagaggtttaggaaaacgttctattttaatgatctcttttactaacttatgcattccttatatattaaaaacatacatgcccactgatttatgagattctcagccataaaaaatttatatgcatattacatatatgctacatatatgtattaaccatatttatatgtagataaatactctgtacttgtgtgtatgtgcagtaaacacactcaagcacataccgcatgtatctatatatgtatagatgtttatgcatgtatatatatcatatagccagacacacatacacctatatgcatatttaaatatattgtctactgtgttttgctgtgtctactatgcttttcatatttcagtgacattgtttctatagtaactaatgcactgaaaaaatcaatgcaaaaaggattgaaattttacaaaaagccaacccagaaacatgcttaaaaattgatgtgcagggggaggtatttgtcttgggtcatacattttggaagtgaataaagcaaaatgaaatcattactctgtaacaaactatgatctagcaaggttggaataccatattcttttctttaaccagcaaattaccaaattattatggtttctaagagcaacatgcacggatccacaaaacctataggcagtgtgaatctgtctatattagacacagtgtaaagaggattagggtaatggtgccaggctgagacactatttccaaactttggatcaagtgtctgtttaaaaatacttctatttggaaaaaaaaatgcctttctgctaaattttaaatgaattatacctaacgtaaatggtaagtgcctgggaagaaggtcaatttgcagttatttgctgcaattttaattctagacatttaaatcattaggaaaaactagaacattaatatttcatattttgttaaaaccatattcaagctagagtttaagtatactaatagccaaaatgtttatgataataaaacagatctgagttaaacaaacagaaacacaaaataatatttaaaatttgaaaataattcaaaatctgctctcttagctttcccaggtaggttacctgtatttcaaagtactttcactctgttggtaaggaaaaggatatacagttgcttttgtaatagccattcatacatataatttgatcatttagtatcaatgatcatttagtatgttacacttgcctgttatataattttcacattattagttaaataaatacataatacaagctttttctgtatgatgacatgaacagttagaattattttctataataaaaagattaattaaaggcttatttataatataaatacattgagtagttgactgttctttctcttgttagttctttgagtcacagtattttaaaatatgatattttaaatacagttttaaaatacatatttatttgacaaatctatattgaacaagtcattaaaacagagctccttctggacctctattaagacagggctgatcacaaataacatgatcacaaatagttataagacatatttgacaagtttcattacacagttatagacaaagtattagatgaaggaaaatctgatgtgattagaaatatttcagtgtatttcatggtgtaagtaacattccagcttacttcatggtataactggcatttcagacaggacttaaagtgtgagaagggatttaatgaggagaaaagaagaaaataacagaaggaccagcacaagtcaaaacagagaggcatgatgggttccaggaaggctaagcagtctgtctgggatgcctagagcatagaaggcatatcagataaaggcaagaatgtgcaaagcactgagagcggtaatgagctttcatgttgttcactggagaggaattacatggttgcatctgtattgtacatatctgatcggacatactatatataacatattgtggagagttagttggtagaagaagagattgaatatatagaaatttgggaagagttaataaaagcttagctatatgagtatctcttgcagtcctggcagtggatgaactcacttgggaaaagaataaaaagaacacagaaacacttggggaacaatattttagaaattcttcaaggaagaggaattagggaagtagaaatgggaagaaagtttagagataacattgggaacttaagggaaatatcagtggtacttcattaatactataacctaaataaaattataatatggttattgtgaattatatcaaaagggataactttgtgccaattgctagatttttatgcagatttcattagtctactactaacttattaccaatgaatttgtgttccttcaaacagaaatgtggtaaatgtaatgatgggaaaaggcttttctatttcatttgatgataagaaaaatcatgaatgttagaatatatattctaatatacatattagaatgtaaggcatatatgtgccattctcattagtatagaagtcatatatgtatgctgtattctaatatgcatacttttttgcattatgtacttgcatgtatcaactaattgcaatttcatgttttgaacaatagtaacatacgtctaaatacacagaaagccttacataggcaacatttttctgtatggaaaacaatgaataagtcccttaaaatgtgtagacaaatattgtagttaaattttttagtagaggaaagctgatatcctgtttggttggccttaactaactaccaaatttttaagtagtgaagtttttgttctttgttcttctttcacgattttatggtccctcttccttcagtactcaccaacatgtagtgttctcatgtgacttctattctttctcttaccaaagcatgcttccttccatctaatgatcagttggaaagcttaggaccactgtgatcaaaaagattgaaaaaataactttataaagtaatagcatgaaactagttttgagtcatacagtcctaaagttaaattctagctccatactgaaatgattgcatgaatgttggcaagttacttatctgacctataactttttcatctgttaatcagataattagatataatttatagggctgagtttaaggatgtaattcacaggaaaagcccagcacaatgcacaggaaaagcccagcacaatgcctggcagtttgcatttactaaacatgtgttatgcttactctttctccccttcttacagaggtttgtgcatttcaatagagcatagcccctcaacactagggaatgcatctctgctccagaaacatcaggcgctactgagaggcaggttagacgggtgtttaggaattggaagcctttctaccatctctgaagtggcacacctgctctgcttgcttgggaggccagcatggtctgtctagttgccaactcaatgaaaggctttaaaagcttgccaaaacattttttcctaggcaatttcccttaggcttctaattgcaagtgaattttaaaatatgtgacctatgatattgactatttctgaaaaaaaatctttatagttgggtaccagaggcagcagtcctgtgattctaaatcccttactgagcagagaattctcatctatctgaattgtatttctttgtaaactacctttaatggtttggtttgggcagcctaatctccctctggagataagaaagaaattctatgaatacagcaagtatttgaagacaggaagggagaaaaggagaaatatttaattaagcagagagctttacctagttttcccttactgttatttataagcaatacattggctctagatttatacctatgcagttccacaatctttattctggctcaagcttctctttttaatctcatactattccaagacaacttgttggaggtaactgtgccctacctctctcttttctgcatctttatccttcagctgggatacacccccaccactccttgtcctcttcataaaattgttttgattcttctaggattagcctgtgtgctgctgcctctgcctgtttatgcattcatgagttcgaataaaaacacaggcagataaacaaaaccaaaccattactgagtgccatatgccagattctagacatagaataataaaaaaaaatgcggttcttttcctaaaaaaattcatagtctgatgggaacacctgcatgcatatcaacaaatttaaagcaatgagagacaagtgaaagtagagtcacattccacagccacccagcattgttcaacggtatcatggaggcttcataagattagtgatgtttgaatggagtcttgaaagataagaaggaatatactaggtagagagtggaagggattggggcagaagaagcagaggtatggaagaccatattgagtctagggaatcatcaggtctttcagagcccatatctcttaaaaaatcacattggcaatcctgattcaaagtgatctccacaggaaacttttgtggggttttcccccttttatatcaactgtaagtcttcatttttatagataagatatagatatttttctaggttaaatatttgtgttctattttaaattgcttggtgactgataagttgcttgagggtaaggactaggtctcttctacttttttattctttaacacacccataactgagttttgtaattatttttatttattgtttactctgtaccaaggactcttaagaaatgtggttttatatttctttaactccaactaaaactccattaggttaggtactattattaccctcaatcacagttaaataaggcaatgcttagtgagatcaaatgacctttctaggaggcaaattgaattaaaagatctgatatcagagccataacttaacaaatactttatttaaccttcgcaggtaagtcattctacatgttcctactaaactctaaatggacaaagcaattctgaaattaaaaataatagttcaattaaataactctacgtgaagacagtgtatcagtatatggaaatattcaatgtaaattgtatattagaaaaaaaattgtgtatgtaaattgtatatcagaacaaaagttctggaaagcctttatataattgaaacagtaaaaatctcaaggatgattttcacaaccttgtattgctgtatctagtacatatttttaggatccaggtgttcatactctgaaggtgccatctggcatggtcatttctagaaaacagggctgctgtagctaactctacctggacaatctcagaggaagtaggttgtgatgggggaaggttggaaaggtagttgcgagggtcagtggatataaaaaagtttgcccatctgttgtaaatttttttaagtctccaaattcctttgttgccagtgtcctggttatagtggaagggcctcaagtacgcatgattcttgtaatctgggcttctggcttccataaatgccagagaatttgcaacagtaatgtggtatactgagcatctgccttttaatgcagcttcctctttccattctaggatcatcaactcagttaattagaggagtggcaggggttacaatgctagcaaattctgcagtattatgttatttgtagagagtgccctggaaatataatgagaagagaaaaatccaagtatttctgtttctcattcaaacccagatggaaaaatatgaggtgagacacttagaaaatcagagtaattgaacaacatactcagactggtttattggcatgaatgatgtccccttcacagtagttatcataggagccaaacaatacaataatgtcaccattgctcatgctgtttgggctcttgtgttggtgttatctttggattctgtgggctgtactatgaataattctcaacagtagcaaatcttcaaacagaaagagtctgttctgtttttgctattagcagaagttagaatgtgccaaatttggtgaataaagtgggtgatcaaagtgggaagtatgattttttttgccaaaaacaaagtagattgcaaaataatgaaacatttttgtcttaatgtggcttaaaacaagctctgtttattccaaaaatttttctaaaattattttgaaatactgcagaatgtctgtagcatgtattttccaattatttaattaaattaaatccacagattctcataaatatatataaatttcagttttctttgtaaatgtatagttacacctattattttacatttttgttgttgaacagcattacaaatattttaaatcttctcatttaaacaatcttaaactaaccaaaacaaacctatttcaaactaagttgaaatattttcagaagttaaaaaggatattttttgagacctaagaagttttaaatcaaaacaagaaaagattcagaaaccaaacacattgtactcatttaggataaaataatttgaggtaattatgaagtgaggagtcagattcgtattttctgaatttaattgtgtcattgtatatattattttttacgtcgtatcacagccctgtgtagtagatattattttaacatttggtcgattatccaagtttacagtcaatattcaaagttttgtctgactccacagcttttatccagctctaatacaagacttcatatattcccttcttcagaagagagaggagaaaaaaaactttgagtgacaattatttttaatttttacactgttaagtgaatatacctgagagggcattgctttcaaaatcttactactcagagtatggccagcagacaacactctgtgtggcagcatcagtgtctcctggtagctgactagtgaagtagagtattagatgccacaccagatgtaccaaatcagaagctatattttaacaagtccccccatgtgaattgctttagagcagtgatcttaagcatatctttggaagtcttttaaacaatattctagtgtcttctgcattttttacaggctctcaaacaggacaaaatttttcagctatgaggtgtgtctaaaagtatgaactcattttgacttcagaacaataagaactcttgaaggtcacctttagcgttttagttaaataacatgaaacttactattaaggaggacatgtttgataagagaaaaaaaccactactgcctaagtagtcatacactcttcaaaattgatacacaatgactgaaaggattattaaactatggtcaattactgatgatttataacacacaatttacggtgattcattttttttctggatacctatctttgaatatgctatttttaaaaattattttgtcatttagacttctattttatactgaattgaaataacatactatgttcctaaaatatcatatggaaaagggtttagcttagtgttcattggttgtgatattttttaacaaaattttcaaaataacacatttttaaagtgaattttattaattactgtgtctagaattaagtttacttttttttttttttttttctgacagaatctccctttatcacccaggctggagtgcagtggcatgatctcatctcactgcagcctccacctcctgggttgaagcaattcttgtgtctcaactccccaggtagctaggattacaggcacccgccactatgcccagctaagttttgtatttttagtagagatggggatttcaccatgttgcccaggctggtctcgaactcctagcctcaagttatccacccacctctgcctcccaaagtgcagtataatgtgtctaaatatcaaattataaaaaagtaaaaagattatcatcaaactacatttctacactcatggtaagatttttcataatttttcttatgaacatgcttaagcattttaaacactgcttgtagcctctgcaaaagttagcatgctaaatgtatgtttaaaagaactaagaaaggaagggaggaagaaataaacaggtttctgttatgcaaagttgagtgagttcaagatgtttatgttcatcaccagaacacgtgtaaaaatagctgtaattcattcataaagtcaattcttacctctgttaactttcttaaagcatagttgttttgatatagattatttcccttcaaatttatttatgtggaataattatatccaatacagaatagtattattcaataacaaaaaatgaatgttgcaataagtcattaagggtagagattattattagctaaaatcaaaagatttttttttcattgaggagaggtctagtatagactttaaagggtgaatcactgttggctatgtctctgtggttaaagagacttactgatgataccacctgtgttcagcagaagtagagagtagttttttgtggtagtaacagagggaagtgcagagctccaaaaacaaagggaaaatatttacttatttcgtctggatttctgccataggctatgattacttacctgtcaagattttctatcctgtcctaaatatgcatcaactctctgagtgagactccccctgtaatcccggttcaaagtactgatacacagaatatattttaaaactgatacattcaagtctgtatctaaactggctgttgacccactgccctgtttcctactacattccttcatcaatttttaagagtagtggtttcccagcaaaaaataagcagcataaataatgtggagagaatggaaatctactacattgttggtgggaaagtaaattagtatggcaattatggaaaatggaggttcctcaaaaaactgaaaactgaactaccatataatccagcaaatccatctcttggaattccataccaaatcagtatgttgaaggaatatcttcactcccatgttcattatagcattattcataatggccaagatatgaaatcaacctaagtgtctgtcagcaggtgaaaggataaagaaaatatggtacatatacatagtgaaatatcatgtagctttagaaatgggtgaaattattttatttgggatggcatggatgaatctagagaacattatgctaagtgaaataagtcaggcactgagagacaaataccatatgatctcatttatgtgtggaatttaaaaaacattgatttcataagaagtagagagtagaatgagagttaacagagactgggtggtgctggtggtggtggtggtggtggtggtgagggaatggaaagttcctggtctaaggtaatatgtctcagctagacaagaagaataaaatttgaaatctattccacaacaatagaatcaataatattgtattatatatttcaaagaaactaagaagaaagtaaatttcaaacgtcttaccacagaaactgagtgatgcatgttaatttgcttgatttaatcattccacattgtatacatacatcaaaagatcacactgtattccataatgtaatacaattatgacttgtttataaaataatattaaccaaaaataaataatcagcatataatagtgcttaagatgggtgattctggtgtcagctggatcagagttgtaatcacttctctgccactcactggtattgctacctttattcaacctcatttacaagagctgtttcctcatctgagaaatgagaataataaaaagatgtatttcaaagaattgctgtaaagattaaatatgaaacacttcatctatattaagttcataacaaatgttggctactgttatgtattattactatgtacttcccttgtactttgctcttatagacactatgtcttttttatattaccttattttaaaacttgcttatcatatcaataaaatagcataatactttcttttttgtagatgaagaaacaggctcagaaatgttaaatttatatccccactatcaagaagccagctaagtgccaatcttgcacatttaaatcctccatgtttcttagtttcccatattacattccttatctcaactccttggaatcagatagaatggtgtaagatctctaatttccttagttcccttgagagctagaaaacatttgacaaactaaaaacaaaattatctaaacctattttgtgctcttcaaaaataggcataatagtatacatttaacagggttgtgaggaataaatgaggtaatccatacaaccagcttagcaaagtgcctgccatatattacgtatggcaggcactcaaggaaaactgactactattagtatctaccaccttgggaattagtagttcccgaaaatgttgctgttgtcccaaaatgttttggcattattattatctagaattacatcaaaatttactttataagctacataagaaatcaaatcaccacatagaaaaatcaactcagaaatggataaaagacctaaaggtaagacctgaaactataaaactgtgagaagaacatatgagagaaaagctcctggacattggccttggcaatgatttttgatattgtaacaaaatctcaggctacgataacagcaatgataaataaatgggggcatatcaaactaaacatctctgcacagcaaaagaaacaataaaataagacagcagcctgtgtgctggaaaaaaaatatttgcaaaccacatacctaaaaatgtcttttatagaaaagtaaataaaagatcatggggattcattttgttgtcatacctctatagtccttcaatttcgaatatttcttgaattctttttgtggctcctaccattgacattctgccattaattttgtagaatgtcccttaatttgagtttgtctgttatttccttcctcatgattagattcaaattatgcactgttggcactgtgtgattacctattactcttcagacttttatccattagttttaacctccatggatgatttctacctgaattggttgatagttggcaaatggtgatcttctaatcctataagccttgctacacatgttagttgagacttaatttataatgggaaagagaacaatgataaaataatgtgcatgtacatcaataaaattgcaaaattttcagtgtcaggaaaaatcaatggatggatgttgagcatggtttgggggtggtctgattctgagagtagtaggaaaagtggtttgatatttcagctgagagttttaagaatcagaaggagcttgccatggaaagaatgagaggaggaatgagaggaagggcaaacaaagggaaagagaattgctttaggtaagaaagatctacatacaggggtgactaaaacaccagtctggcagcatatagtgggcattgggcagaaagggcaagtttccgttaaagggagatgtgtagctgtgatcacttaggatacataagctatggtattttcatctaagtgaagttggaagtcatttaaagatttaagcagagaaatggcatgataagatttttaaaatgtgtctctttgtagagaataggccagaagggggcaggtgaaaaatctctgtttgatctgtgttaactactagcatcattacttcagctactctgatctctcattggactgcacatatataacttgtcttcttagacagttctgtaaattccaaatgatctcttgaaaatgaaaattgtagcaccctggaccccactgaccaggagtgctagttgacagcaagaggagaggaagagtgtaatataatcacatgttgtgagctcaaagagaaagaagcgatagtagcctggaatcagcaatgagaaataagtaagactcagaagtgaaatgggctagaacatgagaaagtggggtcttgggtaactttaggcccaagtatgggtgcgggtctcagagtatgggtaataccagatgctgagggacacatgccttttggttgtcatgaagtagagaatgaagagataagctgtaatagtctcttttaagaggctaaccagcagtctagagctgtattcctaaatgctattctctaaggctcaggacctagagttgtccttgagaagcattaagaggtagggagtgaaacaggtgaggcattggaaagttttatgcctgagactttccaaatatgatgggcctttatttttaataaataaaaaggatttttattggagactccttgcgctgtctcatgctgtaatattgacaattaatggctcaacgacacaataacaatatatttaaagttttaataaatgcactgtgatgtgaatcattcacttttattttatttattacttgcttacagcttagttttatactcactttggatttttttaaattctgtggtttataggaaacctaagctcatgaagagtttataatctaagtataatcctatgaagggcattatgtgagagattattgtgttttgttggaggttgtattagatgacttctaaggtctcatcctactcggagtctatgatttaatgtttctagcatgactttgtatcaaagaatgagccagaaaattgaagggtgtttaatatgacctgaaggaaaaatcaagaattctaataaagtcaagacacgtataatgtgaacaattcctaggcttttgatcattcagtggaactgacacttatgtagctacagatttatgctggttttaaaggcatgtttcaattgaatgagcaaattgtgaaaaaaaaaaaaaaaagtattaggtaacaggatttcaaaagaccgtgtgagatcttagtccatccaattattttactcttgctgattaaataaatctgatataatcgccctaaaaatttgatcagattactagctggtaaaaaccagcttttgctcattgaaataatgagccagtaatatacttcacaaaaatatagctaatgataataaatatatgaaatatattattttttcctaggtgccaagttacatcttttgactcaatgacctaataatagactttctatcattttaaagaaagaatttcccctcatacatgtccccttcacagagattcccctaatgttagactaatggtcctaactttaataaagtgttagtctgagtctgtggaaaaagacatagaaaggtgacttatctgagatcataaccaattcaattgttaaatattgtaatcaagcaaatacaaaccacctactccttaaatatttgtaatttttcaaacacttttaatcagatgctctgggccaaaggacagatgcttgtttacaaggctgatttagttactttaaatgctgctgactgaactatgtacctgtaacatgcttcagctacaggccatgttcagaaaaatccttgcatatcactaccaacacacttcagtatccagctagctaatatattgcaaaaactaatttattcaaagcatatggtctagcaaatgttgactgcattttcagatgatgttgtacatttaggatcttggaaagttgtagattcttacatagaaccacatagaattgaggcactttggggaaaaaggccaaaaatcttatttcacaaatatgggaaatatttttactataagaggtaggaaataactaaacaaaatatttaccagttaaaaaacctcaatcagaaatagtaaattgaaacatttgttcataggttctttttagatatctaatatgaatatatatttatgtagcaaacactggggctttaaaaataaatacaggcatatcttgttttattacacttcactttattgcactttacagttattgtgtttttttcaaattgaaagtttgtggcaaccatatatcgagcaagtctattggcataattttaccaacaacatgtgctcacttcatgtctctgtgtcacacacattttggtaattttctcaatatttcaaacttttttaattatcattatatctgttatggtgatctgtgatcagtgatctgtgatgttatcattgtaatttatttagggagccatgaatttcacccatgtaagatgataaacttaataaatgttgtgagtattctgactgctccacattccagacattcccatctctctccctcttctcagttctccttagtccttgagagaaaacaattttgaaattagaccaattggccgggcacagtggctcaagcctgtaatcccaacactttgggaggctgaggcgggcggatcacgaggtcaggagttcaagaccagcctggtcaacagagcaaaaccccatctctactaaaaatacaaaaactagccaggcgtggtggtgggtgcctgtagacccagctactcagggaggctgaggcagaagaattgcttgtgagactccatctcaacaaaaagaaagaaaagaaaaagacattagaccaattaatactgcaatggcctctaagtgttcaagtgaaaggatgagtcgcacatctttcattttcaatcaaaagctaaaagagagtaagcttagtgaggaaggcatatcaaagctgagatagtctgaaatacattttgagttgatttttgtatgtggtgaaagataaggagttataaaagtagacttcatgaaggtagaaagtagagtgatggttaccaaagggtgggcctggtagtgagttagcaaagttgtaaatgcaaatgaaaagttctagaaagttctagaaaacggaacgttctagaaagtgcttcttttaagaacacctgaatgataagaacacaaaacagccttactgctgatatgaggaaagttttagtggtctggatagaaaataaaaccagccacaacattcccttacaccacaatttaatccaaataaaagacctaaatctctttaattctctgaagtctgagagagataaggaagctgtagaagaaaacttagaagctagcagaggttgcttcatgaagattaaaatgaaagctgtaaccataacaaaaagtacaaggtaaagcctcaagaactgatgtagaagctgcagcaggttatccagaagacatagctaaaataatttatgaaggaggctacactaaacaagagactttccatgtaaagcaaacatcttcctattggaagaagatgccatgtggtacttccattgctagagagaagtcacttcctagcttccaagctttaagggacaggctgactctcatgttaggggcaaaggtagctggtaactttgagtggaagtcaatgctcattcaccattctgaaaatcctaggggtcttaagaattatggtaaaatctactctgtctgtgctctataaatggaacaacaaaacctggaagacaatgtatgtgtttctagccaggtttactgaatttttaagctcactgttgaaacctactgctcagaagaaaagattcctttcaacatatcactgctcactggtaatggacctcatgacttgacggctctgatggagatgtacaaggaggttaatattgtttttatgcctgctattacaacatttattttgcagcccatagatgaaggagtaattttagtttcaagccttattatttaataaaaacatttcataagactatagctgtcatagataatgattctcataatagacctgggcaaagaaagttgaaaaccttctggaaaggatttaccattcaagatgccactgagaacattcattattcatgggagaagatcaaaatatccacattaacagggctttggaagaggttgattctaacccttatggaagcatttgaagaggtcaagacttcagtggaggcactcactacaaatgtggtagaatcagcaaaagaactataattgaaagtggagcctaaagatgtgaatgaatcgctgcaatctcatgacaaaacttgaatagatgaggagttacgcatagataagcaaaaaaatgtcgtttctttggatgagatctactcctggtgaagatgctgtgagcattgttgaaatgataatagatttagagtatttaattaacctaattgataaagctagcatggtttagagcatggactccaattttaaaagaagttctaccgtgagtgaaatgctatcaaatagtattgcatgctacagagaaaacttttgtgaaaggaagtatcaattgatgtggcaaacttcattgttatcttgttttaagaaattgccacaaccactccaaccttcagcaacgggcaccctgatcaatcagcaaccattaacattaaggcctgaccctgccccaacaaaagattctgactcacagaaggttcagatggttgtctgaaattttaaaattaaggtatttaaattattgttttagacataatgctattgttcatgcaatagaatatagtttagtgtaaacgtgactcttgcatgtactggaaaacctaaaactttgtgtgactgactttattgtgatatttgttctgttgtggtggtctggaaccaaacctgcaattcctccagtttctccaaggtatgcctgttctgttgttttaagtcacttaacaaatacacatactttttttccccctatttttatatgatagttactatgcccatttgtacaagagaaattcagaggaatttatgatttagaaattaattgactctgatgctgtataagttatactccagaaaattttaaattattaataagaacatctgattccgaaaattattattcttaatgaaaaaatgccaaaatgcatgacactgctctcctgccgatgactaccagaaactcatctttattcaaacaagttggttttattggcacattgcaacaaaggaaactaacacaaatgaagaataggtgcttcagccagagagtgttagaaaggacgtattataggatacaggttcatgctaggtaatttgggggcatattcaaagcagtggtgctttgtctgcattggataatgtcaggaagcaggggtaattctttgtttgtgaatctaaacaattccttttaaagcagaaattctgattggtaaagaatcagcactcattggtgatagccaagataggggaagtgtggtcattttcgtagtttgcacaatattcttgttttgtctgtgctcaaacatttttatgtagtggtctgatgttgtccagatccatcatagcaaggagtggctttgtctgatgatggtgttctatgaaattatctgtgtgcagtaagagaataccatggcccagctgtgtcagcccaacttctaacaatgttgtagcctggctgatagtgccaggccagcttccagctgtgaggggctttttctctttctcatgtgtaatggcaaatacttctaactacaaatgtcacgacaaaataatttcatgccggatatgaatattttctagctcaacatcttgctttcaaagttctttaatatcaatcctcatcactggattgtaaactccacaaaggcagagaccatgaccttttttcaagagctaaatacatcctaattattagtactactcatacaaattgaattataactaatatttatcaaacttttacttatatgtcagttatacttttgtgggttttactttgcttgtcaccctaatatgcacagaaactctctaggatgagtacatactattaatatctccattttataaatgagaaaatgaaggaatagggaaattaggtgacatacaaaggtcatacagctagtaaggagcaagtacaggattctaactcaggaagtctggctgtagattccctatttttcatcactgtaatgggtttgatacatatgtgttgaatgcatgtgtaaaccaaaaataaaattcaaagcccccccgccctgccaccccaaccgtctaaatggacctcctcctcagcaagggctcttttacaatttaatctgagagactgtttctttcaggccatgatgggaagtgggggttgaaaatgcctcattatgcttcccaagcattaatatcaacacagactttaagtctgataagaaacattttacaacttattctctttaaagcctagtacctaaaggctttccctgcaaagaagaacttgggtctccataatcctttatcttaacccaggcattcatttctattaatcccaggtctttagataaacttaaccaactgtcaaccagaaaaaattttaaatctacttgtaagctggaagcccccactttgagttgtcctgcctttctggaccaagccagtgcatttcttaaatgggttttattgaagtctcatgtctccctaaaatgtataaaaccaaggtgcaccctgaccaccttgggcatatgttctcaggacctcctgagggctgtgtcatgggccgtggtcactatatgtggctcagaataaatctcttcaaataagtttcttccaattgtttacagagtttgactcttttcatcaacacattatgaatagatgaggaataatttgatgattttgaaaattttgggtaaaacaggtaacttttgagattgggtattaacctgggataagagtagcgcaaatcttaacttggagttattctacaagcacatttttaataggaattcttgaaggggatagagtcaagtgtagggaatagacctgaatctggatctccataaataaaaggttaaatataaagtagaaataaggatgaaacgtggtaggttcagatctgtggttatcaatctgaatatgtggatataatgaaaagtgtaaacataccatacctgagacagacttatgtaaaatgaatagccaccttacaagagaataaaccagacagcaagaggggtatatgtgagtactgcaatctttgaccctaaaataggcagccatgacagtgtagagtgcatccttagagttttaaatgtgtatcaggaaaatgaacctaaagcaagttttcctttaatattttaatcaaatcatgggactgtggaccagaaaggatgttgtttaagtataacttaaaattgatataatttataaacttaaatttataccatttagttttctatgttctgctcagaatctataagaaagacatagaatcatgttcatgaaaccatagaatttttgcacaaacgtttgtacaaatttgcaggtgctaaaagaagtgtgcttaacatctttttagcccttgtaatttgtttgttgctattattcattgcatcttgtgactaggtatgtcttggtgaatttagtgtgtaaagctttgaaaattatagtatcctctacaaaaacaaggttctactattatcagtattcattttgttaagagaaaaagagaggttactgattaatgccattccatgcgtgggatctcttttcatttattctcatcttaactatctgcataaataagaaagtgagagaaaaggagaaactgtttaatgccagtaaaggtatcatgttgaacacattttttttgtgctcctcatttagctacattggagatgttggaaatatcacaaattaataaatattcaatcttctcttcttcctgtaatcccattattcacacactgcatcaactgtgaaataggctggactttgttggaaatccaaaagcatgaggaaatgtgctcaaagttgcatattaggttagaaaaaatgcctgatgaatatgcaatttaataggtaattgtattatgtaagaacatacaaaactaatataagcacattattgtattgaggttgtattttattaaattgcttactgatatttttttgaaacaagaaagtaatgtaaattgagtaattctgaataagcgattcagggcacatatatcatgtttctccataaaagaatttttttcatttaattaattgtaaggaagtattattggattagcccttcatgaaaatactagggcaaaatggggaaaaaattatatatatataaatttcaacacagtgataccctgtatctactaaaaaatacaaaaaattagcccggtgtgttgtcgggcacctgaagtcccagctactcagaagtctgaggcaggagaatggcatgaacccgggaggcagaggttgcagtgagccaaaattgcaccactgcactccagcctgggcaacacagcaagactccatctcaaaaaaataatatattaaaactcgaaaatgacctccttcatatctcacatccaggtcatgctgatccaagagatgggttcctatggtcttaggcagctctgtcccatggctttgcagggtatagcctccatcctggctgatttcatgggctggcattgagtgtctgtggcttttccaggcatatggtgcaagctgtcagtggatctaccattctggggtctggaggaaagtggccctcttctcacagctccactaggcggtgccccattagggactctgtgtgggggctctgaccccacatttcccttccacactgccctagcagaggttcttcatgagaggcctgcccctgcaacaaacttctgcctggatatccaggcatttccatacatcctctgaaatctaggcagaggttcccaaaccccaaatcttgacttttgtgcgcttgcagactcaacaccacatggaagctgccaacgcttggggcttgcaccctctgaagccatgacctgaggtctgaattagcccctttcagccaaggatggagtagctgggacacagggcaccaagtccctaggctacacacagcatggggaccctgggtctggtccacgaaaccactttttcctcctaggcctctgggcctgtgatgggaggggctgctgtgacaacctctgaaaagccctggaaatatttttgccattgtcttggggattaacatttggctgtttgttacttatgcaaatttctgcagcctgcttgaatttctcctcagaaaatggaattttattttctatcacattgtcagcctgcaggttttctgaacttttatgctctgcttctcttataaaactaaatgtccttaacagcacccaagtcacctcttgaatgctttgctgcttagaaatttcttctgccagatacccaaaatcatctctctcaagttcaaagttccacacatctctgggatagggacaaaatgctgccagtctctttgccaaaacataacaagagtcacctttcctccagttcccaacaagttcctcacttccatctgagaccacctcagcccagactttattgtccccattgctatcagcattttgggcaaagccattcaacaagtctctaggaagctccaaacttgcccacattttcctgtcttcttctgagccctccaaactgttccaacctctgcctgttacccagttccaaacttgcttccacattgtcatgtatcttttcagcagcatcccactctactcatagcaatttactgttattagtctgttttcacgctgctgataaagacatacctgagaatgtgaagaaaaagaagtttaatggactcatagttccacatggttggggaggcctcacaattatggtggaaggcaaggaggagcaagtcgtgtcatgtcaagtggatggtggcaggcacagagagagcttgtgcaaggaaaccccaccttataaaaccatcggatctcatgagactactttactattacaagaatagcatgggaaagacctttccctgtgattcagttgcttcccaccaggtcccttccacaacatgtgtgacttcaagatgagatttgagtggggacacagccaaactatatcactacccaatatttcaacgtatgtggttagtagaattttgtaatactgttttgagctcattagtttttttacttagatatctaaagtacagcaaaaattactgtctttttgtatcttagatcatataattttagagctgaaagaggctgtagagatcattaaaaaaaaaacttagatattagaaaaatgatgcctggagagatgttgtatgacttttccaaggtaaagtacttaattaaaaaaactaaaaatttaaggggattttaagtcatcacccccagccctgtagattaacttaaattttatcaaaagattagacatattaaactattaagtattgcttcaaaccactctcagagatttattttaaaatttgtgcactgtatatgtggttgtcatataaaggattgacaacacttttttgtgtatgtaaatgaaaattgtattggtttagtgctggatttacagtttaaggattgtatttaatgaaagcctctcaattggtatgtccttgacataataaaaattttcataatttaggttttaattttcacattatgttgaaaattcaaattatttccaaatatcctgtgtttatatttactatattaattcaatcaaaaatatactagttgaaatttggactattccctatcttgagcacacaacatgcacacaccccacacactttacccattaacatggtgtacacaaagaatcttagatattttattcttttcaaagttgagaaatgcttgttaatttttaatcaagttgagctattattcaaccatttaaatttaccatcaacatattgtggaataggataccttatgcctaattaacaacataagtaagaatcaaaatatttcatttgctacctgttaatgctgtcttatgattttgctcatgtttactaatctcaattataaaatatatttttatgtgcacaaaccagtatattttatttattttgccttcatctaccttaaatgttaaaatttttaaaataaacctttatatatttatttacacataatttaataattaagtttatcaatatttctatttttgtaaaggaaattactccaggacccatttatatgactatttaggctaaaattgtattttccatttttttaaacaaatatttggtaccagaataacaaggtatgcaaaatgacaactaaatttattattcaaatcaaatatttaaacatgtacttgtatgattattggcataattatatataaaatgattatgtacataaagtttaattttttttacctgttgtcttcaattaatttagagtgttctccatttatcttgcgtcttgatgaagggtatgggggatccaagatgatgtcaatagctgtttagatgtttttgttgccatgagtttgggctttgtgtaatttcttggcaaaatatatggagatatggagagtgcattactccctgatagacacttataatgatggaaaagaagcaaaaaagtttatgtactttcagctgttgtacatagatgctaaatattactatttattacaatgataatttttaaaacaaatatcttctgtatacaaattacattccaataattaaacctcatgttaatggagatatatggcggggttgaacagtatattttataatctattattttacaagaagaaaaactagatcagttgcaaaatatattaaatacaggctctgaaaaatgaaagactaaggatgttaggccccaaaaaagatacactggagttaacaaatctttattaatgcatgaggcctcccatgatgctggtttctgttctttaccattgaaaactgatcattgcttctggagaaggttggaaagatggctagagcttattttaatagccttacagatagctaataaagtttcatttattcagtgtcttttaaattatatataggtattaaattgttttttaagccattcctgtggtatagctgtagaggtgccaggctgcacaaataataatcctatacttgttgctttggagaagaaaatatcgtttgttgtaagcaaaattgtccaacaggttaaaaatggtctaattatgtgaaaaaactattttagtttaaagtatacattcgaaagtgctgatctttaatgtggtataatgggcccttgatttgttagcatcagcaaagcaaggctaacaatgaagtttgggaagcatttttactttttttttgtatcacttagccctttgttttagatatggtaggtccttgtgtgtgttgatttttttgtgtaatgatataattgaaagattatatcttttaggagaaagagtacatctatttgaaacataccatttctattccaaatgaaaaaaaaatcctttgcttccttagcatatgtatttttgaagacattgcttactagctcttcaaaaaaaagttatttagctttgttgatcctcaggttgttatctgtgaaatttgtaacacagatcttttgtgaagattaaatgatatcaggtatttataatacaaaatttctttcctcccccaactccacctctacatatttgatttggctccatttttgtctcatttttctatgtattttaagtatattttgttgacttatgttgcatatatattcgttagctgcctcaagtatttctggacaaaaatatgtatacttatagattaatacaaattagttcttcgttgaaatccttttgtttttgttttgtttttcagattaccaaatttgttaaatggattaaagtgtggagtcatatgatgtagttgcttctggctaacagcgttagttcactcttcagggtacaattttgcttctctgaaaattagttggtcttagttgtaaatttgactaattaaattatataaccaaaatggtacatataatactatatctcctctgtaagtgtaaatttgactaattaaattacacaaccaaaatggtacctataatactatatctcctctgtgagccctcaataattactaaataatatactttgcaatatcagaaatataaagtttttaagcaaaaagccccttttccctccaatattattttttccaatattaacctgttagtgtctctaatgtgtcatgcaatcttaagcctctttgaaatatagtagataccatacattattttaagtgttttatatgtgtaatgtactttaatcatcataataacctaataaaattggtaactattattatccccatgtgtagatgagaaaacagaggtacgaatcattaataaactcagctaaggttgccaggtgacggagtgactgaaccaaaatctgaagttggcagtctggccccaaaatcaacattcttaattgaaattctatatcacctcgatcactcgatcacttctaatatgtactttacatgtggggaaaagtaggctgctcgtgtgctttgggtgactttcctagtacttgtaatttcactgaatgatgacaaatttcttcctgatcccttgaagagagactagcaactgagtgattatttgtatgtaaactctatggtaatataaaagaagtgtttttttttttccagcaatgccaataatctaaaagacgctgggaccctactaatgtcacttgctcaattccatctccacatcagttaattcatttgggcagcacactttttcaccacaatgtaaaagtttctcttttctaatgcattctttgcaaagaattaaccatcaccatatggaagtactgtggagtttaatttcaatgtgttaaattttgatggtggaacatcagtgaattgactttgaaatctgaactgaactctggttcatttgtcagctggtgtaaagattcatgttctcttgtgcttgtggtcttacatctaccctgtggttttaattttggcaatgattagttagcatcccacttcatttcatacttagtcatccacaggaaatgataaagacaatgaatctcagatgtctacagactagatattgatttattactattttttcaagtttttcatgatttttccccctaagtggaaataggatttttgaaaatggatttctggctctgtgtaattgctgtatgtcagtgagcattccattagtattaaaaacatagtagatatgtccacatgttagagttttgaatatatttatagttacaccgagattgatattaaagatttgaaatttagtaaaatttttattacattaaatgactgtattgagcccataaaattatgtgttctcttaaggtggtagaaaatactatatttttaaagaggagctgaaaaaaaatatagatatagctatatccatggcaacagcatagcacccatacaaaagaaagccagggtgtgcttgttggatagctgcatagcaacagcagagttcagtatgggaggaggaaagaaagtttagaaccaagactatagtgtgctttctgaatgtattgcattgtgctgtcagtaagcctgattaatgtctttttgttcttgttcgatattttacatattatatttgtgattttaatttcaaagaatagttgaaaaatgtaggtgtatggtgtaaaatcagtaaatttgcacttaagttttgcattaatatgagtatgtgctattggaaattaaagcacattgttaagaaataaagttaatagaatgagttattgattatatttgtgaggaattggaatatgtattctataataaattcactttcaaatttagaaagggatgacccttattttataattatttttgttttcaatatgagtatgctagtgttcaaatatatattttatgtgtagaaaatagccatgctacatacttccagaaagccattccattcagttagtcatatgttttggacactgtacgagatagatctaagcattttgtattagtccattctcacattgctataaagaaatacctgagactgggtaatttataaagaaaagaggtttagttgggtcatggttctgcaggctgtacaggaagcatgatgctgacatctgcttggctcctgggaaggtctcaggaaacttttactcatggaggaagatggaggagtagccagcacttcacatggccagaacatgaggaagagagagaggagttatcacaagatctgattgttttaaaacaatcactatctcactcactatcccaagaacagcaccaaggagactgtgctaaatcattcatgaggattccgctcccatgatccaatcacctcctaccaggccccacctccaacactgagtattacaatttgacatgagatttggtggggacacagctccaaaacataccacattgttagggaggactacagcaaaacttgtctaataaactaaatagacatttctgaaaattaaaattcttagtttctaagtattgtaattcctttgtaaatctaaaccaaatcattaagaatcacatataagctccaaaggcctaagacagaagttgttaatacatacctttcagcccaattctaccttactcctaacgtaagaaacatgccagtacagccttttgtcttccatgtaaaaggctttggaatttatcccaggggtaaggtatagaaagcccccttaaaagataatgggactagttttcccagtattctaaataacatagtatgttttcggatcctttgtgttgtattcatctatgtatttgctctgtgtatgttttctttctctttttcttcctcttcctcttctttcttttcctctacctctccctcctccaatgatgctggatttactacctgaattatttcaagcttcactataaagtgtgtatataatattcaatagtcaacagtcagttggctcccaaataatatttctgcttaaaatcaaaattagcttcatgatatttaattatactttaagtctatacattgttccttgttgctgttaaagtttatgacatttcttatccactctttgctcccaaagatagtaaattcttgtctcttaatggtatttaagatggtaaagtagcctttaagatatttaattgtcaaaacctttcttaatggaaatatcttaagcattaaaaaacaggagaataaggatatattctagtttggctgacaatgtgtgagtgaagtagctatgaagaataaagaaatattctaatttggcagtgtgtgtatatgtgtgtgtatgtgtgggtgtgtgtgtgtctgcgtgtgaagtggctgtcaagttgcaaccagaatgtaactctactaggacttttggtgatttttgtttcttttgtttactgctgtatttccaatgcatggaagggcacttcaaacaaagtagtcgaagttttccctcagccacaagagccctttatgtggggctttatgtggagtacagttttaaaagtatgtgtctacattctgtgaatcagccattgtggataatgtcatatatactaacagaggaaagaagtgtacctgtgtgtgtgtaggaatatatatatatatatatatatatatatatatatatatatatatattatttatatataataaaaatatatattatatataatattatataatataatatataatataatatataatatatattatatataatataatatataaaatatattatattatatataacataatatataatatatgttatatattatatataatatatattatatataatatatagacatattatatacatatattatatatatataatatatatgagacatatggatgtttgggagccatataaatattttacttgctgaattagtaaaacttctgataaataagaagatacttcaagataataagtgttaggtagttttcattctctgaaacaatggaaaaacgcttgaattttcagacggtattgtccgtaaagattcacgacgcattctaggtgttccaggatggccttggaagcagtcaaaaggagaatgtttatggagctgaatcagaaaggatagattgcatcaccaatatacacaatgggcttgtcacatttactgatggttccctatgtactgggaaatgtcaggtgattcacatataatttgtcttttaaaaatataaaaatatatctgctggaaaaattgcaccaggtcaaatgtattttagagtatctagtgttataaaatagatgtgttaagtttcctgctataaatgttgatatttataatttcatttattttcataaacagttaggatgcacctattcaagctatcctttattataatataatttagatataattcaaaatttagctataattccaaattttgctcatttctagacatgactatatgactgaattgatgctgaggagtttctacaaattgtcagtgttttgttgttagtattatttgctattttcaaaaacattttaaaatttagtcaattttgcattagatattttaattgtggcaacacagagtatcaactggaatttattaaaaaaattattaaaaattgactcatgcttatatagtctaaggtaaggaaatcaaaccattttttttttcctacaaccatgttaacgctatgaaaactctcatgtcaagatgtgctatctttagaacaggaatggaattcataaaatagctctttgctacagagtttttcagctgcattttcaaaaccaaataatataatttattttaaatttaaattttaggcattttacagtagaattcatgaattattaggtttctatacatttgtttaaaaaacaaataggttagaatacataaacatttgtgtcctacttttgtacatttgtaatatacctttgtagttctacttttcatgtattgttttcaattatgaaataattaagttatttggatttaaatatagaaaaaatatttaacttttgttgtgaagaaatatatataatatacgtgtgtgtgtgtgtgtgtgtgtgtgtatatatatatatatatatatatatgaaatacacagttcatttgcccttgaaataagtcctccaataggaaaaaaaatatgccctttgtgaaatgtcgtctcctcaccacagataatgaaaggattgctttgtgatttgacaattaaaattcacttttatttgtcagtattttgtatgatattctgttcaatgacaccctccagttaaaactctacaatgtagtaacattgtattctgaatggtaatgcctgcatcttattgttgttatttttaaaaagtttaaagctaattaggagacacatctattattttgctactttatcattattcccttcagacctatgagctagattttatcaggaatgcatactgtatattcactctcagtttattcatgctgagggcatcgctaatttgatcatcaaagtgtatgtaccatgtatatcctacagtagattccttaaaggaaaactagggctgtgctattaattttaaagtcctaatgtatggctgttaaaaattaagctgtcaacattctccatttccagcagtagcacagtaatgacaaagacatattatggaaataaatagtaattaattttaataagtagcattgtacttacagcattgtcaacaggaaaaataaaaaatcttttatggagaaaataaagttgtaacatcaaaaaatatgaaaaagcagaatatatttatgattaaattaaggcaattttagaaattaaaactctcatttagcaatatttgataaagacatctgtattgcttctgaataagatatgtattaaaattattcataagacaatatggattaaaaacaaacttctggcttcatgatacttatttattgagtaatttgcaattaatacaaaatatttttactttctagggacaagagaagaaaaacaggcaatgctatggaggattagaaagctgattaacttgagatacatagcctcatgtttataaatttgacagaaaaaatgattcacattctatatatcagtcattaatttggtactgatgataatgtgcaatgtataatacatatctgtgtttactctgtttcttgattgcatatgtaatgtgctgaacaaaacctaacagaaaagacgtttttggtcaaatatatcaaattaaaagcacactattgatggtccgaagctgtttaaacagttaatagaattatctgttgatttcacctgatttcaattatactaatgtaattcatgtaaaaccttatatactcaaaaagtaaggaatttcccatggttttaagaacatcttaactctagaaacacagaaaaggcagagaaaaaaaaagatttggagttgttatctagaaaaatttcagtggtaaattctgatatttttcttcttccttacatgactgaattatttcacatactttttattgtgtctaagagatgttttgaaaaccaaaataacaaacagcatctatgcataaaataagagccagcaagttgtgtggagaatgtgaggtactctgcaaagtgtatttttataagccctgattttgctttccaatatgctccttaatgaccaacaaagagggatatttcttgaggatgacttcccttgacctttcctatttgtctagagtatttgaccaggatagatgggagactatgctgtgcagtggtaactgtacccaggagcaggaacatgagtaagaatgtacttgatggagacaagggaggaaggaagtgtaagtggctctggaaagctccctctggtggagaatgtcttaataataattcagaagccattactagaacaaggagatgatagattacctatttaaaggactttctcaatgtagaaggggccttcctaaaatttcttgttatctgttttaaagtctgtggtagaaataaaaattccattccctaattcaaaaattcagcattcttccattgccagccaaattagctaaagttcaaacataaaaagaatcaaagatctttgggttccatattttccttattcccttccaagtctagctggatttcagagatacatttattactgtaaaacaaatgctcaataatagaataacagaagacaacaaatcttccaacattttgtttgatttctaaaatttttgttaccgttgttggacataatattttacatttcctaccagcactgcctgctgcttaaaaaggttgtttgctcatcttctgctagagaactctaaaaggggtcaatttttctccgaaatcattctgccaagggcagtcgttgatattgctgtcagaagaaagaaaaagacaatcttatgtaggtggaggggttttaacctttttaggtcattggctgttttaaaaatcagaaaaaagctttggattctctggctcagctatatactcataatattttgcatgcagttgcagtattttcctgaagtcacaatagtattcccaataccacggttacaatagtatccctggctctctctctggtgagctaccacctcatttaccttcccactgcctcctacaccttgccatgactagatcttctgaaggttaatgtaattcctcaccccgaggaaggttgaaagtacagtctacataatcatgccccacaacggctatctttagcattaaacaccctggctctaagactctcatcttttatcacaggaattctgcattgttttccgagactggttcctactaagaaattccaggttatggtactccagtaatgaacactaaatattgagaactccctacttccgtagcattcatttctcacaccgccagttaatcagttcctgaatccttgccttctatgattgtgtttgtgtatatatatgaaatagacttgaccctcagtcctaatatcagagttgaatccctgttacaatttttttgttgataaataatattatctaatcacaatgactactgtaagtatacaattgggaaatgttaacaagtgctatgcaattaaaaaaaggttttgtggtcaatgaaatgtggaaatattatataccgcattctctttgggagtttacaacgcctttcaacatacactttaagtagcatcacagtaatggaaaccggcccttaatactggttaacccaaagtttgtcaaacatatctgcatacataacaatttctataggacagtagttaataacataatgttgatagtttaggaagtttggtgttttaggaagaaactcatagccaagcctttaataagatatatttctgtaaaaataacttccacagtactctttatggccaccagtatctgagatcattatattgaaattatggtttattaaaagtgataatttagttgatcctactgtattcctcatacatagcagagatgtggaaagggacagtatggggtttgaaaatttacaacttcaaaaactattttccttaaataattttctcttgtctgatagaaaatcagtgactctgatatgacatgaatctgattcccttcactaaatattcatgtgaccaccttttctgaaaggaaataatactctaagaagtaaccattaaaacttttattatgttcagctccacagttaaaaggacccattttaatatctaattgagtctacttccattttagtagtttactatgaatgtcatgattgttttctaagtaggtgctacaatctttatcactggaatttccttccatctaagagaacagaaaccgagttaatgtatctgaatttcaataaggcatttacaaaggtctcttttagtgttcctgttggccagatggaaaaatattcactgatgatatggaactgggtaggcttattattggttaaaagtttgtactcagataaccctgtgttatggatttgtattaactgtaaggagatatctagtgatttgtcatatagtttcattcttgcccctatattattctaaaggttcattattaatgtgggtaagaacactggactcaatcttttcaaaattgcaggtgctatgaaactggaagaaatattaaatatgttgaatatgttgaattacaaaatagaaattctgggaaatggagaaattttaagaattaggtagaggttagcaaatcatgtttaacagagccaattttaagtcctcttttaaaaaaatctagcatcaattaaacaaagagcacaattacagatggggataaatttgatttgactacagcatgactgtttagctagattctgaatttaacacggaagacagatagaaacaaacattaattaagtgcatactatatgcacacctggggctagttaccttcatgtactcacttcatttaccttcaacaacaaaccagtgaatagaaatgactataaatagtataatgacaaataaaattaattgaaagaataaccgccccaagatcattcagcaaataagtgtcagatctaacttttattcccaaatttatcaattagaatttgcattgttagtaataaaatatagaaatatagaatttaagaagagtgaaaagggtggctctcccttggtccaaccacatctaaaggctgtgtttagttctggccctgactgcggagggaggttaatagaatggatcaagtccagggaagaacaaacaaaataatttcacattatgtgcatttaaataagtttgaatctatttattttgagtaggaaagttttctggtaggatatgataatgatttaatataattgaaaggctatcgttttaaataaaaattagatactttcccctccactttgctccagagagaaattccaggatcgatgagaggaatctgaagagtttcaggttttactcaacataagaaaaacacttcatattttgctgctttaccttttattcctagctcttattatcttatggtataatatacaattttatcgtatatattttctgtttttctcactaagataaaagttccatgatgtcaaggatttatgtctgcttaatcatggcatttttggcaccaagcctggtacccaggataaaataggtgcctaataaatatttgctgaataaatgaaatcaaaccagagattattggattcaacttggttctagcaaatagtttccttactgacaaacagtattttccttactaatagccaaagaagtattcatataatttgcgaattcataaaattgtacatatttgaaagccaaaggagcgctgaattctcaaaaagtcattttagaaagtggcccagaatgattgattaatctatcaatctctatatgtgagtacactttggaagtttttagtcataatgatgttacaaattgtcatcagactgtttcaaggaggtatgagctctgtagttaaacttccaaggctctttacttgcaagctgtctgatcttgaacaattgatacgacttcatggttactttcagcaccttcctcctgacattattttgaggattaaaagtcataatatatgtaaagtacttactgttaccttgtgcttagtgtgaatataaatattaaataatattaacagtattagtagaaaattatggcattgctcttattatagctacttaccattcatactgtatatcatgaaaatgataaatattgagattgtaaaaaaaaccattcaacatttagaagcactcccagggtctttgcaaaacaaaacaaaaatgcatagttcctctattgtccagaatagataaataaaatgttaaaatatggaataaatagaccactgtgtggattacacgtataggtaaaaatgtcatcctcaaggaatataatgtcactctctactcattttgatcttctcactaacttgatctttttaggtccaacccctcttctgagctttcccttccttctcttgaaggattgaaacataatagcaagttgagtagccacaggcagttttgctatacaagactagctcactctctcccattacagtgttttctttgcttttgtgaaaagactcccacactggtgtctgctgctaaaatcaattctggaaaggtattttaaaaaatgaccctcccttaggacgtgacagatctctgatggtgtctttgtcttccttctgtttttgaaaaaatccacagtattttctccaaaactttattatgttttatgaaaacataccactgacagcttccaataggaatcagaagatttacattgattgacctaggatgcacttcaattatctagcctgagcctatatcatctttttaaaacgtttgcttttaaaaaatgatttatattgccctgatcctttgaaaagtaaatttgacacatgataaccctttaattctacataattcagtgtgcaccccttgagaagcattttcttggctgggcgcggtggcctgtaatcccagcactttgggaggccaaggtcacaaggtcaggagatcaagaccatcctggccatcatggtgaaatcccatctctactgaaaatacaaaaattatctgagtgtggtggtgtgtgcctgtaatctcagctacttgggaggctgaggcaggagaatggcttgaacccgggaggcggagattgcaatgagccgggatggcaccactgcactccagcctggcagcagagtgagactctgtctcaaaatatatatatttatatttccctgattttctgaaagtaaattggacacatgataaccctttaatactgcataattcagtatgtaccccctgtaaagtattttcttattcagttacattactgaagtaattatgaaaattagaaaaataacactgactcaaaattactatttaaactttagacatcattcaaatattattttgtgtcccagtaatatcattcatacctaaagactatactttttgaacatactaatatttttcataaatatttctttatcgccttccttaccctgcgttactgaaaacggtgtgttttggtcatgtttattttgaacatagtgccaaacacattcatcgatattattatattaggttattcttgcattgctataaagaaatatgtgagactggataacttacaagaaaagaggtttaattggctatcagttctacaggctatacaggaagcatggcaacatctgcttctggagagccctcagggagcttttactcatgggggaaggttaagtagaagcgggcacttcacatggtgaaagcaggagcaagaaagagggatagagtggtgagggcgttgccacacactttaaaatgactagatctagtgagaactcactattatataggtaggaccaatccatgagggatccactcctatgattcaaaaacctcccacaagaccctacctccagctttggggattacaactgaatatgagatttgggtggggacaaatattcaagttatatcaattattatctttccatctcctttacatatagatactctatagaatgatgcagtgtaatcttacataatatctctcttcaagtttgaacaatcattttttctaggtatggaacaaattacttttatggaatttttatttcctaaacttccctgcactcaacctacatatactctgaacaaatctgaatatagttggatttagaaatctagaatagtcttatatgtacttatatgtggcatacagttaattatgtaaggaaatatttgccctatataattttgtgcttcattttctgttcactccatgttttattttctttcaccaaccaattttcattgttttatttgactaattcctggctacaaacatgatcaagttgctctttagttttggggaaacttaccagtttgtatgtattggtccagtcaaagggggtaaaatattattagccagaagttttctgaataaacataataaagctaactcgatgttcattttaatggaatttttatgttaaagcctagtgatctgatgaaatgccttcccagttacatatatttctatcatattagtgttggtcattttgaataaaagttgtcactttgctggatagtgtcacagaaatactggtactggtcactggttaccacttttaactgaaaggaacttgagtgtctctgcttcagtgatcatattttcaattattaggaagctaagcaaagggtgatttggtttgtataaggttactcactgagtcggcagaaatgccactgatctcattttatcatatctgctaggttttatgtgacattgaaatgcctcattgtccaactcttgttttttgttacaatgaagatcactaatatattatttgtatttgtagtaatatcaataatcatctgcaattccactttttatattgcattataatttatcaactatttttaatcagtgtcttctacatttgactttagccaaaaagctaagaaataattattttcactgattttatttgaaatggttctttactcatggtgcacagggcaccataattttaataaaactttaccgttcaatacagttttgattaattccaacaactaatatcattcattaatcataaattctagaaaactttttttcacagaagctaaacttcctgatctggctgtggctagttttggagtctgttgttcactggttacaatgcttatatcattctctacttatattttaattagaagaatgtaagtagttgggtcacaggctgaaaaatgacttaaaaattaaaataattatagacaaagcccaattaaacataaatttcaaaactctgcaataaatactttttattctaaaaatttattcagtttctatgaattccaacttgaaagaattattagttttctataattatatgtgctgtcagtaaacatttattttgatgtgaaataattactatttacaagccttaattgaaataaatttgtttatgtagatctgtatacttttttcctacataagttatttttaacagctatactaaaatttagtttcctcttagtgtgtaattttgttattttatatttgtgtaatattatttttagtcttcctaccaaaagttgacttttcagttgttcattcttagagcacagtgataataaaaaggaatctatacttaattctatccataatatgctttggcagaataaacaaagtaactaacacattaaaattaccaagtaattttaagttctaaattaaataaacaatgaacaacacataaatattttctttaaaatattttgtgtagaatatagagtttgtttccacaattattcaaaaattagcttaaatacccacatattttgttgatgtactaataatggggatatttttacaataaaacatagaattaaaaattatgattttggagaattcataataaggtagggatatagtatgatttatgtaccctttgatctcacaattaggtgggaagacaatgaataagtaattcactcgataaaaaatattgttaagaaatgtatatataaaataaaatattatttttacagccttttaaaaaaggttttcaaacatattgactgttgatcttgcgaaacccttcattacttaatatctattaaaatattttcacttatcaggaaatttataattatctgtaatggtttatataagagcaccaaaatgttaagtaagcacaaccaaagctcaaccccaggaattctaacttaaaaatttcattctggtctataacgagctctcttgccccgatatatttattctatgtagctgttggcactatctatctatgtgtctcatagataaaaccacataatatctaaaaaactctagttataatataatagcataggtaacatttattgtatacatatgtgtcatattttaaatatattctttccattccttgcacttagagagttgggtgggattattcctatttcaaagatgagaacactgaagtttagtaactaataaatgagtaattatttttgagctgatgtgcccctaaaggccaatatctttctgcatctttgattatttatacttatagaaaactacattttgtacttagtacttggtaagtagattttgaaatacgtaataacctattagtagatttttcttatgcatacacagctttttaagtaatagaagaatttttatgatacagagaaatagtatgataagacatattatttatttcactttttaaagccaaactgatttaaaataaagtgataccttaaatgacttgacatatggtctgaaatgtttagactgattattggtgaaatattttgggggaaatttgcactgtaaattaaagcattatgtttattcaaggtgacaaagaaatgtacttcaatggcatggtactgttttatttcattactaaaaacaatagaactaaagtgctaaaggtaaaatagagagcttgtagtgcattatattttaagaaaaatgagacccagaatgtcttgcatgttatatttgccaaaatatttgataaattcagcgaaacaaatgtttgccgattgctttttgtaagtacctctgatatgtgcttttatatacatggcctaatgatcttatttatgagaatgacttatcatcatcatacacagtcatcttcaataagcaatttttaagcttataccattggagagacacttcactagaagatgtggcatatacaatgaagattatgtcatacctaggagtgagagcctaattacggagatgaggctagtgcataaaatatagttaacaataaagatagcatgtaaatgccaacaggtgtataaatcgtaattattaaagatggtcaaagcaagacaatatcttttatgaaattattttaatcccttactctttattatcatccaggagaagtcaagatctaaaacatagttcagagaagcagaaaagtttcagcacatcaggtgcttccagtcctggatgaattctaaataagaaattccaatatagtagtgttgacctagcaacaatttaaataaaatgatttcctttttatttgcttctctgaagcatggacaaactgctcattaacagtagaacaaactgctgtccacttttatagttatttgaaatataaaaatcaattattagtcatgagaatgaatcacgttttaaaacaagggttgagaagtaaagtattttagttttttttcaaggcaagtattctaaaatgccagcattaggtccatttacaaaaagttgaatcattacattcttgaaattctttaaaataatcatgtaaaactttaaaaatcagaacaatattacaattattatagataatttgagaaggataatttattccacaaatattttatataaattacttagctttgtaagctaaaatatcatgtaggattttttttagtctctctgttattaactatattaaaaggaagaaaaaacagctgagaggaaaattataataaaactctgtgtgtttgtatgtgtgtgtgtgtgtgtgtgtgtgtgtgtgtgtgtgtgtgtgtttctccattcagaagaaataatggaggaggagttaggctgttaaccaagcctagcactgacatcattcaagagtcaaaaaatataatagaaggcatgcctaatacattgtttactattggaaaattgaagatcaagagaaagaaaaaagaaattatttatgtcacccaacatatggaataaactgaaagtgaaaagaaatgctcctattatagcataaaacaactatgttactgttgcagcatagaagtggcatgaaaatacatggggtaataatatcagaagtagtagaggagagtggcctgaaaccatagctcccatcatgaggggaaggggacaaaatgttacaatagcaacccaaaatacagtaatgtctgagaaagtgacagagggtacatggttaatgaagagaacatatcagtaattaataatgaaccatatggaaacgattttatttcttccacacctttgagtaagggttgaatcagaaagaatggtattgattaccatcactatacctactccaagttaatgtggcctggggaaactagaatcacttgcaaatttgtgttcacacaggtgcttcagactgtaggtgatgcttttaaatgtaaataatgctctatattccttttggagaacttaccttacaaatatgctggcacacacacacaaaataatatatgcagagacattcatttgcagcgctatttgacatggcaaattttgactactcctaaaatgttaaatacattgtggcagattaaacaataaaatcatatgcaattaagaagatggaatatctatatataaagatatgaaagtatcgtcaagatatactttaacaggaataaaacaagatgccaaagagcagcatgtatcaaatcaatcatttattattatttcactattattattattattaatttgagacaggaattaatttgaaacctgttgcccagactggagtgcagtggtgtaatcacggctcattgcagccttgatctcctgggctcaagtgatcctcctgcctcggcctccagagtagctgggactacaggggtacaccaccacactgggctagcttttgaatttttggtagacaagtttttgccatgttgcccaagctggtctcaaactcctgggctcaagtgatctacctgcctcggccttgcaaagtgctgggattacaggcatgagccactgctcccaatcacttatttttaaaggtgaggtagaggataaacttcatttgtgtttccttgtacattcataacaattctggaattattcttaaggaactaagagtagtcatcatcgttgaaggaactggaagtaagaattgggcagatgaaggaaaaaaatgaaagaaagactagaaatgcatgattgtacaactatttagtatttgctacattttcagccatattattacaaagtgaaagttaaaaaatgcatataatttaataggcatgttatgagcagtgggactgagtgagctgcctcacactgttaaacgtgataactacatgaatatagtaaaaggatcagatagtctcataaagtccgtaacaactcaaaaaattattatttcttgaattggtaatctattcatttttattttttacatttaaagctagagctacaactggtttagttagagaccaaattactcatccagtttctgtaagccatccacattttactttcatgaaaacacacatggtaagtaaatgtggagatatcaaaaaggaccctcggggtatgtcattgagaactctgtgaatgagctcaggtttctgcatcctaccgtaatacaggccaccgttttataataataaccccgaggacagttgctctttccagaagtgaggtgagtcacatttgtgtttgtgctccattgactgccttttcccttcctccgttgagctcatagtccgagattcctcaagcagttcccgtcttccttcaggcccactcctaattggaacccatctatcccactaacagccgttgagctttaccctgtgaaacattctggttgttgtcttttcaacttgaagtcatatcgaaagatgataattgtaaggctaaattcaatacttggggttagattatactgtattcttattcgctgacaaatattatttttgtgatctcttaatttagttttgaagctttataaagatacacaattaagaccctccaattacatatttcacaatttaactttattggatagaataaaagcagctctctctctctctctctctctctctctctatatatatatatatatatacatacatgtgtgtttgtgtgcatgtgtatttaattatataaaatttttcaggtaggcaaaacatattattttattgtaattagaatttcagagctagaagatattttaaagatatatctcaactattcaatttacagaagtggaaacaaactcaatgaataaatacatagttacagatgtagttactttacgtattgcatgtgtgtataattatataatttttcagttgggcagagcatattatttcattgtgattagaatttcagagctggaaaagattttaaagataagtcttaactatttcatagtagtggaaactgaaactcataatgaataaatacagagtcaaatgtagttactgtaagtattgcagctataacctgtctcattcacattttaaataagagattcattaaggtataattcaaataccatacaattctctcttttaaagtgtatagttcagtcatttttagtatattcacaaaattgtgcaactaccacagctatttaatggtaaaacgtttgtatcactccaaaaaagaaaacctctatccattatcagtcacttcccgttcacctctccctccagttcccagaaaccaccaacatacattcttgtctctatgcatttgcttactctggacatttaacacaaatagaatcatgcaatatgtggccttttgtcacagcatctttcagttagtaaaatgttttcaaggttcattcatgctgtagcatgtattagtactttattcctttttattgtcaaataatatcccattatatggccataccactatttgtttatctactcatcaagtgttgggcatttgagttatttccccttaagggctattacaaataatgctactaagaatatttgtgtgcaagtgtttgtgtggccctatattttcaattaccttaccttacacctgggagtgaaattgctgggttctatgataacttcatgtttaacattttgataaacccccaaattgttttccaaaatgactgcgccattttacattaccaccattaacgcatgaaggttcttatttctctttaccctcacaaacacttattgcatgccttgaaaaaaaattatccttgtgagtgtggtgtccaattgaagttttgatttaccttgccctaaagactcatgatgttgaacttccttcatgtacttacatggccacttgtatatctttcttggaaaaatatctactgaaattctttgcaaatttttaaatttatctttttatcgttaacatgtaagagttatttaaataacctcaatataagttgctaatcaaatatgatttgcaaaaactttctcccattctgtgggctgtcttttgactttcctgatgagatcctttctttcataaaagttttaattttgatgaagtgcaatttatctattttgttgttgttgctgtgcttttgttgttatatataagaaacaatttgcctaatccaaggtcacaaggtcagattcctttattttcctttagaagttcatttacatttttaacatttctttcctcaaagaagtttattatatgcaatttggcaatagtttaaacaataaacaagtaaaggaactagaaagcagatattacatgtttatatagtaatttcaacttcattctttcaattgttatttatcagatacctatagtgaaccaagcataatgttaggagctggttttttaatgtaataatttatttagttttaacaccaattctttgtggcaggaattatgtgcagtcatacatcagagatatcatgggtttagttttagaccactgcaataaagcaaatatcaaaaaagcaaatataataataaagtgagtcacacaaatttttctgtttcccactgcatataaaaattatgtctacactatactgtatgtctacaatatactgtagtatattaagtatgcaatagcattatgtcaaaacataattaacatttaaaaataatttattgataaaaatgctgactatcatctgagcattcattgagtcgttaatatttttgctactgcaggatcttgcctcactgtttatggctgctgattgaacagagtagtggttgctgatggttagggtggctgtgggaatttcttagcataagaaaacaatgaagtttgccacatcagttgacactatcttgcccatatcttttctctgtagtatgcaatgctgcttgaaagcattttacccacagtagaatttctttcaaaattggagtttattctctcactgtgcagctgctttatcaactaagtttatgaaatattctaaatcctttgttgtcatttcaacaatgtttgcagcatcttcactaggaattgtctctatctcaagaaaccactttttttttcctcattcgtaagaagctacttcttatctattcaagttttatagtaagattgcagaactccaggcatatcttaagtctccaattctaattctagttctcttgctatttacaccaaatctgtagctacttccttcaccgaattcttgaatctctcaaagtcattcatcagggttgaaatcaacttctttcacagccctgttgatctgtgtactttgacctcctcccatgaaacacacgtttttattggtatctagagtggagaatcctttcctgaaggttttcaacatatctgcccaaatccatcagaggaaccactacttatggcaggtatcaccttatgaaatgtatttttgaataataagacttgaaagtttgtattactatttgattcatgggctgaagtatggatattgtgttagcaggcatgaaagcaacattaatctccttgtacatgtccatcagagctcttggatgaccagatccactgcaaatgagtactaatatttttaaaggaatcttgttttatgagcaccagatctcagcagttcacttaacatattcagtaaaccatgctataaacaaatgtacattcatccaggctttgttgttccatttatagagcacaggcagaatagatttagcataattcttaaggcccctaggatgttcagaatggtaaatgagcattggcttcctcttaaagtgacctgctgcattagtctctaacaagagagtcagcatatcctttgaagcttcgaaggcagcaattacttccctccacctatgaaagtcctacatggcatcttcttccaataggaagatgttttgtctgcatggaaaatctcttgtttagtgtagcctccttctttaaatgatcttaacctgatcttctgcataacttgccgcagcttctacattagctcttgctgcttcatcttgtagtttttcatatgaagaaggcttctatcttaatgcttatgaaccagcctctactggtttccaacttttcttctgcagtttcttcacttctctcagccttcagagaattgaagagaggtccttgttctgctttagactttggcttaagagaatgtgtggctggttttattttctatccagaccacccaaactttcttcatatcaggaagaagcttttttgctttcttattattgatgttttcacttgagtagtacttttaatttctttctagaacagttttgttgcacaactcaggtgtttggtgcaagaggcttacctttcagcctatctcaacttttgaagttcctctctcagtaagcctaaacatttgtaacatttcattgaaagtgagagacatggccaggcatggtggctcatgcttgtaattccagcactttgggaggctgaagcaggcggattatgaggtcaggagtttgagaccagcctgaccaatatggtggaaccccatctctactaaaaataaattagctgggcgtggtggtgcgcaactgtaatcccagctactcaggaggctgagacaggagaatcgcttgaacccgggaggcagaggttgcagtgagcagagattgcgccactgtactccagcctgggggacagagtgagactccatctcaaaaataaataaataaataaataaataaataaataaataaataaataaataaagtgagagacatgtcactcttcctatcacttgaaaacttcgaggctattgtagggttaactggcctaatttcaatattgctaaaatagataatagggaggttcaaagacagggagagagatagggaatggctggaaagtggagcagtctgaacacgcataatatttatctattaagtttactgtcttatgtgggcatagttcatggctgaccaaagcaatgataataaacatcaaaaataactaatcacagattaacataataatgaaaacatttatgaaataatcaaatattgtgagaattaccaaaacgtgacgcagagacatgaagtgaacacaagctgttggaaaaatggcatcgatagatttgctcaatgaaggattgtcataaaccttcaatttgtagaaaatcaatttctgcaaagagcagtaaagtttaacacaataaatctaggtatgcctatattcatttttttccaaaaagaaattaagagttaggtaacttttctaaagtcattgtatgaaagaatgaagatagagttaagagaaaaacaattctgattctagggaaatgcaaatcaaaccacaatgagataacacctcataccagtcagaatggggattattaaaaagtcaagaaacaacagatgctggcaaggctgtggagaaacaggaatgcttttacaccgttggtgggaatgtaaattagttcaaccattgtggaagacagtgtggcaattcctcaaagacctagaaccagaaataccattagacccagcaatcccattactgattatacccaaaggaatataaaacattctattataaagaaacatgcacatgtatgttcattgcagcactattcacaggagcaaagagaatcaacccaaatgcccatcaatgatagattggataaagaaaatgtggtacatacacaccatggaatactgtgcagccataaaaaggaaacaagatcatgtcctttgcagggacatggatggagctggaagccattattttcagcaaactaacacaggaacagaaaaccaagcaccacatgttctcatttaaaagtggaagctgaacaatgagaatacattgacacacagaggggaacaacacacactggggcctgttgggctggtggggagggagagcatcaggataaatagctaatgcatgagagtcttaatatctaggtgatgggttgataggtgcagcgtaccaccatgggacacacttgcctatgtaacaaagctgcacatcctgcaaatttatcctggaacttaacattagattaaattaaaaataaagttgattctaagcattctgtaaccatatcagatatatggttgtggttgatagctcgaatgtcagagatggagaactgcctgggtttgaagaatggcgttcaaactcccagcaattcgactttggtctagttaattaactgctttgcatttccatccatgcaaagtgcaaataataatatttatataggacagttatgagaattaaacatgttaatgcatttaaaatacttaagcttatgactggcatgttattaatgcacacaaaatgttaaaatgttagttatatttattcataaaatttattataaatctctgctgtctggaactgacattctattagcggggacagacgctgaactaacaaccatgtaaatttttatgtaattaccaattttggtaagtactacatagaaaagaaaaaagtaatataaattataaaagtgattaggtagttcaagatattcaagtatttctttttctgttccttgctgtgggtgttaaaatctttttatatttgttttcttaaattttcatacaataattcatttttatatatgtatatggtgtttccacatagcaatacataagggaaaaaagttgattaggataaaaatatcctgactctcaactgaaaagtaggtaaaagttacattcagtaatacaaaaaaaaaaaaatcagcttatacaactatttcatgaggtcttatttctaatggaaatttagtatcatcacttcaaagtatttttagaaatacggtataaatcatatatgaattagggttctcttagagggacagaactaataggatagatgtatatataaaggggagtttattaagtattaaattacacaatcacaaggtcccacaacaggccgtctgcaagctgaggagaaaggagagccagtctgagtcccaaaactgaagaacttggagtccaatgttcaagggcaggaagtatccagcatggaagagagatgtaggttgggaggctaggcccatctctcctcttcacatttttcttcctgttttgtatttgttggtggctgtttagatggtgcacacctgattaagggtgggtccacattccccagcccactgactcaaatgttaatgtcctttggcaacacccttacagacacaccaaggatcaacattgcattctccaatccaatcaagttgacactccatattaaccatcacaatacaattaataaaactaatacataactttaaaattataaaatctcatttatcccttaaattttaggcctttagtttttgaagcactcaaaagtcaaagttaaaaaagttactatcattataatgttacagtcaaatgcccagtaatgtacattaatgatttcattttagaaaacatgtgcacagttcttactggcctagaacagaaaatgaggacattgtgtgcaaatcaatggggacattgtgtctctggaagtgactagagttttgggtatttttcctttttttaaaaaaatgtcaacttttattatagattaagagatatacatgcaagtttgttacatgggtaaattgtatgacactgaggcttaaggtcccaacaatcctgtcacccaggatgtaagcatagtaaccaacaggtggctcttcagcccatgaaccccttcttttccgctccatctagtgatgcccagtgtttgttattcccaaccttacaattaggcattttcaatgtttagctcctacttataagtaagaacatgtggtatttggttttctgttcttaagttagtttgctgaggataatggccctcagctacatccatgttgctgcaaagggcatgattttgttctttcttacggctgcatgtattaatccgttctcacactgctataaagatactatctgaaactgggtaatttatatataaaaaaggaggtttaattggctcacagttctgcatggttggggaggccaccagaaacttgcaattatagtggaaagcgaaggggaagcaaggcacctcttacatggtggcaggagatagagagagagagagagtgcgtgtcagatactgccactcttaaaccatcatatctcatgagaactctctatcacgagaacagcatgggggaaactgcccccataatccgaacacctcccaccaggtcccttcctcaacacctggggattacagttcaaggtgatatttggatggggagacagagccaaataatatcactacataatattccatgatgtatatgtaccacattttctttatccagtccactgttgatgggcgcataggttgattccatgtccttgctattgtgaatagtgctgcagtgaacatataggtgcgtaggtctttttgatagaatgaattatttttctctgggtatatacctagtagtgggattgctgtgtcacatggtagttattttttaagttctttgggaaatctccaaactgcttttcacagtggttgaattagtttgcattcccaccaaaagtttataagcattgtattttctccccagcctcaccaacatctgttattttttactttctaataattgctattgtgactggtgtgagatggtatctccttgtggttttgatttgcatttctctgatgataagtgatactaagcatattttcatatgtttattggttgcttgtatgttttcttttgagaagtgtttgttcaggtacttttcccatttttaaattggattatgtggttttttgcttgttgatttgtttaagttccttacagattctgggtgttagatctttgtcagctgaataacttacaattattctttcccattctgtaggttgtctgtttactttgttggtaatttctttttctgtgcagaagctcttttgtttagttggatcctacttgtcaatttttgtgtttgttgaagttgcatttgggcttagccataaattccttgccaaagtctacgtagaaaaggatatttcctaggttttcttttaggattgtcatagtttcaagtcttacatttgaatctttaatccatcttgaattaattttcatatatggtgagaggtagggttctagtttcatagacctcattcaatggctgcatatggctagccatttatcccagaaccatttattgaatagggaatccttcccccattgcttatttttattgattttgttaaagatcagatggttttaggtatgtgggtttatttctagattctctattctgttccactggtcgatgtgtctgtttttataccataccatgctgttatggttaatgtagccttacattacagtttgaatttaggcaatgtgatgcctttggctttgtgctttttttgcttacaattatattgcctattcaagctcttttttttttttttttttttttttttttttttgctgttgttgttttaaatgaactttagaatagatttttctaattctgtgaaaatgaccttggtattttgatagggagagtgtttagtctataaattgctttgggcagtatggccattttaactatactgattcttccaatccataagcatggaatatttattattatttttttttgtccctgatttctttcaacagtattttgtagttctctttgtagacatttttcacctccttggttagataaactcctaggtatttcattttgtttgtgactatgataaatgggattgtgttcttgatttggttctcagctagaacgttattggtgtgcaaaaatgctacttttcttttaactgattttgtattatgaaacgttactgtatttgtttatcaagaatgtttaggtggagtctttggggttttgtagatatagaatcatatcattgaaaaagacagattgacttcttcttttcctattttgatgctttttattttattttctctcttgcctgattgttcctgctaggacttccagtgctatgttaaataggagtggtgagagtgagcgtacttgtcttgttccagttctcaaggggaatgcctgaggtttctcccattctgtatgatttggctgtgggtttctcatatatggctcttattattttgaattatgttccttcgatgcctagttggtcgagggtttttaacatgaagggatgttggatgttattgaaagcttttcacgtgtattttggctgtaataccaaaaataagaagtgtgtcataacaacagaggcatgaagagacagccttcttttcccttatttccctcattacagagttaccattttaggtccattaaatgtattttcctactctataaggtgtccagttcaaaaaaatcacacaagggcctagagacctgaagatgaactctagagaatggtataatatgttttgtgtggatagagtatttcatttttaagtatttattactttctgatagattatgtcactcaatcatggtgtctaatatatagtattacttttataggtaaatttataagtcaccatttcagacatatatttctcaaaattaggactatagaacattcaggaacttggatttgtaaagggatcggctgctggtatgaccgaacatacaataataagtaaactaatgttaaaaataaattttaaatacacataataaaatattctataccttcctgggttataaaataaatatagttgatccaataatttttaagtgaatatgaaattcccttctacatatttagtttcaacatccctgcagaaattctgggagagaggaaagagagttacaatgtacttagagtttgttcaacagggtgtggcctgggacagactgtgctggtctttttcttgtggaacctttgctgtatcacctttccctaggatattgcactggcttttctctgtcatctacacttctaataaagagagaaggatgaggctataataaaagttctcccttggagtagtctctctagtttgtgagacttctcagatttaatgaataagaaaatataaatgctatattgaagtttgatgtatctcttcagcctatttcaaggctatgctacttgttagcatatccttcacatgccattaaactttttgggtttcggaggacacccaacatgactttccgggaagcatcttctatctgtccttgaacacgcttcaacttctttgtgtagtggggcaaactgaacttctatatgggcacatgttttcattaggcttcttcccatgacagagatgtttcgtgttacactacatttgttgactgttaaagtaaggcagtacatttaactatcaacacagatagctattcttgctaagaactatattttgaactcagtgtctgagaatatgtacaaaaaacttagttgagagatacaattcatatatccatgaacatttattgcacacgtattttgtatgcagtgaatcctccagataccattctgtgcattggcaagataagattgaacaatttggacaggatctctggcttcacagagctaacattctactagagatacagttttcatacagaagcaacatgcatggtgggctaagagcttgaattctgaagttgtacctgaatttaaatcctacttcaagcacattttagatgtgtgatcttgagcctctcttacatcatttgtaaagtgcacatagcaatacagattaataatcctttatctgaaactcttgggggcagatatttttcagaattcagaaaaaattgtatatttagaaaggtaatgtggtacatatcggtgtaatatttaacaacctaagtaggtctgcaaaagcattttttttttttttttttttgcaaagaaacacatgaatagtcactctcagtggaataagaagagattataaacagtctcacctcagttcaggtcaacagtatttgacaataaaagggttttaatgtcaaacttctgaaaaaaacaaacagcaacaataaaagcagccactggttttcatcatgtttttggatttcaggattatagctaagtgtttatggatatgtagcacttgaagaagacaacttatgtcttgtcagcacagattctggcatgtggtgggttcttacttgttattaatatcagaattggcctggctatttctttagaaagtaaaataattattattgactcaaccataccagcagatatttatgtacgtgaactgctttcatttgacaccttacttctcctcaaattatttttacagaatggacctttagaatttttatgtggaaatattatgaaacggaggcttgtgagactgactatattatttgcttcatatttaccttaatgttatagattatgtgtctttctgtgcaatgactggtagaaatcttacaaaatagagatcaatctccagcaaaatacaaggcttcactgtataaactaaatatgttactttattcttaacgttctttcatttcctacaatatttaaccaccttttcctgatttttaataaattcactttttaaacttttcacctgtattttcatatgctgtctcaagcctctctgtatcaagacataaagaataaatttgtgcattatatatagatatatatgcatgtgtgtgtgtgtgtgtgtgtgtgtgtgtgtatatatatatatatatatatatgaaatatacccacagtgtatttcttttttttgtttttttgtttttgagacggagtctcgctctgtcgcccaggctggagtgcagtggcgcgatctcagctcactgcaagctccgcctcccgggttcacgccattctcctgcctcagcttcccgagtagctgggactacaggcgcccgccaccacgcccggctaattttttgtatttttagtagatacggggtttcactgtgttagccaggatggtctctatctcttgaccttgtgatccgcccgcctcggcctcccaaagtgctgggattacaggccacagagtgtatttcttctttttctatctccttcatattttcagatcctagactaatccaataaccatcatctatttactatacatttttattttcaattttaattgcaattatatatcgtgttttttgtgcctgtgtgtgtgtgtgtgtgtggtgtgtgtgttcaattggctcttgtgagttagcctagaaaagtaatcatggtttatactctgatttctatcaagaagtaagctacatgtttccattacagttccatattgacataaaaactgtttctaaattggaaaccaagctatgtgccaacttatttattgcatatttttaaagaatatttgtgtttcactagtaagtcactttacttctttgcaatacacattgtaaaaatctttgaatattttttttttctgaatcacctattcctagaagtgtggatacaaaggaaagaaaaataagaggacaacatttatatttttctctagaaaacaatgttttctacaatattgatttgtaatttttatatttttccctcttctttaacctctaaggttttcatttatcatgtaaaataattttaaaattagaaacaaatcattttatatgagtttagcacatctcattttttcctactttcacattaattcattacactcaaatttcattcactgagaatttgtaataaaaataactattcatccctgccatactacttagcatttctattagcccatccacataccctgttgcactttacaaggcagaaactctgaattgcttacaggtcaccaagcacaccctggcatttcagacttttatctgtttacacctgtttttcctctgcctgtagcaaatgtcttcttctcctttgttcactagaacacatcctatgtgacctccacatcacaaatcagaggtcattgcttccagaaattttctactgacagtccaagggagcattcctttgtgttacttctagtgttcctctgtatttctctttaccagatacatgtgtgcatatttgtgtttattacattgtactgtactaaatttcagtgagtttcctttttagtatttgtataaatttaagggctacaagtgcagttttattacatggatatattgcatagtagtgaagtctgggctttcagtgtaaccatcacccaaatattacccattaaacaatttttcatccctcatcccctcccatccttagtgagtttcttgataggaggcatgtagctttttcattgctctacccttacccagtcatagcatttcctatattttcattgattgtatacaggcttaaaataaattaggttgaaattaaactatgtatgttagttttttttaaaaatgatccatttcatagaaggacttaaatagtaggccaatacccattggtaatgtgagtgatgaagaaggtggaagaagaatattagcagtttagatttacaccttgagtttgagtgccagttaactatccaagtcagtagtaagattagattgtgggccactggagaaagattacacataaggagaaaatcaaaaggaagaaaggtgtccaaagtgataaacttgcagcaatacctacatcttaagaaattccatcatttaatgagtttacatatggaaagtgtttgggaaggattccaaaaggatgggatgagaaatgctgcaggaaacacgggagaagttgtaattctgtaaaatgaaagggaaagggaatctcaaaaagaaatgactgtttattgtgttaaatatatgcatctgggagacattcttgatgttagtgatagtaatttcactgctgtaatgtgaagaaattttagtattttgaaagataaatggattttaagaaaagagagatgatccctacaaattttgaagaggaacacactagattgtgctagagaaggatatggggttgacagaggatttttttaaatgtaggaacaacttaaagaatattactttagataaatagtttagaatgaggttaacataaaagaacaaaaggaaatattgaaaataacaaaatgggaataatatattgtttggtaagtagaagttgcagctttgcactgacaatggtgatacataataaagtcttggcatcataagtaagtttgtagactggaaatgattagcttgagaatcttgctgcaccttgtatcttactgtctgagacaatagctagtgggaagctaacaatttattagaatggtaaaagttaaaagcatcttctcttacagtgagaagagaaaacatactagagatatatagaaagatgttcagatagccgtgcatcttcaaaaatgaggctggatgcacagaatctgtgggcacacaaatctgcaaaactttcgtgattgtctccagtggccctcagtagactggctatggaaacaaggagaatacatggtgatattaatgcaagtttggagttttcataattaatattacataaacaaaaagagaagcaatagagttaacatttttcagatgatagtcaaagggatggaacactaaattgaatctaaatttgatttaggagagaaagcaaaaaggagtcatttattctggctgatggtgccattgacagtgatgagctatcctagtaaatggtacaaaggcaaacatatggttgtggacagtgagcctagaaagtaacacctccttttaaatactgtgatgttgccagcagtcattttcatcataaattctatagaataacatgtggatgctgcatgaaggtttttttatatttagtttctactgggactatgttagtctaacattaaatttattgtttattatagggttagatccatttatacagcagaagacctcactaagtggtatattttccaataaaaactaaaacctgaatttaaaatcttaggagctgattatattgcagtggaaatttgtctcgcttcattattccatgaaagttttcattcatgttggtatctagatatactagacaagatgttacggtagtcagagcatgcttttcaccctgccttattattattattttgtttttgaaaaagaacaagataaattgtcatcttaaacccataacattaagtatttcataacttcttaaaaataaaaagcaaattttatcttgtaaaattttcatctaatattttattttcatgaataattactgatatatcttaacagaaattgttgataatattagcaataattcatattcttaccataatttaccactgacagattacttttatatgtattatcttctgtagagataattacattaaactctacaacaaatatagatttttaaaattttgtttatttttattattattattttaatagttttgggagaacaggtggtgtttggttgcatggaaaagttctttagtggtggtttctgagattttggtgcactgattacccaagcagtgtacactgtacctgtgtagtcttttattcctcaccctcctcccacagttcctcccaagtacccaaagaccattatatcattctttaggtttagcatcctcataccttagctcttgcttataagtgagaacatatgatgtttggttttccatttctgagttacttcacttagaataatggtctccagctccatccagggtgctgcaaatgtcactatttcattccattttatggctgagtagtattccatggcgtgtgtatgtgtgtgtgcatgcgcatgtatgtgtgtgtgtgtgtgtgtgtgtatgtgtgtatatatatatatatatatatatatatatatatatatatatcacattttctttattcactcattggttgatggtcatagtctggtttcatatctttgcaatcgtgaattgtgctgctgtaaacatgcatgtgcaagtgtctttttcatatagtgacttcttttcctccaggtagatactcagtcgtgggcttgctggatcaaatgatagttctacttttagttctttaaggaatctccatacagttttccatggtggttgtactagtttacattcccaccagcagtttaaaagtgttctcttttcaccacatccacgccaatatctgtttattttttaatttttacttatggccattcttgcaggaaaaagttggtatctcattgcggttttaatttacattttcctgatgattagtgaggaacaatttttttcatatgtttgttggctatttgtatatcttcttttgagaatcatctgctcatgtcattttcccactttttgatgggattatttagtttttcttgctgatttgtttgagtttcttgtagattctggatattcgtcctttgtcggatgcatagtttgcaaatattttctcccactctgtgggttgtctgtttattctgctaattatttcttttgctgtacagaaactttttagttgattaggtcccccgaatttatctttgtttctgctgcgttggcttttggattcttggtcatgagctctttgcctaagccaatgtctagaagagcttttctgatgttatcttctagaatttttaaaatttcaggtcttagatttaagtttgtgatccatattgagtttatttatgtataagttgagaaatgaggatccagctctattctcctacatgtggtttgtcaattatcccagcatcatttgttgaatagggtgtccttttgccacttcatgtttttgtttgctttgttgaaggtcagttggctgtaaatatttggctttatttctgcgttctccattctgttccattggtctaggtgcctatttttataccagtaccatgctgttttggtaactatagcttgtagtatagtttgacgttgggtaatgtgatgcctctggatttgttctttttgcttagtcttgctttagctatgcatggtattttttggctgcatataaattttaggattttttttctagttttctgaggaattattattgtattttaatgggaattacattgaatttgtagtttccttttggcaatatagtcatttttacaatagtgattctacccatccatgagcatgagatgttttcatttgtgtcgtctatgacttctttcatcagtgttttcaaatatatgtaattttaatgctcaaagaaggtgcaaaaataattgtctgcaagtttatattggcaatgtaatagttaataaaaataaatttttgtttttgaaaatgggaaaataatacacaataatcatgcttccataaagaacacatttcagatttgacttttaaagtcctaggtataaatataagtaacggagaatttagaagggctatgaaaataaaatgagagcaaaatactctgaaaagtaatcccaaagacaattgttatggtttgactatgttccccaaaattcatgtgttggaaacttaattctcagtgcaacagtgttgtgagatgaggtcttgaagatgtgattagctcataaggctcataaggattcagatagggaaaatataaagcaattaccccctgaggaactaacgctccagtagagtaattaattgtaacaaaaaggtaaaggcacaatatcatcgctattcaacatttttaaaaagtaccaggtatgtactaagcactatatataatagtgttcagaaattatcatattacatgccattgtggaggttgcagtataatgtgaggaggtggatgttaatcaaatgattaacaaaaaatataaaatcataatagttattgatatggtttggctctgtgtccccacccagatctcaccttgaattgtaataattcccacatgtcatgggacggacccagtaggaagtaattgaatcatgagggcaagcctttcccatgctgttctcgtggtagtgaataagtctcatgcgatctgacggttttataaatgggatttcccctgtgcaggctctgttgcctgccactatgtaagatgtgactttgctcatcctttgccttctgccatgattgtgaggactccccagccatgtggaactatgagtccattaaacctcttttataaattactcagtcgtgtgtatgtttttattagcagtgtgagaagagactaatacagttatacatgaagaaaaggatcaatacatggagctactatgttgtaccatggaagagtctgaggtagatttggtgttcatacatgcttctctgaagaagcagtgactgagttgaaatctgaagaatgagtataaatgagagcaatgagcatgtccccacactctatggctggaatgggtttggtgaatccagtgagctgggagatggccaaaatggctcatggaaagactgaaatggaatacactgcaaaatgaggctgagtggcagataaggagcagaccattgaagaccttagctctgtaaagggaacaaacaccaagcgtcaagacaaggatggggtgggagtggtggaattgtgacctgattgcatttgggattttaaaatgttacactggctgtagtgtagaggaaagattagagagggctaatggtgatagaagtagatgagtgggcaaggacaagataatggtggcatggacagaaagaattggaggcagatcagagatttaaatatgagacaaagtagagatgaattgctaacaaatgagtaaaaagatagaggcgggaaagatgtcaaggacaaaatctaggtttctggctagcttaattaaatgataatgatatcattcatcaagtttgggtctcctccttccacacccccctaaaaaggacattaggttaatgtttgtttagataccataaatgacatgtttagtaggtcctgttagtaagaaatctccatttctctggcctcatatttctatagagaagagcttcaaaaaataataataataacatgttggcctttatttttacttcttactcagtgctctccagtgaagatggaaaaattatctggttaataatttggaggttaatgttgtactcatatctctctccctctctttcctttctctcgtctctttcttttgaaggtttggggtatttctacatatttccagaaagcttaaaagcttaatttgcctctgctatagtgggatagattttgaattatccttcttgcttgttaaaatgtagacaagtttgtcattttcaggtagagtatgttgaaagctcattttggtcacagagataaactgtactctaatcagtctaccagtaataaagcttacacttcagtcttccatttatctttctcctgtgactgtctcttaattggcttttaacttatgagggaaagggaatgtgatttaaacctcctaaaactcttacatgtagctcaggaaatgagtaatctgcctctagaagtaattgaagctgtggatatggatgagactgccttgggatagaatcgagaggtaggtgaatagcctaagactgagcatctaatcacaactgagtgtcagttctggtaaattaagatgacggataaaatacgtcaaataaatttaaacaacatgaacattatatttgtgattttagaaaatggtaagaagccagattgaagtcatatctcgtgtttctggtcttgttaggtgattgggcaggttcaagtgggaaataactttttggaagagatatttctttaactgcttcttaaagttgagtaaaagttagaaaagggaagagaatgagcaaagcttgagaggaaaaagatagcaggaaatttcaaaatcaccttcttccttcctttttaccttaaaaacccatctctaagaactaacacttatttaggtgctgtaacttgaggaaaaaatgattcactagaaaaattctaggacatttatttcagtggttatttatatagtcaatagtaatcatcagaaaatatactctgaaaattggaaaatatacctattttatttacttaaatatttcaaattttacgctgttgttctctgaaaatataaaaatgaaatttcatcaaagtttcttagtcattattataaagtatgatattttcagcatgaattagaacaaatatatagtcttgacatatagcttattattggggattatagagttgtttgcagtgaagggattttagcacttcttttaaaaaattggtttcacaaaatgtatcactggaaaatttatttccctttggagaattctgctgtgactacaaattcactcttgtcaattctttgctatagctttgctagagagcatgtataatactaaactataatataaacttaattggattgatccatttatgtatttattgcatttgtctggaaattattaccataaacttttaaatagtaagttttaacacctaatatggtgttatgatgcacatagaaactatttttaaatttatagaatcaaataacttgattacaattttatgattatcctatctaagctccagcctagtacaggagtctgtttatcactgaagaccatttattagcatattttaaatataataaaagggagagcacatgcttgtgttataagacaaatcatatttttgttgtttacaaggtttgttttcatatttgatttgtcttctcctaatttcaatccctagtctgtccttcacataatacatcaatacaaaaatcaattaccaatttcaaatgataacttttcaaatagatgaagcagacatggacatcacccacactgaaatgttttttgttttgttttgttttgtttgagacagagtgtctctctgtagcccaggctggagtgtagtggtgtgatctcagctcactgcaacatccaccttctgggttcaagtgattcttatgcctcagcatcctgagtagctgggattacaggcacgtgccatcatgcccagctaatttttgtattttcagaagagatagtgttttcacgtgttgtccaggctgatctcaaactcctagcctcaagtgatctgcctgcctcagcttccaaaagttctgggattataggcatgagccaagctgcctggccctcacactgaagttttttttaatgtaaattctctgtcagttactacacaacttaaaaggtaaatgagaacagttctttttgtttttttcagttccatcatttactttttcatatggctagtttccaaatgctgcaccttttacatgatcagctctgagagctttatcttttattaattttatttatatttattaatcatggttatttaaattatttgtttgttgagtgctctgtatgtgttaagatctgtacggactgttttatatttattaatttagtaaatacctgctgagttcattctatatatctggtacttgaattcagtacagtggaacaatggatgtgttataggaattagaccttatacaattgtgggaggagctgaggaaatacagatggaaaaaggagaaagtttgagaaaagatcaccagtcagtcttcccaaagcactgtcacctttggcatgagaatgctgagaacccaagcacatttggttgctgaagtgggactgcaaatgaaagtttgtagaaaagtcagttagaagcttttgaccctgtaagatctatctgctgtaggcccactgctaagagtctggtagtgggtccaaggctgctgttattcaaacaggactaatagatgagaataagaattagacacaaagcagaagagagtaaaaacaagctagagtttgctgggcgctctgtttcagtcactctctgtgtctgatgtaggtttagagagtaatgcccactgcttcactttcctatcccaaatcttgcacaagttccttttctgttcaactctaatccagaactatacaaagaaaagaacactgggtagtatagttaatagcttaactattagagagccaatagttcaaatctgcaagggatgcttgggattcagtggtgaaaagacagaaaaagttcctcgcttcttgcagttacattctagtggtagagtcagaaaataataaatattttatttaatgtcaagcagtggaagttcaggaaaaataattaagcagagaaaggaatggagaatgatgccttggagcagcatgagtggaggatgagatgaggcttccctttttgagtaaggtggatgaggaagactcatctaaggaaatgcaaatgagccttagagacctcagtgatgtaatgtgaatctttcagctacctaaaacagatcagtactggcagagggtaggcagcaggtgggaaaaagcttggtgatttttggaagagccgggtagtgtgtctaaagttgaatgagtgaaatggagagttctaggagcagatttagagacctttccagggattcgttcaaagagaacattataggcatgaaatgagtttggacagtgtatgataggagtccactggagagttttaagcagagatgagacaagtttgaatttacattttattttattttatttttgtgggagaccagagttttattattactcaaatcagtctccccaagcattcaggaatcagagattttaaggacaacttggtggggaaggggaagccagtgagccagcggtgttaattagttaggtaggagatgaaatcacagggaattgaagctgtcctcttgtgttgagtctgttcctgggtgggggccacaagatcagaggagccagttaacccatctgggtggtgccagctaatccatcaagtgcaaggtctgcaaaatatctcaagcactgatctagcaagcagttcagggagggtcagaatcttgtagcctccagctgcattactcctaaaccataatttctaatcttgtggctaatttgttagtcccgcaaaagcagtctagtccccaggcaagaaagagatttgttttgggaaagaactgttaccatctttgttttaaactataaactaagttccccccaaagttagttcagcatacgcccaggaatgaacaaggacagcttggagaacaagatagagcctgttaggttagatctcttttactgtctcagtcataattttgcaaaggcagtttcaatccctccctttgggttttaaaacacctcagtcttatggtgtaggctatgaagatgggacaaatcctgccatctttgtagagagtagattctagcgagccaacgcgagaaaaatggagtctacatgaaaaatgatagctcaaactgggaatctagctgatgtggtagaaagaaatatatcctgaatctaccttgtaggtagagctatatagtaagactagctaatagaccattgttaaaaaagcaaatggagttaaggatcatcctaatttttttagcaaataagtgagttttggcagtatttgcagagatgagtaagaatggaacaccagtgagtttaggagataaattattttctattagaagttagagattttgtgttgattaggcagttacaaagaaaggaattgaggtgaagcgaggagagatggatattgaggtgtacattttgtagttattcaagtccataatgtgtttagggacacgatactagaaaatcagtggggaagatggtatagagtttaaaaagtgaagagaagtgatattcttgtggcaaagattgtgtacaacttaataagagaagtgttgttacattcttatggcatatgcttacctggagggagtaatgcttcttatgcataacctgatttatatcctattttccttcacaacagatttgagctgatgttcaataatacttttggcactccagaataaaatgcaaacagagggtagttgggtgcaagagagaaccagggtagttaaattttgtagccgaaagtaagttagcacaggtgtattaaaaagaaatgatgatgaagatgagctgcagatttttttgcagtgtccaaaacaagaggagcaacacaattagtcaaattgttagaagatttataatattcataaattaaaaaataaaaaagagaaatggaaaaggaagaattgctctgaaaatatttgcgaaggctctgggcttctatgctcttcaagtagtgttaaaccaatttcctttgaattgtctgagatgatattacatagtatggcaagtgatatttggaattcttgtgacattatgttactgaaatgaaattcaataaaaacagtcctacagggacccaagcagttttatacaagttcttaattctctagtagtctgtcttgatccaagataaacttcatttatttcaggtaatcttccacaaaattctctcaactaggagtttgataattattgcaaaggaaagagttattctttcttcaaaggacctgtacttctttctcttcctgttcatatgtgggaaacatatgataccatgtattatatttttctatattccttgggatgttaaacttacaactggacaatactccaagttccctgtgatcgtagttgatatgacaggatgaccaactcctttggataaaataaattggatttttaaattaagttccaaacttttgggagtgagaaatattttggtagtcaagaaatgctcatgatgatgactacagtgataaactggaagtaatattttatgaacaatgacacataagccaccaacatgtggtagttaggaataactataaaacatctataaaagaactaaaatttacaaaaccctcagtgtaatgaatatgagaaataaaaatctcaacatcaataagtgagtcaatttaacaatatttctcactatttctatagggtaataataggcttttgaactgaaaaaaaaaaaccacaaggacaagcttctagtttcttctgatatttcaataaaaattgtctatttacaacagcagtcctaacaacaaaaaatactactttttatactcctctgattaaacaaaaattcaaaagttgcttgtaaccagaggagctaataatcattattaagtatttactaggataaaataatttaatgaatggaaaaaacatagttctcatgactatctaaattatatttcaaatgttaaaattaagtcttgtattgttattaaacatttttaaggcagttaaatttttaattgtgttgaattcagcagaatcttttaggttattataataattataagatgaattttcttgactaccaagccaaaagaattatttcaaatagtttaaatacaattttctgtagaaagagaagtaaggaagatgatttttttccacatgagtatcattattaagtagacgacagcaaatacaaccaagaaaatccatctttgaagtgtgctaaagggtggctcgtttagatatggcaattaatcactgcattatttatagtactttaggaacagctcatactacattaatcagggataacttctgcttaattaacaagactgccaaaaaatgtcaaacacaagcacaaaaacacaatggaataaaaacaagaaaacaagtgttagctagcgactgatcaccacaaagtgaaattttaacttgcatcacaatattttacttgcttgaacttttatactttagctggatatttcatgaaacgatgatttcttctcaaggttgaaaagggtgctgtttaggacacatagtagcaaaataaggtaatccatattatatagtgttttacttctgaccacctcttctgtagtatgtttgtgtagcttattctgtctaggcaactgcctactttcccacatggattgggcaggcattactgaagtgccaaaatagactgtagttagattgcctagtttaaattctggcaccattatgtcccagctgtgtgatttaagataaagtaatcaacttctctgtaccttcatttaataatttatgaaagagatgaaaaatgccaactaacttacaaggtggttatgcaaattaatatatttaaagcattgaccaatctgtaactactcaatatgtattaggtgttattattatttgtattttttaatcaggaaaattatcctctatcttctttagctttctatagctctctcttccttagcctctgaaagataacctaatcccacctactttctttctctttaacatctcacttggacacctgagcaactgctgtatgcatagtacaatgcaatgaatactttatgattcaaacacacagttcaggctttctatggtaacttgtacttcatacatctctggcatgtagttttctcagatatttgatcagtttcatatgtccaaagttatgtcacatttaatgaaactataactaataataagaccttgggtcattctctgaccaccaatactgaaatacctagaataacacaaattcctaggacttcttggtccacggaatatatggtaacatgatatacaaagaactttcatgtgatgagctaaagcaggaaaatggtattcagggtagaaaaggtatatgctttgcttaaggatgtgataaataatgtaacacagttgggaataaccaataattgtagatgtctacctgatctagtctgtccattttaaatgacagcagcaatcagtattaatgctaaaacaaggaattacaaacatagtgcaaccttcagatacacagaaatgatagcttcatctaaatccagaagatactgcttaagtgaggttctgtagatactcaagtatatgaagagcaacagtatgaaatgcttcccctttggaaatacaatcacaaagaacaagagcaaatatctttcctttgatttgttgaaaaactgtttattatatattatgtgaaattatcacatacatttttttcaccttttctttccactgatacaagcatttgttcatggacctgaagggaccttctctctcttttattactatataaaccctagaaatgcaaaaagcataaggtcacctcctagaagaaaccttcctagattatctgacatgaaaatcatatttagtaggtgagccatccaagggctcatgttttaaaatggaggagggtgagcatacctatgtgtgttagtgtcaggacacaggtttttgaccaatggtatcaaaatcactgggttaatgtcatttcccttcaatctcacctactaggaactcagatcacattgaattattaaatagtggacttgaattcaggcttttatgtgtttgttctatttttggcttaatgtcttactaacttcctatactctgatccggctcaaaatatcagaaggatgctccaaataatacatacattttcattcttgtattagttaatcttgtattctttcatattgggtttggctttagtgggttccaattatgggaccttatcagtatttagacgacattcttgatctattatgttccctaaaacgtatgacaaatatattttgatgaatgaatgaatgaataaatgaaggggttgggataaacagccccatgaaaatgaaaaagatagcatacaaacataggtttgttgagttatggactaaattgcaacccacattattgataaaaaactgttttcttgttgttaaatgctgtattttcagtccatctcagatgttatatagaaaaatatactaggaaaagctagtacaatgaatggtccctagaccttctattttgccttattataattgtagatggaaaattcaatttttaagaaaatgtaaataaagagatcatgataaggagatgactttttaaaaggtagcaactagaacattttatcaaaatagcaacaaaatgttaacaaatagagcgaatagaccaagttatcttggtttcagttggttaagtttaattaaatgaatataataagcccaacacagtacaaagttttattgtaaataagttttatagattttcttatcttaatgaatgcaaagtttttgttgtgttttctactctaattgaaaaatagaaaatattcgaaagacttaccaaaaatcaagctattgctagggaaacaatctactctgtgcttctttggagattagaattattttgttttcaatatttgattaatgctaataaaaataatagttttgggccaggcacggtggctcatgcctgtaatcccagcactttgggaggctgaggcgggcggatcatgaggtcaggagatcaagaccatcctggctaacacggtgaaatcccgtctctactaaaaatacaaaaaattagccgggcgtggtgaggggtgcctgtagtcctagttactcaggaggctgaggcaggagaatggcatgaacccgggaggcggagcttgcagtgagctgagatcacgccactgcactccagcctgggcaacagaacgagactcctcacaaagtaataataataataataataatagttttgaaaaacattttgtttggcatttatttttcaagtttctaaagaatttactggaggcattgtaagaaattcatctttaattcttattcttttgttttcttttttctctcttaacttctgatatttccttcggtaatcctgttacagtttctaaattttcagtaaggaaaacaaaagagaatagaactataacaggtttattttttccttgtggacaattggtatattcccgtatattctttccctgtgatattaagaagagatagcatttatcataattttctttttattgaacattttgctttgagtattaagttataactattatgttttttgctaataagaacatgtaagtaaactaacttacattttatttaccatattttagaaattaaacacatggatgtcagagacattttgtgaagctaagacctacatttcctatcttttaatgtttattttattatgccacttccatgatagttaaactagtattttttatttttatgcatgcacagtaggtgtgtacatttttttgaaaacattatgaatttatttatatacatgttccacaaacattttttttaaattatactttaagttctgggatacatgtgcagaacgtgcaggtttgttacttaggtatacatgtgccatggtggtttgctgtacccatcaacccgtcatatacattagctatttcttctaatgctatccctcccttacctccaccccccgacaggccccagtgtgtgatattcctcttcctgtgtccatgttctcattgttcaactcccacttatgaatgagaacatgctgtgtttggttttctgttcttgtgttaatctgctgagaatgaaggtgtatacattgatggggtgcatgagatatttcgatgcaagcctacaatgcataataagcacatcagggtaaatgcagtgtccattatttcattcaaatatccaatatcccagcctcttgtaaatattctattttctgtcttcataagttcaattgttttaagttttagatctcacatgagtgagaacatgtgaactttgtctttctgcgcctggcttatttcacttaatgtaatgtcctttcattccatccatgtcattgcaaatgacaagaacttaattctcttttatgcccgaatagtaccccattctgtatgtgtactgcattttctttgtcctttcatctgttgatgaagagcttaggttgcttccaaatcttggctattgtgaatagtgttacaataaatataagagtgcagatatctctttgatatactaatttcctttcttttggaaaggaatccagcagtgagattgctagatcatatggtagtctatttttagttttatgaggaacctctaaattgctctctatagtggctgtactaatgtaatttagtccccagcagaagtgtacaagcattctgtgttctccacaccctcgccagcattcattattgcctgtcttttggatataagccattttaattggagggagatgatagatcattgtagtgttgatttgcatttccttgatgatcaatgatatggagcaccttttcatgtacctgtttgttgtttgtatatcttcttttgagaaatgtctattcagatcttttgcctagttttttaaatcagattattagattttttcctatagagttgtctgaactccttatatatctggttattaatctcttgtcagattgatagtttgcaaatattttctcccattgtgtgagttgtctcttcacttttttgattgtatccttttctgtgcagatgctttttaacttgatgtgatcaaatttgttcattcttgctttggttgtctgtgcttgtggggtattactcaataaatttttgcacagaccaatgtcgtggaaagtttcccccatgttttcttgtggtaatttcagaggttgaggtcttagatttaatccttcaatccattttggttttatttttgtatgtggtgagagataggggtagtttcatttttctgcatatgaatatctagttttcccagcaccatttattgaagagaatttcttttctccaaagtatatttttggcatctttgttgaaaatgagttcactgtagatgtatggatttgttttggttcttggttctctattctgttctattggtccatgtgtctgtttttatgccagtaccatgctgttccagttacaatagctctgtagtattatttaaagtcaggtgatgtgatttttaaagtttttctctttttgcttaggatagctttagctatcctgtgtcttgtgattctctatacatttcaggattattttttctatttctctgatgaatgtcattggtatattgatagggattgcattgaatatatggattagtttgggtagtatggacttttaaacaatattgatacttctaatccatgaacattgaatatctccgttttttgtgtcttcttcagttacttgcatcaatgttttacagttttccttgtacagatctttcacttctttggttaagtttattctctgttattttattttatttgtagctgttgtaaatgggattactttcttgattcctttttcagattgtttgctgttggtatatacatatgctgctgaattttgtatgttgacttttttgtcttgcaactttactgaatttgtttatcagttctaatagttttcttgtggactcattaggtttttccaaatatgagatcatataagctgaaaacgaggataatttaactaattccttagaatttggatgaccctttatatatttctcttgtctgattgctctagctagcacttccagtacaatgttgaatacaagtggtgaaagtgggcatccttgtcatattccagatcttaaaggaagggctttagatttttctcattcaatttgatactagctgtggatttgtcatatatggcttgtattgtattgcagtatattttatctatccccagttttttgatggtttttgtcatgaagggatgttgaattttatcaaacactttttaggcatctattgaaatgatcatattgattttgcccttcattctgtttatatgatgtatcacatcgatttgcaaatgttgaatcatccttgcatctctgggataaacccatttggtcatgataaatgattttttaatatattgttgaatttactagtattttattgaggatttttgcatcagtgttcaacagggatattggcctgtagttttatttatttattgtttgacgtgtctttttttttttttttaataacagtgtaatatccttcaaacatgaataagaaagactttccagaaaaaaagactttccgtctctatgttatcttgaatttcatttagcttcctcaaaacagccagtttgaattctctgtctcccccagattggtttctgatgccttatttagttcatttggtgaagtcatgttttactcttgatgctcgtggatgttcactgatttctgggcattgaagagttaggtatttattgtagtgttcacagtttatgcttgtttgtacccattcttctggaaaaggctttccaaatagtcaaatagaattgcatgttataatctaagtctttggtcatcactgtaattgtgtctgcattgggggaaccccaagcccagtaatgctgtgactcttgcacacttgtagagataccactttggtggtcttgaatgaaatccaggtgaactgcctggtttaccaggcggggaatcttgttcttttcccttactttcccctcaacaagcagagtctctcttttcatgctgatttgcctggagctaggggaggagtgacacaagcatctttgtggccaccaccactaggactgctctgggtcatacctaaagccaacacagtattgggtctctcctaaggcccatggcgaccactgcctggctactactgatggtcatttaaggcccaagggttctttagttagcaggtggtgaatccatgcaggctggtgtcctttccttcagggtagggagttccagctggcccagggtgggtccagaaatgccgtttggggaccaaggcctgagtcacaaaccttaggaatctacttggtgctttattctgctgcttctgaactgacagccaacctgaaagacaatggctttcccactctttcctctcctttcttcaagcaggaggagtctttcctcatggccaccactactccaggcctgtggggtactacttggctactgctgatgttcactcaaggcccagtgctcttcagtcagcttgtagtaaacactgtcaggcctgagtctctctcttcactgaagtgggctcccctgtggcacagtgcaagtccagaaatgccattcagtagctaaggcctggaatcaggaaccccatgagcctgcttagtactctacacaactgtggctgagctgctactcaagcttcaatataaagtcccctttactcttccctcttctttcctcaaacagaaggagcctttccccatagccaccgcagctgggaatgtgctgggtcacacctgaagccagcagggtactaggtctcccccaaggcctgcaatgagtattgccttcatctgctgatgtttactcaaagcccaagggctctttattcagctggtgatgaatccttccaaaaacggtccttcccttaggagtagcagctttcctttttgttcagggtgtgtctagaagtatcatccaggcgctgggacctgggatgggggcctctggactctgcctggtgtcctattcaaatgtggctgagctggtatccaagttccaagacgaaatcctgtttactctcccctatcctctcttcaagtagaaggaaggagactctcccagagctgcaagctgtactgcatggggttgggggagggtgacacaaggactccctcagtcacccaaggcagtgcctcactatgtcatgtacacctcaagtccactggctctgggcccagcacagcactaagctgtgctcaggaattgcagtccttgcggcctagaccgcctttcaagtttatgtaggttgccagagtgctttagcctgcaatggcggtgcttgccagaacttaggttccgactgctgggatggatgattcccctctggctaggtctcatctaagtgcttcctctgtgggtgccagctgaattttgccctgtgttgctttctgctggaacagacacactgagttccaatgccaagtcccacaatcattgcaagcacacagattctctccccacctgctgctggggagttggggaggggtggcattagcaattcaagactgtctttccacccccttcagtgcctctgtcctcaatataatgttacaaccaggtactgtgattgatcacctgatttttgtatcttatggaggtgctttcttatgtagataggtgttcctgtggggaggatgaatactgaagggttctattcagccatcttgctctacctacctttcctaaaatcatattttaatttatcaaatcagtaattagtttgtcaccttccttaaaagataacatacacatatttaatgaaaattaaaagagagcaagcaagaacagaaataagaataaataaaaaagaagaacctagaatgaggccaataatgcatatcatatactttacacagtgggatcatggatttaactttcagttttctataaacccacgtcaaaattgttacacaattcacgatgtccgtaaatttaaaacaaccagttattctttgagataatacgttgttctcagttttcttcagtagtaatatcagagtagaaattttccaagtggagcggctattccagacactgtgtgacataatacaattattctcagcaacatcctttcaggcgattccacagtggttttcatggactgttttttttgcgtgtagtctctgatggccacacagcaaaagatggtccagccaaagcaattttataagtttgtagagtgtaacagaggcatttcctcactgactggatcaaggagtatgtgtatatttgggatttgaagtagcttttttatttctgaaacaatgttctcttaaatggcgttaaacataacctaacaatgcattcggaattctgctgttttccttgcgcctatggtaaattctaatgtcagttaaagtcagaccacaggacttaaaagataatccaaatgagattataggtgtcatatatttaggtcaaaaatagagagcctagaaaggacaacagcttaatttgaagctatcctgacctcctttggaggtcaattaaatagaatagagatagggtaattttatattatttaattttcacatatatcagttttggtggtttaaataacttctaatatatttgaaaaatgaatagcaaattaaataaagcattttctaataatacaaatttttccaaaagggaaattaatataatatatagatagatagatataatttgataggtctctctgaagtcaactgtatttcctactggatatgtgagaaaatgctcatatgaaaatttagcaccccttaatccctataatgctgtagaaaattcgaatatttaaaaatagaagattacttgctgtcgttgatcacatgggaatggaattcaacaattcaaatgttagtattcttacttttatactatgaaggctaaatagagtaggaaaatgcatatttatatccaagattattatgtctttatgatagcagtatatcttctatgtttcatttacacaggattatgtacctcttcatttttaatatttactgagccctatgtaagtgggcaccccatctgcagttttcctagaggtttctttctgttcctgggccaccaaaccggatttgtgttttcattatcagggttgataagatccttgggacatttcacaaatttccttatagggtatgtaaattatttcaacctgagtgtagctttgtgatcgaaggagtttatgacagaaaatagtaaaatgtaactattcaaaacagaaagggtcaaacttaactggaagcagtatccatggagatgatgggggagatgtgaagaagatagatgtgccttttacagtggaagaatgtgctacaagtgtcatgagtattcatctgtctagaacagagtagataatagttcccttcttcatttatgtcataccctacttgagtctgtctggaatgagaccctgtctggaatacaataaaccagagtgagactatgtgaatcacaacatacgatgactgattgaaggtgctagcatgttgagcctagagaagaaaagcttttcactattttctacaagaactttccgagctttcatataaaatgtactttaggttttccatgccattgcagagaagagtactagggtccatggatgaaagtgtagtgaggaagactaactcattgtgaggaagaactctctgtgattgattctggaattgtctgcctcaagaagtggtttgttctccatcactggaagtatctagacataggatatatttgtcaggaatattgcatagagagattttatcagagtagcttgacagactacgttctttttatccttgcatttcctttggaccttatgatagattttgttgttgtatctgagattgtttggtatagttttagagactggaattggtgtgccatgtgagaagataatagcaggcatatgagacttcacaaggaagttttgttgactaatgggaattaaggattatattccatgtcttcatagtgaaaggaatattactaatggtggatcctacatgctatgaaagtgtaccgcaaaattattctattaaattctcagtttcctttaaattaataattcttggaggataaataatggcaatgtgtacaggtaaccatcattatttaaaacaccttttgtgtgtgggcaacaaacatttaactaggtaaatatgaaaacactaaatgttgaccttaccaaaaattcagagaatcctatatcaatgaattaaaaatttctcaaaatactaaagatgtggcaataaaaaaagtcttgacattttcccattttcaatattaaattataatcaatttgttattatagggctaaagatttcagtacacatttctgggcatctgattttattttatttatgaaatgctactactatttaaattttctcagcttttttttggtttgtttacatttttgaatttgtttaactgacataagtatcattttgtttttctaactgtgaagtgtacagatagtcttgaacaagtgctatctactagaagattattaagaataatacattgcatcataatggttatggaatctctcttaggttgcttgtgtgtgtgaatgtatatatgtagctataaatgtgtgttaaatatgtattagacatattagacttatttctacatacatttaatattgaagacaaaggaaaacaatctcctaaatgcctgatactttcataatttattaaggaatgatttatttatgatataagaataatgtctgttgggccaataagtggcatatttatttaaaattatgtgtataatgtttatcatatgaaataataggtaatgaatgctttatgtactaaatacaatagtataaaatatattagcaagtttgatttagctgtagatttggctataacaatttttaaacaactcaaacaaatgtataaattcttaaaatgtgagtaaattttgaaggacagattctagttaatttataagttatgtgtctataattgactaagatgttcgtatttgaatcatgtgggtcttataccaattaaagagaaattttactttaaattgtaagattctttaaattcaaaataaatattcggtgcactgaacttgggctatgactagcatttcaccgacgaatgattggaaaaaaaatgattcatttatatttctctaggaatgcttatttttagtttttgttttgagacagattctcgccctgtagcccagcctggagtgcagtggcacaattttggctcattgcaacctcccccacccaggttcaagcgattctcatgtcttggcctcccatgaagctgggattacaggcatgcctcaaatagcccagctaatttttgtagacagggttttgccttgttccccaggctggtctcaaactcctggcctcaagtgatctgcctgccttggccttccaaagtgctgggattacaggcgtgagctactgggcccagctgactgcttaaaggactattattaaatgtttgagtggttctggaatcaacgtctttaatatgctgatatttgattattcatatgtccttttctgtttaacctcaaaggtttcactaacaaaatcaatatacagaaggtattactcagacatgaaaacacatttaatacttccttctttctatattacatctacatggcaacttgtggatattgaggctccaataaattggattgcttcggctcaaggtaaaccaccactttaagaattaatacctaaagaaaacaaaattgcttagatgttttgttgcttattaaaatgatttatatctcagtattagtttcagatccatacagtctttctttgaactctttttactagcatttttttcttgagccaagattacatgcattttttaaagttcatttttctgattttattcattggactttagctgggcttagtgtgccacaataaataatctccaagagtatttaaggctgttaagtatttcctaagactatttatgactttccatcgttggtattgtagttattttatacgtacatatgccagaaataacataaaaatgtatgccaataaatttcatgaatatctcacctttttttttcctcttaatatcaggatacaatttatctgctggtttgtgcttctaaacactaaaccaactatgtcacacaaagcttactttaaaaaaagaaagcagagggacagtatgatgtatttgtcattaaaagaaaaataggctgccaggaatctcggagcacatatactcagatgcaatgattgattatcatcttatcgcatatttttttttgtgctcccataatccctgtcctttatcttaatatctaacaccaattttcttgtcattttctttgtttttatttaatagtgtatatgtgatgaggcatctaaagtcaatattggcattatactgtaaggattctattaatttttataaaataatattcatttggcagtttaccttctgtgtgtgtgtgtgtgtgtgtgtgtgtgtgtttctatactagtattttagccatgggcacatgttcgtgctgtttttcccaactcttcgttggctaccatggaatctatttaactagtgtcttcttttaactgaagaatcccagtcgttctaggagaaagttgtatttttgaattctcttctttgatctgatataaccctcaagaagaaaatctgtagatacatgaatgcttattcttttaccaatgtcccctgtgcatctattcatgtaatatcccatgaaacaatatcaacatttggttttctagattattgccagcactgtgagatagttacagtatatcctgccttctctccaacactggtgtcttgcatttcatgcgcgtccctgtgaagagaccaccaaacaggatttgtgtgagcaacatggctgtttatttcacctgggggcaggtgggctgagtccgaaaagagagtcagcgaagggagataagggtggggccgttttacaggatttgggtaggtaaaggaaaattacagtcaaagggggcttgttctctggcgggcaggagtgggggttgcaagttgctcagtgggggtgctttttgagccaggatgagccaggaaaaggactttcacaaggtaatgtcatcacttaaggcaaggaccggccatttacacttcttttgtggtggaatatcatcagttaaggtggggcagggcatattcacttcttttgtgattcttcagttacttcaggccatctgggcgtatatgtgcaagtcacaggggttgcaatggcttggcttgggctcagaggcctgacattcccgccttcttatattaataagaaaaataaaacaaaataatgttaaagtgttggggtggtgaaaatttttagggggtggtatggagagagaatgggcgatgtttctcagggctgcttcaagcgggattaggggcggcgtgggaacctagagtgggagagattaagctgaagggaggtcttgtggtaaggggtgatattgtggggatgtaagaagaaacatttgtcgtatagaatgattggtgatggcctggatacggttttgtgcgaattgaaaaactaaatggaataacagaaggagaaaaacaggcataaaaggtttaagaattgggatgactcaggacatctgatgagagagtgcctaaggagattcagcatagtcctgccagcaaagattatttatttacttcaagagttaagagtggcagtttggggatagcaccaggagatatcagctgtgatggcttggagaaacagtgtaaaccggcagtgtaaacaagagcagggcatgtatgagtagttgagaacggtgaataggagtatgactagacagaagatagtagggatgacaagttttttgggggcacagtctaagttggtctggtgtcaaatgagactggggcctaataaaaaggagcatctgtacaggagcttaaatgggctgtaccctgtagcattccgaggacaggcctgaattctgagaaacgaaagtggtaaaagtattgtccagtcctttttaagttggtggctgagcttggtgaggtgtgtttttaaaagacctttagtccgttctacttttcttgaagacggaggaccttaagggatataaaggtttcactgaatactaagagcctgaaaaactgcttggctgatttgactaataaaggctggtctattatcagactgtattgaggtgggaaggctaaactgaggaattatgtctgacagaagggaagaaatgactgcggtggccttctcagaccctgtaggaaaggcctctacctatccagtgaaagtgtctacctagactaagaggtatttcagttatctgactcagggcatgttgagtaaagctaatttgccagtcctgggtggggcaaatcctcgagcttgatgtgtagggaagggagggggcctgaataatccctgaggagtagtagaatagcagatggaacactgagaagttatttccttgaggatagatttccacgatggaaaggaaatggaggttctgagaggcgggctagtggcttgtactatagcataacctgcctttgctggtgtgtggtgattaggcctggtggaaccgccatcaataaatcaagcgtgatcagggtgaggaacaggaaagaaggaaatttggggaaatggggtgaatgtcaggtggatcagagagatacagttatgggggtcaagtgtggtatcaggaataatgtgggaggctgaagtctgggccaggaacaacggtaattgtgggagactcaataaagagtgagtatagctgaaggagccgggaagcagaaagtatatgaatcaggtatgaggaagaaaatagattttggaagttatgagaactgtagagagtgagttgagcatagtttgtgattttgagggcctctaaaagtattaaagcagcggcagccgctgcatgcagacatgagggctaggctaaaacagtaaggtcaagttgtttggacagaaaggctacagggtgcggtcctggctcttgtgtaagaattctgaccgcactaaccatgcctaggaaggaaaggagttgttgttttatagaaggtgtttgggtttgagagatcggtcggacaagattggcagggagagcacgtgtgtttttatgagaattatgccgagataggtaacagatgaggaagaaatttgggcttgattgaagtaatgggggctgtctgtgaagctttgcagcagtacagcctaggtaatttgtggagcttgatgggtgtcagggtcagtccaagtgaaagcgaagagaggctgggattaaggggcaaaggaatagtaaagaaagcatgtttgagatatagaacagaataatggatagtagaggcaggtattgaggataggagagtatatgggtttggcaccacggggtggataggcaaaacaattttgttgataaggcgcagatcctgagctaacttgtaaggctcgtctggttttaggacaggtaaaatgggggaattgtaaggagagtttataggctttgaaaggccatgctgtagcaggcgagtgataacaggctttaatctttttaaagcgtgctgagggatgggatattggcattgagtggggtaagggtgattaggttttaatgagatggtaaggggtgcatgatcggtcgccaaggagggagtagaggtatcttatacttgtgggttaaggtggggggatacaagaggaggacgcaaaggaggctttggattgggaagaagggaggcaatgagatacagctgtagtccaggaatagtcagggaagcagataatttagttaaagtgtctcagcctaataagggaactgggcaggtggggataactaaaaaggagtgcttaaaagagtattgtctaagttggcaccagagttggggagttgtaagaggtttagaagcctggccgtcaatacccacaacagttatggaggcaagggaaacaggcccttgaaaagaaggtaatgtggagtgggtgcctccatattgattaagaaggggacgggcttaccttccactgtgagagttacctgaagcttggcgtccgtgatggtctagggggcttccgaggcgatcgggcggtgttagttttcagccgctaagccgagaagatctgggaaggagtcagacagccttgcgccagagttccaggggctctgagagtggctcccaggtgagttgaacagtccgattttcagtggggtcctacacagatgggacacggcttaggaggaattccgggctgcgggcattccttggcccggtggccagatttccggcaagtgtagcaagctccttggggaggaggttctggaggaacgcctggccgctgcggttcaggcgtttggaagttcttgtgtgctggagatgtggctggggtttgtctcacagtggaggcaaggaattgcaacttttttctattattgtacaccttgaaggcgaggttaattaaatcctgttgtggggtttgagggccggaatttaattgttggagttttatttaatgttgggagcagattgggtaataaaatgtatattgagaataagatggccttttgaccttttagggtctagggctgtaaagtgtctcggttgctggcaaacaagtcatgaactgggctggatttttatatttgatgaaaaagagcctaaacgctatctgatttgggataaagaaaaaggagcattaaccttgactatgcctttagctccagccacctttttaagagtaaattgttgggcaggagggggagggctagtcatggaaggaaactgtaagccggaccaggtgtgaggaggggaggtgataaaaagattatagggtggaggagcggaggctgaggaagaattgggacctagctcggcctggcgaggagcagcctggggaggaagggagaggtcagatgggtctgtagaaaaggaagattagaaagactcagcgaggcttggggttggtactgaggggacaggcaggagggaaagaaggaagatttgggacgagttgcactgggcacagagactaggaagggactgatgtgtaaaagaatgcctggacgtcaggcacctcagaccgtttgcctattttatgacaagaattatttagatcttgcaggatggaaaaattcaaagtgccattttctggctatttggaactactgtggagtttgtattggggtcaagtggcattgcagaagaaaataaggcatttaggttttaggtcaggtgtgagttgaattggttttaagtttttgagaacacaggccaagggagtagaaggaggaatggagggtggaaggttgcccatagtgaaggaaggaagcctagagaaaagagagagtagagaaacggagggaaggggtttgggggttcttaccttccagaaaagtgggaaaaggggttggggcacagagataagaggtcgggacgtggaaataagtgattggggcacagagatacgaggttggggtacttgcctctcctctagaaaagcgggacttgccgctaagagtgaaggagaaggggttggagtacttgccctgtgcccggaaaagctgagaaggggtagagacaaggagagaaggggttggggtacttgccccttccccagaaaagcaggacttgccgctaagggtgaaggaccaaggcaggcgtccctgcgtggtatgacacctttgaaacgtgggttgaataatcagagaggcgtccctgcaatgattaaacaccaagggaaggctgcctttccagtctgtgaccggcaccagagttttgggtccacagataaaatgtatctcctttgtctctcccagaaaatggaaggaattgaaattaagagatgggagagattgaagagtggaaaggagaaagtggttgagggacagtgagagagattggagaagagagtcagaagaggccgcttaactgatttaaaattggtgagatgttccttgggctggtcagtctgaggacctgaggtcataggtggatctttctcacggagcaaagaacaggaggacaggggattgatctcccaagggaggtcccccgatccgagtcatggcaccaaaattcatgcgcgtctgtgtgaagagaccaccaaacaggctttgtgtgagcgacacatctgcttatttcacctgggtgcaggcaggctgagtccgtaaagagagtcagtgaagggagataagggtggggccgttttataggatttgggtaggtaaacgaaaattacagtcaaagggggtttgttctctggcgggcaggagtgggggtcacaaggtgctcagtgggggtgcttttggcgccaggatgagccaggaaaaggactttcacaaggtaatgtcatcacttaaggcaaggactggccatttacacttcttttgtggtggaatgtcatcagttaaggtggggcagggcatattcacttcttttgtgattcttcagttactttaggccatctgggagtataggtgcaagtcacaggggttgcaatggcttggcttgggctcagaggcctgacatttcgtactatggatataatgtaaaaagggggcgtttgtcttctctttttaaatatccgtacagaagtctctgctgcaacataataaatgacaaatgccagaatatatcctaaaaatttagcacatgtggacagtgggtttacttagatgtttatttttgcccttacatatttttggaggattgatacatttttggtatcacttttggtatttaaacaaataggtaaatattttctcaaaaagtgaagacttttttttcagacaaatctatgagaaattattggcttaacaaatcacaagttttgtcacgtatgccatatttgtttgtttgtttgtgaaaggattttgggtattaggcaactgtagcagacatcatgtatctggactttagcgagtcatgatcactcatcatctagtaaaaatatttaatatttatataaggcttattatgtgctagatactcttcaaattatttcacatctcttaactcatttgatcttgttaacagtgctacaaagtagatgatttgatttttgcccttgtattgatgagtaaaattagtctagcaagtagcagatgggtaatttgagtcccagactctcttgccctagaattagttttataatcacaatgtcgtgctgctaaacaattgagatgcatcattcctgacaatctttgccttcacccttcaagtaccatatcagcatataaaagtgaaggatgatgccttccagtgaaggttcaaggcttttgcctgaagtttatattatttgtttgaaatctttttcagccatggagatattgaaggagattttattaaactttcatgttgtatacagctgaaagagtgttttaaaaagtgatatgtaaaatgacagttttggtattcaaaaggagcaatggtggaaatccaacaataaatatggcagggataaatgtaaggtgctacccttgaatccaataacccatgaaacaagtagagcataggagagagctgatttaggaacaagccatgggaagaggtctaagggattatgatacagactagccccatcgtggtgtggttccccaaataacaaattctatcttaggtaggctgcatttctatgttgtaatttatttattgaataatcttaccttggttagtgcgtaattctaaactttttccaattaacatttttagctctgctattgttaatcatttcccatgctttaatgtcactgtgaacacatttttaattttttctaatgttttgttactaaaatcagtataaaactcttatctcatattttttgtttgtttgttttgagacagagtctccctctgtagcccaggctggagtgcagtggcactgatttcggctcactgcaacctctgcttcccgggttcaagcgattctcatgcctcaagctctggagtagctgggactacagggttacgtcaccatgccctgtctaatttttgtatttttagtagagacggggtttcactatgttggccaggatgatctcgaactcctgacctcaagtgatcaggccacctcaacttcccaaagtgctgggattacaggcctgagcctccacacctggctttatcccatatttgatttaaattgtatgttcttacctcttcttggtacccaaattgagaccctaacaaattggagtggcaaagaactaccacaaggtctgactctgagataaatgtctcttctttctctttgatatatagttgctccagtatgttaggtcagagaagagagagcagaaagtgttaagtgtatctttattcaacatttactaatactatcatttatttgctttctctgctttgcagacttctgtgtggctctcctatgaggctcattcatggattctttagaggacctattgtaaagttctctgatatgggagattcaatctgaatccaagctagctagcctccattagagtgaaccccaagctgtacacactgttggaacttgtttttgaggtctccttagttactatccagtggctctagctccactacattttgtatatttacttgactcatggagaacttacatagagttacttctaagtctacagcctgttctattgcaacaccttgcatagattggtggaccacttgggtgaaatgcagagaatatcatgcaaagaatatctgctctgcatgaatgattaacagcagaagttctcaagttttacctgataaccttcgaagtaacaccaattccttgatttgctcctgcaccatccctttttggattctgtccaacagatctgctataaagcctgatgattttgtttgtttaaagcacttcagctagtcagcaagggttcagaaacactaaattagattaccttactcagaatcctatgattctatgtatttttatcctctttaaaagtacttttataactgtgatattactttaatattttaaaacaaccataaataagattgcagatagtaatgcattgggtttgcaaaaataactttagataaaatatattccagtttgtatttatgtgataatacattacctcaagacctcaaaaatagatttgctttgtttatatggtttccttctataagtgaaaaaaactagtccaatgaaataaagggttaagaccccttagaggaaaaggaagataaaattatcttcagaaatggctatggtaacacctcccaaggcaaactattggcagaccttctaagggcagattgtgtgcatctatgtaagtgaaaaacagctgaagggtgtcaagtgctctgagtcacactagagtccctttagatttatttcccaaaccaagtagtagttgccttttccaccagcccacacagttctattattttcctatctttgctttatgaatagctggctcttacagtacttaacttcttatcttagtccacttgggctgctagaacaaaatatcataaactcgatagcttataaacaacagaaatttatttttcacagttttggatgctgagaagtccaaaatcacagtgcttgcagattccaaatctggtgagggcttgtcctttggttcacagacagtaccttctagctgtgtctgctcatgttggaagaagcaagctaacattctgagttctcttttataaaaggactaattccagtgatgagggctctgcccttgtgacctaataaccttccaaaggccccacctcctaataccatcaccttatgggttagaatttcaaagcagaaatttggggtggaggaggatcaaaaattcaaatattctgaacccttgctgactagctgaagtgctttaaacaaataaacaaaaacaaacatatcacttatgttgaaaactagtcaaataataaggcatttctaacataagacctcatgatcaagtaaacttacatgaaatgaccagtgcaaagacatgcttgggtaaagcttttctgtagagtagtagtattgatttttattttatgtatgtatgtatgtatgtatgtatgtatgtatgtatgtatgtatgtattttgagacagtctcactctgtcacccaggctgcctaggctggagtgcagtggtaccatctcggctcactgcaacctctacctctcgggttcaagtgattctcctgtctcagcctcctgaatagccgggactataggtacatgccaccatgcccatctaacttttagtagagatggggtttcactatcttggccaggctggtcttgaactcctaacctcaagtgatcctcctacttcggcctcccaaagtgctggaattacaggcatgagccaccatacccagcccgagtagtattgatttttaaagtaaattttttcatcacatccctaccaaattatatacaaattaagtaactagcccagttaggaaaatagtacacaagtactaaatccatattaagatcaacatctaaaaaaataaacatttacataaatggaagagacattttttactacatttatttgattttaataatttaattttatggaatttatgaaaattttatttttaggaattcatgaaaaattccaaaaatttcaattattaaaatcaaataaatgaggtaaaaattatgtaagatatatttgggtaaaaagcataaacacatttaaatattttattaaaacattttaattaacaggaacatgttttaaaggaactaatacataaaaatcaatttcaatctcattattcctcacaatcacttccagtattctggagcctcaggttttcatccttgatatttatttataaagattattatagtcatattgctcatgtaatagataatccctctccacaactaatattttattatgatattttctacattattacctatttctcataaatataactagaaattatcgtgcaatattttattgggtaacatgatttagttagctatttctcccataattatacattatatatggcttactcttgggttttgctcctacatataggactgctttagatctccatgtcactaaggttttaccatatttggattatttccttaggataatttttcagaagtgggattattaaagagactcaacatttttaagtttttgttttgtaatgcaaagttgatttccataacttacagtgctgccagcaagatagggaaacatccagtacacagccttactttttccttgaatttggagctcatcttttatagtttgtataaaatatgatagttgaaaataatatttcatggtcagatccatgtgaaatacaaattattgtattagtggagatgagttgaaaatttttttccatgtgtgggaaatacatttgcctttctcctctaaaatatgtctttttggaaaataggaacttcagtattttgtgatcatttgtatacactcttcatataataataactctgtcataactgcaaaaatattcatatttattcttaattttactaattatactcaagtttttacttgtaatataatcaaatatgtctatcttttcttactgatatatatatatatatatatatatatatatatataacacttaagccaaattcatttatatttcagaacagtcaggaatctctagaagcttcattaactctttcctaccattatatttaatttttaagtcatggctttagagcaccagaggttagtatgagtaatttagtcagtgagaaaagttggctccttctggaaaagcacctttatcaaagcaattccatcaaagctggctttgaatttcagagaaagcaattagattaaaagaaaattaggatcttggctcacagtaagagcatgtaaaacataattcatcttgattcagcgttttaatattctatcatgggtatcaaatatgtcagatatgaaaagtaatttcagctttgttttcaactttgctaagtttggtcactgttccttagaagcaaaagtttagctctgatcatgttggaaaataaagtagttttagtcattaaaaacaaaaattttatcaataatagtgtgatattataataatgtcatattttcatcttctggtgtacctatcttgtgcctgatgtataataggtgcagaatttataatagtagaatgaatagatgaatttcctgaagtagaatgcagtgaggcattaagcatgtcctcataatgcctttaggattgccaaaagtcttgcttaggggttgaaaaagaagtagaaatcaaatgataagacctcgaaggaacagagaaatccaactcaatgaacagtaaaaatcaatgaaggcaaaaaaggtccatttttatctcattcatcttcagagatagaccagtgtaagttcattgatttacagtgctcattgagttgtattctcctgttctttgttgtgctccattctctgttttttcagcttcactttgtgttttattttaaattgtatttgttatgaggtgggctttgatggcatagttttagcacaatgagactattttttttcacttgatttttctactcatatgatatcatcacttttcaatattcttaatggtacttttctgaataacctcctttaaatctctctctttctttatgttgatctgtgtcaatcaagtttttatgtgtaaaagtgtgttaataaatttaaatttaaaaataaattttaatttaatttaatttttaaatatttattttaataaatttaaataaatttaatttttaaataagtttaaataaatattcaaataaaataaaaataaaataatatttaaataaatttaaattaaaataaatttaatttaaatttattatagtgaccatacaaaacaaatagttgtttctattcagttcactcataaagaaatgttatttaacaaatatattcagcacctttcaatgcaatgcacttttgcagttgtcaagcaccataattcacttaggttctgccccaggcctttaattataagttcttatttatgggaattagagagtagaacttgaactgaagagactagcctgaccgtggagctgacaaagaaagaatgtacattggttctgagtacagtgcccacagataattggagaatacgtgtttgaatcagactgatgaattctgggtggaacatgaaagccggtaattctaaatattagtgatattaattaaatcatcataatttgtctagaatcacgctcaatttagaaaggattcatctaagggaatgaagacagaatagctgaagccaatattttgaaagataaaacagagtaagaaaaattatttgaccactaggcatttacatttttttatagtatataaatcacttacaacatgcagatacacgcatacaatagaatttcaatgaggtacaatcacttcccacattttaatgaatgtgctcagggtagaagtaataaattattttaatatatagaatttgataaactcataatagaagtagaagcaaatcctttgagtgctacaaagaaaggaaacccatttcaccaatgatatgcatgagtgcttcattgtggagttcatctttggtttcaggcttaaattatgacacattgacaatttggaacattcagattaagaaaacattgagcaataattcaggaaaattaggcagaagggtatgttcacaaaataatcctgtattgtccaaatatcaaaagagcctaagtattcatctcaaattgagcctagaaaattagactttgggagggtcacaagataagatgtttgtaatatagccagataagcactaaaacaaatccaggattaggctgtcttgtgatttggctttctccactgtaaaccatgtttttctatgaatgtgagactctgctggcattgttgaatcactacatagtcatccattcattcatcatttaatttattatccattcaggattgcaaaaagccaaggatgtataagtgtaaaagacaggtaaagcagtgtcatggcatacatcattgtggaaagctaccattatatacttggctattgaacacagatgccctaacagtgaaagttttaataaaaataatattatgccacataaatgttctttatagtatatatggaaatgttctctattattaatgtcaacattgcctttctgtcatgctttggttagcaaatttagcaagggtaaatctgtttagatttttttttttttttttagacagagtctcacttggtcacacaggctggagtgcagtggcacgatcttggctcactgtaacctctgcctcctaagttcaagcaattctcctgcctcagcctcctgagtagctgggattacaggcatgccactgcaccctgctgatttttgtattcttagtagagatggggtttcaccatgttggccatgactggccaggctggtcttgaactcctgacctcaggtgatccacccactttggcctctcaaattgctgggaatacaggggtgagccaaggtgcccggccctctttaggtttttaatgtaagttttttatgaagttttctgtgctattttaagcatgaaagtgagactaatacatataataacaatttgtgagaacttgtatttggaagtacttaataatagtttgtgaattgttacctgcccgttcatgagtagatagcaaatatatatgatacatgtatatataatatatgtttaccatatatatatatttaccatatatatatatttaccatatatatttttttaccatatatatatatttaccatatatatatatgtatgtttctatatatgatacatagagatagactgacaggtgtgtgtgtgtgtgtgtgtgtgcatacacttatgcatttgttagtctatgtatccatgtaacttatgtatgattttctacttatgaatatgtggcatttgtgtgggtgtgtgtgtgggggtgtatacatgcattaaatcatgtcctctaaagagcaaataccatgtcagaatttatcatgcaagagatttattgggaaaatgcctgtgaaagaagaaggagagggaaataaaggaggcaggaagaaccatcaaacattgaagcagttctgatccctgggaaaggaggggagagaaggaaggagagttggactgacagaatcttggatgaagcatagtttttaaaatattttggccaggccaacagggagtcattgtgccaaagttgcctgtcagaggagtattacatcttttagaaatggacctgtcttgctaatgctatcttgctcagtcattagcagagaatgggttcatacagagtatggcctcacgtatgtatattcacatatgtatatgtattcatatacatatatgcatacataagtatcaaaaaccgatgtatatttattgcaccaaatgatttttaatgtacatgttgaaacatattcgttgtgttactcttatgcatataaagttatttgtaaagacatggatttctttcatttatgttttaaaatttccatgtactatattagaggacataaaaagatgcgtaatattacctaggagtgcacattgttgaagagagttacctagtgtttgtgaaaggcttttatcatccagaaattaaattttacggcttaccttttaattttcctctcaaatattgattgattttttttacaagtagaaaacatttaagctatgtttgagattttttaaatataatgtataacttaataaagctaaattatactgtccttaaaaacttaagaccactgactgtttctttcttactgaaatcaaaatagtgattatggctcaaagacaatattacaaaactgaatatgattgcaaatatgtgtgcactaaaccacagcatgcacactttggccacagccaaaacataattagatttctccaaaaatgcctcttagtgtttaaataaacagtactatgtcataatagtacatgacatatagataatttacttttttagagaaatataaataataatgacacattgttttctctgctattacttacaaaatttgagtgtctaagtcataaatgtgtttttctttcccacattaaaacaatgacaaaataattagatttgtatgttttttccacttattggacacctggcttcaaattctattaattattcattacctgatcagcaaagaatacagagaaaagtacttaactatatgaaaatgagcattatgcataaggataaatttggctagtatcttacaagtttccttatataaattttttcaactttaaaaatcttgtgattctccatataaatacagttttattgatcaaatgaagcataaatataactaaaattaatacatttattaacctctgaaaaatgttaggtgaatgctatgtatatacaaacacagtggttgctatatggcatggaacattcccatcaaatctgcatccctggtggctcacgcctgtaatcccagcactttgggaggccgagatcggcagatcacgaggtcaggagatccagaccatcctggctaacacggtgaaaccccgcctctaccaaaaatacaaaatattagccgggcgtgttggcaggcgcctgtagtcccagctattctggaggctgaggcaggagaatggcgcgaacccaggaggcagagcttgcattgagccgagatcgcaccactgcactccagcctgggggacagagcgagactccgtctcaaaagaaaaaaagaaaaatctgcacccctgcaatgtctctggattactttccgattattcacatattatgttgtcccaaaaactcagataaaaccaaactagagtatttaaaaaaaattatttctaagaggttgattttaaactgttttcctacttggttaagattctactgtatgtctagctgtaaatgttttacaacttcatgattatggaatgaaaattagtgctacttttatatagcaccgctgtaaatttctattcattaaaactactttaaaatagaaaaatcctaatagagcccatatctttgaaaggcactagaatttatgtgaaataaaaaggatacttctaattttatttatttttcatttggagtaatgttttaatgcatctattgagcaagtattttttgaggtttgtggccaaaatactactcagttactaagtgccgggtggacaacagagacatttccgtgttcttgtgaaacttatattccaggattcttatattcagagaaaatcttattttctaatactctgtataccccaaacgacccaccagagtatcaattatgtgaattacaactgggaagaatgtgagaaggagaagtacaccatcaggagaggatataacgtgaacctagtgttgggcctggggagaggtccttgaggaagtggtactggagcagatgtcagaagaatgaggtgtgagcgagagggaaaccgcacaggaagagcgttctggtgagcaggaatagaaacatggaagaatgctctgaaatggagaggagcatgtgctcaaggaaatgagggagaccattgtgtctaggtagggtttggaaagcagtaccggagtggtgggcagtgaggcacgagagaggggaagagtttctaaatgcatcctcatgtaactcaagaatacacctgagatgaattttgttatgcttgtggaggggcagtgcctaataaagtttaggtcacactttgatactagaatgcaatagtaaattgtatgatcttattgctgcctgcgatttgattgattaattacagtgatttttctcttttacaaaagacaaactgctgccacttgttgcattttttaaatgagcagtttgcaaagattgtatcttttatgtaggttgcttatttcatatatttggaaacgggttatatcagttggtggacgatatgtcaaaaatttagaactttctcccatctttccaagttgctaaattatatttcagtgaaaagctttctctctaaagtgctaaaggtatttctcaatggaagcaataaaatgaacttttttggcagctttcccagaaaaaaaaaaatccctctagcatttttggaaatgagtaggggaaaattataaataatgtaaaataaactcacataagaggcttatatgaactattatacaatatatattaggaactaaattttcttccattattcctttaggatcttgtggctctagtagaatgggaaaatgcactcccatgagaaatttgacaataacagccaattctgcacggaaaaaaatattgaatggtttatatataagtttaaaatctattttaaaagtaagacttgatacgtgagagactagtcaagtttggtgattaggaagtctctttttctactaaattcaaacctacagtgttggtgttcactgaatacactaggtagtgtagaggatgcagaactcaggggaaaaggtctcaataccaacctacataatgaaaaagaaaagatatgtgtgaggtgtggctttaaaacaaaagatctaatctaaaaagatctaatctatgtatcacttttgggatctatatgatatgacagttatgccttatgtttggaataataagcaatatgtaaattacagcaatatacaagctactgtatattagtagggaacacaggttccatttctccttacttcttcctggcatgctatgataacaacttaactatgttatgataacaactactagtcatcctgcttcctgtatccctttcttgtgtaccttagacacacgtgcatttttcttcttaaataacaggtatgttatgaaatatttgtgcctaaaattcttaaatatttatctttctctttacacacactctcacacacatttatttatatgtgtatgtgtatatttctgtctccaacttatcttctaggcttattttcgacattccttacaactggcatgagcttcttgttatagtttctagatattctaggttttcttaccttgaggtcacttttttggtcactttattttttctgtttgtaattttttgttctctatttttactatcctctatcacctcagtttttgactgttctttaaaaccaagttcaattggcttaaactctgtgccttttccttacccatatgaaaaatcactgtcttctcatcaaagaattcctgtgatacattagttatgctgtttttatagcacttttcacattttccattgaattatttatgtttatgtgttagattgtaaggaacttgaaggcaaagtttatctctgagtcatttggcttagtaccttgcatagtaattatacagagtaaatatgtatagaatgaatgaataaatatatgagaagaaaaatatatttcttttatgcgcatcgaaagatgtaggcttcatctacatacacaagtcggacttaagtatttagctgacttgattaagggatgtctcatcctgaggaagggtataatttagcaataacttactcattataatttatttaaagttgcattccacaagtaattgtacagcatcacctatgggacaggaacattatatgtgtagcttgtgaattcaagattgataacaatcttcagctgagaccttttttttaaaaatgtggcatttgcctccaagagaaaaggcacgaaagcatcacaagcagagaacaaagagaaagtgtcttcagaatgtaattgtgatgaatctatgcctgtctgtttgcaaggatttgtgtagcactcttgcaccttcccccttaaagaaatttctctactacaaattttcagtgctttgaaatgaaaaataatttctgccattgtaaatttttttgcaaataatttcagcacctagaataagtgaagttatttttcagtaagagtttatgacataaagggaagtgattaaatcagtcatgaattgtgcatttagaatagcatgaaggacttttctttcaacacaactgatacgtttgaactatgctgaaaagttctcctggctgaaaaatggtcatgtcttttttattctaaaataagaatgaaatgttttgtaccttaaattttctttgattttattccaaaaataaatagggaagctaaattttgcaaaaataattagtctctatgataggcacggtgagaacaaaaagagactgtgaatcagatgatcctagttctaggcctgggttcagccacttaattaagtctgtgaccttggcgatttcatataaatatttaagtctgtgacctttgtcatttcatataaatattttcatcctcaggaaccttatctgcacaatttagggattagtctttaatggtaaattttaaactgcttttaggagtcacagtggcacatggagtcccttgagaagcaacctcacaaggggtggcctagggtgccaggctccaccattttttgtgtttgttttgtattctgtttcatttgtttgttaaaattccctttataataggttcgtgacaggaacaaacaacaaatttaaaattctagattaaatcacttctgggtttcatatagcaatcttaatttttacttgtttatggaacatgggtagtagcagataaagataattgtcatttttcttattgctctattcactcacccaacatttattaagaagttgctacatgtaaaaactgctgtgtccagtgttttggaaatttaaaggtgtcagagttcaaaatctattcggaaaatatctaagaaaaaaagtccatgtgataagggttacggcagaaatataaataaaatgtccttaaagaatgtaggtagagacttcattcttccatgctctgagcaggtaatgatcccacaacaggagatgaatgcaagttggtttaagtcctatggtctcaaacttggttttagaactgaagcactttttatttcagtatcattattttttaagcaaatgcctgatgaaaagttatctttgaaacattttgtatttaaaaaattgtcatcatgcatacattacttaatttaatacagtacactatttttaactcatagcaaaagaggtaaaacagtaacttaaaatttataggttgtaagaagtatgaagatcattgtgatgcaagtataaaaatggaaacgtgttttaaataaatcaatattcaaatatgtaagtcatataattgttataaataatttaatatacaaatacatatgccaaagtccacatgatatatccactaagaccttaacatcctgaagtgtattatatactagcgtaacataattaatatagtgaaaaatgtctggcaatatgcaaaccatccataaccactttgtttgcaatctaccttcaatatttagttggacaactttggagtgaaaagtactactgcatgagtaaagaaatacaaacgtcttattatgttgctttccagagtcttaggtttcagttgattacctatgtcaattagtatattctctcctttcctttctattacctttctttaaactttgagttttctgtgcctaaaaatgtgtatacatacatcttgtctacccaaaattttattctgttgtaattgaaatatgtatttacttgtgatggctaatttcatgtatcaagcctggctatgtcaagatacccaagtgtttaataaagcatttctctagatgtttctgtgaaggtatagatgagattagcatttataagtagacttacagtaaagcagatgaccctctatagtatgggtgagtctcatccagtcagttggaggttttagtagaagaaatctgacctccatggaagaagagagaattctgccagcagcctgcctttggattcaaactgtcactctttcctgggtctccagcctgctggcctgccctgcactctggacttccagcctccgcaactgcatgagcccattccttaaaataaatctcactatatatatatatatatatatacacacacaactttttggttctgtttctctggagaactctgactaatatatgcttcagggcccagaaagtgctgaccatcttataataatttgaacaaacaaataaacaaaaatagcccaaaccagaaaagtcactcaatgtatatgtgatgtgatacagtgacacagatattgagaaggcaaatactgtgtgatcgagataatggggtcagcagatattcttccagagacaagaagcactggtgtaaacaagtatgctagttaaatactcattagttaaatttacagagggaattcagtgaaccctacaatgcttcagttcttcagaaagattatccagcctctctttacttctcccttccgaaatttcatgtacacgattctagatatttgaataaatgttccacacagaactttgggtgatgaaataaaacctatccatctgtaatggaagggaactgactcttacaattgttatttctgatactgatagaatttttgtctcaaataatttttacacttactgctgttgttttcctttctgtcttgctcacacttttagtgtaaatatagttataacatatagaactgttagaattgtggcattaggttgtagatttgtgatcttcctatatttttgatgaaggcatttaactcaggactcattttgaaagtctaaactctttgaattggaaatatatctcctgaaagttttttactggatttagtaaaattgagcatttacctcactgtttttctttttcaaaagacatataatatttaaaaacagtagagaataatgtgggggaaaatgcaatctaattaggtttattgttattactattttgacatttttagatctctttagaaaaaaattacataaaagacatttgaagcttcatatatataacgctaacctattttcctcccttcttcctcatatgtatctattttaccacatatttatttttccataaatttctgtctattgttttaatttttaaagttttatataaatagtatataaatcatatatttatataactttctttcttatatgtgttttttaactgagtaatgaaagaataagtgtttaaagtaaaatattttatcaggtatacttatgaaacatcaagtatacccattaaacttgtcaacttttatcgtaggaatgttacatggtaagtccttagttaacatcattgataggttcttggaaactgtgacattaagcaaaaggacatacagcaggtccttgaataacatcattttgctcaacatcattttcttataatgttgagaaaaagcatggtatttttatacgttgttttgcttaagtcacagtttctaagaacctattgacaatgttaactgaggacgtgttgtgtttgccatttttttctagccaaaaactctaagaaacttgaaatgacaaacccttcaatatgctttctcgatatctttctcataagaactcagataatttcagtatagataataatatagctactttctgtataattgtggattttatatgagaattgctaataaaatgcctttttttaataaataaaacctaaacttaccctaattatactttcattttcttcctgatctcttaaatcatcgtggattacagggttttgttgttgttgttgtttaaatctggcatatggttacaaatatagcctgtgtgctaataatcatttcatcttttttaatatattagaagacatttacacagtggttcttttccaaggagagcattttctgctcagttagcaggaaatgcataagtagttttcctaagtgagatcttcatcagcctagaagtgtctactgcaactttctgggcttttaaaatcataccaccaattattcctgagatgttgtattacgtctttgacagctgacatttttttgtgtcacagctatttctatacaaatagaatgcatggagcattacaagatatttaaaattgttatgtattcaaatagtaataggtattgttttgaaatgtacttctttaattcacaatatacttcctttagggcacctggccagggatttaaaaacccaaagcaaacatgtttttgtttctttctagaaagatcaataaatagcattatacaattacaacttactattctcacatcgctaaaatagaagtgtgcttatggctgatgtcaaagactgtagttgcctacgcatcacagtctcccaaggagaaagcttaacctttaattgtatgctactcaagcaggattgctgactatccttatctattgaggggaaataagtaaatagtaggagagaattaactgcctttcattctttgctatcacttaaacatatggtataaacaggatttttttttgtggctgttgatttttttccagtggctctttgctggaagcaaaaatatattttgccttgaaaataaagttagtgttctcaatttgtgataaaggtcactatttaaaaatattttttgttgtttttgttttctgacaactcaagcagaattgattaaggataaaaaaatggcttgctatttatggagatgatttcctatagtttgtaatttaatggactccctaaccaaaacacattcctaaaatagttttatgagttaaaatgttaagtgatcggtttaaaaaaaaagtaaattcctttctataagacacttctgaatcaatatcattgtattactgaaatattaaaaacaagcaagaaaaccaatgagacttgttatacaggtacatgtggctactcaactatattgtgatgtcagagaaagctcccttttctatggagggccatgtgaccagaagaaataggtgctttcttactatgaaagacacaattgtcccttattctaatttgcgtagatatttatttcaatttccacaaaagtcctgtttacataagagacagaaataaatgtataacattataaagtaaaccattgaataatatataaaaacagcttgaagttttatattatgactatcactgtgaaatgctatcattacatgctttttgatggcatgatgcttttaaattgaaggttaaaagtcctaaaatatgtaactagttagtgtaaaatttttatttaaaactgatggagattcagttttttaatttctgtttcagaaattatcatcagtctaggaggtgtaaattatcctctcaaaggaaggattttgctcttatctattgggaattttctttaaggcctcttgcctgtaaaatcacttgtatctaatatgtgccattaattataaaaccactcctcctataggtctaccatcacagagttttgactaacattttttgaaccaccatatttattatgataacaatttaactaaattaggccctgcttttcatcattcagacaacttttgggaaaacatttaaaaaataaactcaaaactccactgtctctgagaagtttaaaaacagtgagcctcaattcttatgtcagtgaagtcaagagtttcagataaatctgtatattcaatcctgaggtatcaaatccagttcactgaaattgtcaacagtgatttacaaaaataaactgaagggcactgtttattcacttctgtactgatgttctatcttcttacggtgttttctcacagcttttttttgtgtagagaatcttgtattaaaaggtcaagaatattgggatttaagcctactgctgctactattttaataggtatttaactcccaattgcctatatttcttgtgtggtagtaagtgggatactgaagttagattcattgatgtctatggactttgctgtcaccattccctatcttgagaatcttatcttcccatctctctgcttccttttttcccttttcttttaaacatttttttttattcatttgctctttttctctacttctcttccattgaaatgactatattttccctcccttttaatatgctaagtcactttcagagactcaatcctaccctattcttctcaaacattcttaaaatacccttttctaaattgtagagcatgtaattttcctctcatttccaatattccttcctattctatcatgtatgttataatctgtgatgagtaaattaagaatcaagtgtgtcacagcaaaaaccaaaagaatgagaaagatagtggaaatagcacagctctggttaaaactgctttcatcttgccctttctcttagtaaaaactcaaccccacagtattctaacaggatttttactaccgttcttttcctgtcctaaccccaattcaaataaagacttcacaccatctcagttcagttaaaagaaatactgttctctttaatgttagaaataaagctctagtcttccataccagaaggattttgagtaggtatattaactttttgctctacccactttagagtagactggaagtattaggccaatatatgttaattattttcttctgatggcaaaataatataacgcctgctaatatttcgagtgagttttaagactttcaaaaatccttaaaaaaaggtaatacatgacttcagttcaactccataaaatagcatatcccagcatttagagaatcaaagacaaaaaagacaagttcattaatctcaagcagcttacagtctattagtggagctagaaatataagcacataaatgttaaaaagaataattaagaaaggatttataaaagatagcaattatacagaaaaatgtctaattctcataagatagtatgagaggtttggctctgtgtccccacccaaatctcgtgttgaattgttattcccgatgttaggggaaggacctggtgggaggtgattggatcacgggggcagatttcccccttggtgttcttgtgacagtgaataagttctcaggagatctggttgtttaaaagtgtgtagcgtttccctcttcactctctctctcttgctctgccatgtgaagatgtgccagcttccccttcgccttccaccataactgaaagtttcctgaggccacccagccatgcttcctgtatagcctgtggaactctgagtcaattaaatctcttcataaattactcagtttcaggtatgtgtttatagcagtgtgagaatagactaatacagatatcaaagcaagtgattcataaaagttgagattcctgggccgagttttaaaagataactaggaatatctcacaggcaaaaaatagagagtgagattaaaaaaaaaaattcaggcagagagaacaagtacagactcaagaaaatgttatgtaattaacattcataattgaattcattagacactatttggaaatgggcttacatatatgacaaaactgaaaaatggcagatttctgatatgaattatttcaccggattgcttaatttgctttttattgatattatggaactcattacaaattatttatatagagctataattcacaattatataccagtagcaataaaaaactagtagaattgtagatgatgttggcactttctttgtagtttgctcaaaattttcattgaagaagaggttacattcctctaattgtatttttccttttaatattgtgcaattaaatgtttatttgcagttcataaagcaacatcatctcatttgtttgaaaatcctgcttgacatgttcttgtatttagtcttgctattaaattaggggccattagaataaatgagattgtgagatgttaatacagaggtcagttcaattttctacccatttccaccaatgtgaaaagcatctaacatgtttgcataaatcctgacttatagatgtggtaataaacaaacaaaattgtaaatttcatttatttacaactactggggagtagaaaacataaagaaaataatgatcatatacaggcagaagctgagagtctcacagccccctttttatatttaataataatatacatattttaaattgacatataataattgcacatatttggggggtacataccaatgtttatatttatagatatgttgagtaggtgcaaaagtaattgcagtttttgcaattacttttaattacactatatataatggacagttaattttactacactatatatatgttacagtaatcagatcaggatgcttagcatatccaacatctcaaacatttataatttacttgtgttgggagcattcaatatacactcactagctatttgaaactatataatatattaatgttcactatagtcatcccacagtggtagattttcactgcctttcagagtttgtacagagagttaaaactatttttctttttctatatttagtctgtacattttttccttttgcaattccttttcagcattctgcttctaatctctacgtccatgacttcaattgttttgatttttagataccacaaaatatgcttatttcacattgtatgcctttatcaaaacatctcatgtaccccatacatacatacacctactatgtactcacaaaagttaaaaataaaaaaattctctatctattcattttttaaaattatttgccattactcatttccttggtttcttttacagtcgtttccctattaaatcagttagcttttgtttagcttttataattcattctccattctctatattgtacttacctatgacacagttatttaggtgattacttttagagtggattggcatatttctgttagaagatgatatcaaaatattgttaggtaaatgaatatatatctacctaaatgatacatacatatatatatatatgtgtgtgtgtgttatatatatatgtaaacataccaccttaatgggatgcatacagggctaatacgataattccttattttatataatgggaaagtagtttttgccttattcctcgaattaacggtgtagagagactcaatttgttttaaaatcttaattatcaatgataattcttcaaataaatactctcatttcattgcaaagttattactattagagaacattttaattattgttatcaaattttacttttttagaaaaacacaaatcctattttaagttgaaaaagcgaatgttaaaaatgttttaggatttacacaatattttatttgaagttttcaatttttcaaatgtgaaaatacctatgaagtatgaatttttttatttatcacgttgattataactttaagttttaaaaatgttgaaaagcaactgggttatgtagaagtgtatatgtgtgtttctaaacaccttatatattatgtattattacaaaatgtttataaacacgttataattttcagaggcttacattctttttaaaatgatacttcgttaataacacttcactaagtttttcattcagaaaattttaatctaaactagactgatgtactactacacactaatatgtaaaaagggaccactaccccttgagtgagactttatattatttaaattttgctccaagtactgtatgcatctggatatattcgaaaaaaatctttccacattctcttatttctgttttcttagatgaagcatgagtgggctggtttgtgcatctagaacaggggtaggggacagggagatatccaaccaagtatggaaaagcatctcttctcttaattttcttcctccaaattaaggtgctgtaacttgaacgaacactcaaattaatgtgtacacatgttatggaaaaaaataatgcagtgatcaatgaaagaatccaggtttaatattgggaattaatacaaagaggggatatagaaaattgaagctaggcttaaaattgaccccaaaaacttatctgaacaaatgaaatcttagaaatcctttaagtatagtatgccttggaaatgagtgatatggaatgatcatagtaaaaccacactaatgtgacatgtaaacttacctatgactacatgaaaacttgggcccaaggaaagctggattatcaatactatgtgtatatgaaagagtttgtcatgaacctagactgtgtcacttttttccatactaagagggatgctatctcatccacccaacatgaatggaaatttaattatattcaattatcttaccaggtttggagatacaaatgaaatactattatttaatatttactgagtgcttattttcaagtggttatcatgttaaaggctttagatcattgactaatacaattccataataaccaccctgactaggtgtttttactagctgaatttttcagataaaattgagacttacagagactgaataacttttccaatattaccctgctagtagaaagtggcagaactgggattggatcccagttcttagaaaatcaccaatctttcttaaccattatgctatttattggttttataaataattacttcaaattacctacttggtggcatccttaatttggagccaagcacttatttaaacaaacacttaatgaaatatttatttatttttaaaaaacttaattaaacacttatttaaacaaagtttaagtaagatacagtttttgttcttgaggaacttacagtataacagagggagaaagccatgtaaacaaaaaaacaaacacctctaagtttgtggctttgtacagagagagtggtctgttccttttggatttttactttctagaagttttatgcaaggctccataaatatattatgtctgagtttcattgtgaaaagttagcaggtattcacttactgaagggaagccattaaaatgttttaggctggattataaccactggacatgaacgaagaagaagatttcagctgagaatagtgagtccatttaaaaggctgttgaagtagtcaaactgaggtcagatggaggcccgaagagaggtagttccagagacaaggcactgtgaagagaagggattttggtgtttgaggagtagcaatcatggaccacacacatttctgagtggaagtaaatcagctcaacctatgtcactgcctgggcatttgacagccatttgttgctttccttgtttttaattacttaatttctattatttttgaagagactacctaacatacttaagaaacttcactttccaaaaatctttggctattattatcccgtcaggaaaactccttatcaaagaaaactttctttttggaattatttttttcttcagtgtcaagtgcttttatattctgttgaagatttgtttttcgttaaaagataacttccacttcctgtattgcaacaatccaatgagaatgaagaaggttagaatatagttgtccctcagtatcagcagatagaactggttctaggaaccaggtggatatcaaaatctgcaaatgctcaagctccttatgtagaatggtatcactgtatttgcatataacctacgcacatcttccatttagataatctctagattagttataatacctaaatcaatgtaaatgctatgtgaatagttgtcataccatgttttctatttgtatatttttattgttgtattgttatttttattatttcttaaaaaatattttcagcctgaggttggttgaatccatggatgtggaatccaagaatacagaaggccgattgtaaccgatatcggatcaaaaagagagtaatagaaagaaaggcataaaaataggaaaagacaaatgaaacaaacaaaaaagccacaacaaaaataacccaacttagttagattcaagtttcataatttttttttcttaaaggtatgattaagagttgatgagagatacttggaagaaaaaacaaaacaaaataaaataaaacaaaaaagctgaggaagtttagtaacagagaagagttaattgcttttagaatattttcacaatagtaaagctgcaaattagtttaataggatacaaaattttaaatgtaattatattaataaggaggtaatgatttcttgtagtctataagttatcctatacagacatgaaatattttttgtattatataacaaaccctactgaaaggatggatgtctcataagtatattaaaatttttctaaaaggcatttataaaaacaggtgtgaaaatttttaacacaggatggactagaagaaaataaataggagactagaaaaagatacattctcattggaaattctacagctccatacttgggatcctaagctataattggatgtggaacactcaatttgagagaattttcacagaatgctaaagttctctcttttttatcatccaaaaaaaatcatcattaaaaacttccaaagggcgtaaaacatataatattggcagagagacacaaacatgtttttttttaatttaattttaaccccctgtgaaaaaagaattccttgagtttggccaaaattcaaaattttaacttagaaaataataccagtctctattcactaaaaatatgcattctttcatttatttctgaaaaaaagaggtagaattttatttctgtaatgtcaaagcaagtcctcatccttctttaatagacactatatttgtcaaaatttttgtaagcataaaaatatggctggagttcttagaaatgtttgccgtaacttaaccaataaataaagtattgcctcaaactaaattgcattagaaacaggaaaaggagctctaagcaagaactgactgcaatcattcagaattatatttgtattttcaataatggccaaagacataaaattacgagtgcccactaggtgaacattatttattgtgtgtcagttatgactcataatacatagtcattatctctttaacacagtaagccagaataatatatatgatttttcccattttacagatttaaaaatgatgctttcaaagtaggcttaactgcttcacaggaatgttgtctaattttgagcaatgtacattataatttttctaatactgtctacatacagtattattggtacaactttaagtaggttgtgtagtatattgtaacacagggtacaaatcctgacagcaagtggtaaatataatggtgaggtcaagccaattccaaggaaatacattttctgggacatatgagaactttgccttttgtatatatgagcatcatgtaagagcgaatggtacagtaaaaaccccaaggaaatggcaacttaaatgtgagtcatttaaacaacattctgaggtattggtataaggttaggatcatgttttaattattgttgatctgcaaaatattctattgggcatccttcaatcctttcaagcatccagcctaaaatactaatactatataatgttacatgactccaaacaagattgaggaccagtgaccttgtacaaccctttcattttataattgaggaagttaaaggcttgagtggttagactgttggtaagtaagtcattacaatagcaaaactagaacccaaatctccaaactcttttttcccattatgttttctcctatatcatactgcctggtataatgataatggtaaagttcttgctttttaactctaactgttaacattttaataataaacataaacaaccaactgaaataataaaaataatttacacatgcattttaaaatatttattgtatgaccagcatatactaacttaaacaaatttaaattgtacactttgataaatactgacatacttaaaaattgtaaacacaaagtagtcatcattccccccaaactcccttgcttctctgtaattcttctcacccacacttcctgactgcaattccatacccaggaaaacgtggtttttttctggtcactgtattagtttgcattttatacaggcttatataaacagaatcatacaatctacattgcatttctggccttgtttctttaacggagcatacttatttggggatttatccatatttctttttttttttttttttttttttttgagacggagtctcgctctgtcgcccaggctggagtgcagtggcgggatctcggctcactgcaagctccgcctcccgggttcacgccattctcctgcctcggcctcccgagtagctgggactacaggcgcccgccactacgcccagctaattttttgtatttttagtagagacggggtttcaccgttttagccgggatggtctcgatctcctgacctcgtgatccgcccgcctcggcctcccaaagtgctgggattacaggcgtgagccaccgcgcccggccgttatccatatttctatgaatgtcaatagttcattgcttgttataaatttatactatttcattggatggctatactatgatttgtttatccactcacacgttgatggacagttgtgttgttttcagctttggctgttacaaatagagctgctatgaacatttacacttaagtctgtataggaacatatgttttgaaattttgggtaaatacctaggaatggaatgatgagttcatttggttggtataagtttaactttttaagaaagtttcaaattgttttaaatgagttgtaacattttactttcccactggtaatgtataagagtttcagttgctccacatcttcatcaatactggtgtggttacacattttaattttagacattattgtaggtgcatagggatgtctcgctgtgggttcaatttgcatctccctaatgacaaagagtgttaagcatcttctcatgtgtttgtcatgcattttccttcattgtttcaatgtctcttcaaagttttgcctgtcttaaaattgggttgtttgtattcttattatcaagctttgaacattatttttctgctctggaaacaatcctgttgtcgactgtatgatttgcatgtattttctcacccatttgtggctgaccttaacagtgtttttcaaagtagaaattcttaattttgatgaagtccatttcattttttatgggcttttattttagcgttgtgtctataaaatttttacctatcctaaatttacaaagattttttctatgcttatttctagacatttcatagttttaagtttaatgtttagctctgtgaatgattttgggttatttttgcatatcttatgagttatagatcaaaattcatttttttgcatacgtatagtcagtaccatttgttgaaaaggctatgctttcttcactgaatccccttcacacctttatcaaaaatcaattgaccatgtaattttgtgtttcacttttagattctccattctactttattgctttatttgactgttttgatgtatgtgatcttttatcctgaaaacttgcaaaacactttttagttccagtggctttttgtagcttctgttggattttcttcttacacatcggtcgtcttataataaggaaagttttattttttcactttttaatggcttacatttatgttttctgacttagtgcactaggcaatacatccaggacaatgataatagaagtgggaatagtggaaattcttgactttttcctgatcttaacaggaaagtattcaatcttcaccattaagcgtaaagttagatgtaggtctttcatagattcccttttcaggttaagtaatttttcttctatttctaggatcctcagaattttatcactcagagtatggtctattttggtaaatattctttatgaatttgaaaagaaatatgtgttcagctgttgttagctatcgcgttctaaaaccatcaatagtgtcaagttggatgatagtgttgttcaagtcttactgagagagacagttgaaatatccttctataatttgtttctttttttgatgatgaaattgtgtttaagtttttcagctttattgatgtatgattgaacataaaaattagtatatttaaggtctacaatgtgattttatatatttatatattgtgaaatgattaccacaatctagctaaaaatcatacccatcacctcaaattgttatcttggttgtgtgtgtgtgtgtgtgtgtgtgtgtgtgtgtgtgtgtgtacgtatgcgatgacaacaactgagaacttaaggtctattctcttagcaaatttcaagtataaaatacattataattaactgtagtcaacatgttaaaaattatgtctccaggacttattcatcttatgaatgaaagtttataccacttgacctcaacatctctcccatttcctaccctcctatctcctggtaccatcattctgctctctgtttatatgaatttggattttttagattgcgcgtataagtgatgtcatgcaatatttttatctttctatgtctggcttatttctcttagcataatgtcctccagtttcatccatgttgtcacaaatggcaagatttacttatatttgatgctgaataacacctgattgtatatatatgacacattttcattatgcatttacccactgatgaacacaaggttgattccacattttaggtattgtgaataaagctgcagtggacatgggagtacaaatatctctttgaaataatgatttcatttcctttgtatttgtacacagaagtgagaatgctggatcataaggtacttctatttttaacttttggaggaatctccatcctgtttttcataatgatggtatcaattacattctcaccaatactgtacagtggttcccttttctccatttcctcaccaacagttatattttttccttatttacaatagtgtgaagtgatatctcattgtagttttggatttgcttttctgtgaggattagtgatgttgagcattttgtcatatacctgttggccatttgtatgtcttctttggagaaatatcaatttaggtttttttctttattttttcctgagttgtttgacttcctaatgtattttggatattaacctcttatcaagtatataatttgcaatttttaaattttacctttcatagtttgtctcttcattcggttgattgttttaatttttttggggggggggtggaggggggagggatagcattaggagatatacctaatgctaaatgatgagttaatgggtgcagcacaccagcatggcacatgtatacatatgcaactaactggcacattgtgcatatgtaccctaaaacttaaagtataataataataataaataataataataataataataataaaaagctttttattttgacttaatcccatttgccttttaaaaaaaaaattgttgcctgtgtttttggagtcatgtccaaaatatcattgccaagatcaatgtcatagaacttttctcctgtgttttcttgtagatgttttatgatttcaggacttacatttaatctttaatccatgttgaattgatttctgtatatgatgtgaagtaaggatataatttcagtcttctgcttgtgggtttccagctttcctagaatcatttattgaagagaatgtcctttccccattgtgtgttgttgacatcttggtcaaaaatcaaatggcagtacatgtgtggattttatttctagtctgtctgcattgttctgttagcacatgtatctgattttaagtcaataccatgttgctttggttactatagctttgtagtattttttgaaatccaggtagagagatgcctccaaatttgttattttgtctaagattgctttggctacttggggtcttttatggttctgtaatgaattttaggattattttttaattttgtgtaaaacatcatgggggcgttcataggcattgcattgaatttttatatcactttgggtattatgaatattttaataatattatttcaaaccaagaatatgtgatatcctttcatttatttgtagcttcaacttcttttgtcaatattatatagttttcggtttacagatcttttacctccttagttaaacatattcctaaatataatattttactttattttattgtagatattgcaaatggaaatgttttcttaatcttctttggatagtttgttgttagtgtatagaaatgctactgatttaagaaattcagtgcttcttttttttttttttttttgtgacggagtctctacctctgtctcccaagctggagtgcagtggcgcaatcttggctcactgcaagctccgcctcccgtgttcacaccattctcctgcctcagcctcctgagtagctgggactacaggcgcctggcaccatgcccggctaactttttgtacttttagtagagaccgggtttcaccgtgttagccaggatggtctcgatctcctgaccttgtgatccgcccgccttggcttcccaaagtgctggaattataggcgtgagcaactgcacccggctgaaattcaattcttctttacattaaacataagataattttctaaaagtttaaaaaatattgtcttatttaaacacgacaacaatctaatgtagtagattctttatctatagaggatgaaactgtggcacacagggtgaggtttatataacttttgtaaacccatacagatattaaaattgaatgatggcattttgagtaaagatgttatatgattagatatccttcactctgtgttgctttacttatccaatcattttacctagttaaaatgattaaaataataaaatgttttaccagtagcaaatgaaaacatatatatctcagaatctacttataaccactaactaaagaaaaaaatttcgtatgtttttctaaataacatagcatttaaagctgtattctaaaaaagattacatatattgcataatgattttacttaattactatcacaacatgtagtcaaatatgaatgcttaaaatgtggtgttgcataatgatggaattttaaaaatatgtcagtgaaattcatttaggaacgaaaatgtgacttttctatctttaatttataaggctaataaaattgaaataatatatactttaccgactggtggagtggtccaaagaacaatgaaatgaagttatttaaaacactgtcattcttaggataaaaatcctttgcaaaaacagatggctaaactatttgatttaacttcatgtgtgtgtgtgtgtgtgtgtgtgtgtgtgtgtgtgtgtgtgtgtgtgtgtgtgtgtgtttgcttagtattgttagactatgaaaatgtacttaaatcttttaagaatggaagaatatttttgtcataatcagcagtgcaggcacttgaaaactctagcacaatatttttttttaactgtaactgttttggtttgctaatgcagcacttacttttccatatgcaaagatatttaaggtctcaatggttaaccttattttagtattactgtggagaaagttgcaatctgaatctaaaataagtcatttagtttagactaaatggacagacacatctttgaagtttatagatacagtttccagtgacccagtttttgacatactactgtcgtggttcactctaggttttccaaacactgtttcagtgattactgagccagagacagtatgcttgattgtgtcagtttatacttgaatacctttaatatgtgaatctatgcatcatactcaccatttatcactctaaccctctagggcatatgagcacaacacataaatctattttggctgctccttaaatgtcataaataccctggctatatttggttttaatatatatatattttaaagagataaatactgtaaatcatatttctgaaggaaacattattttgacaaaatgtccatcaattaaacagggtatatatgtttatatatttatatatcctcttttatatatattaattatattaatatacatataatacattaatataattaaaataatatatattttaatatatataaatatatatattcacacataatcacacacacacatagagatacacaaattgaaaaacaaacatacacataccataaactgtgttattggtactatacaagagttacatcttttacagaacaacataggccctagaaatagtataaactcaagaaatatttgttgactaaatgactgcataagcaaatgaggaaacggcctagaaattgatctaaataacattaaaaaattgactgtatcccatccaatatcatagaataatattttctatattactgcaattaccatatctttgattttctttaccaccaacctcttatttgtgcagttatctttttcctctagtgctctccctctttgtctctcctgcctaagctaaatgtaactaaaataaaaaatgtaagttactttaaagtatagcaccatgaaatcttcttagtctgattgtttggaagtagtcagtggctttacccctacaacttaaattttgtatttcaaacttagtcctgaaaaggcattatttgcttcatctccataaaattgcattttagtagcatgacttgatgtgcttaataaattagttatgcatcttaatgatagaagacagcttaacctgtctttaaaacatcatcataaagctggtcatgcatttttctttagtgtcttccctagcactgtgaagctgtatgctcatatttacatcaaaactctgtcagatgattagattttgcacattttttaatggccattgaaaacaagttctttaggaccttaattgccaaagcaaaagtatgaaatagttttgatcaccatgctgtgatcatacttctatgacattcttaagtaaatggcttaccttggacacacttttaaatatatctgacttctttttttccctttatggttttccatcttgtttctgcagacgttctcttccttctgtacgcctctcccaatatagaatttcaaatttgtcatcaattttctgtccacatctccctatctgaaatgtttgctaataaggtaattctggctaggaacactcacagcaattctttgcgggggtaaaatgctactcttcaaggcccagtgtgacatctccaatgatttctcaggatttatgagtttcctttgtggagctgactttctttatggtgtggctgcatttctgaggatcatcacagtgtcaaaattcgttacagtgagaataagtatctcatatgagccagttgaaaagctaatacaatttagatatttgtggttattgataaagatatatttaacaatgtagtgatttcagaaaaaataataatggtgggaaatattacaccttgtgtataattatgatacattagtggacttacttcaagtttagtttgtgcacgctatggaaataattacatggttttttaaaagttgttaagatacatagtcctccttagtctttgctctgctaaagtggatttagtgtactacaaatggtaaactgttagaatggtccaagtctaattcataataaaattttacctattacaaactgtggttatatggattaaaaaaatgcctaaattttccagagaaagttttacaaaatgtgtttatttggattttttaactatattaatcaacaaatatgtagcattttcaatacctccgtattgttctgtttaaatgagcacttacatattattagatttgatgatgttctttattttacatatgggaaaactgaggcacagatacattcattaagttcacatggaaaagcagaaccagattttgaaaatgaaagagatagttataaagttgctgcttattgaggagtattcttcagacctttcaattttatttggtgaatcaggaaatagattaattgatcaataggaacaaactacgttaaatgattgataagtaatataaattaattccaaaagtggagacttctgtgggcttcagttagctaaaaacatgttattgaggagacaggcttgatctggactttggagaaaatagagaggcaattagggagacataatgttggagtgagtacatagaatattcaaataaatatcaaatgttattaaagcatttcataaattaagttttagcgtaattgatagaatgtgattctttgaaacattgtaattactagcttaaaattgtttattgcataatgagtattattattattgttattttggaacatgttttcccttctgattagttttcttacaatttctgtgtaataatgattacaaataatttttcttgtcaaaaaatacacgtatcttctcagttctactaaaatgaatgttttacatgaatttgttagagtaaaagcataagaaaccatcaggatctagaaaggaaagaaatggaatgagaattaaataacttacttgaattgtcttgctttaagtgaatgtcatttcttatgataatcacaaaaatcattaatcaaattttattttcataagtttgcatgagattacttaatagttttcttgagtcaatatagtgttgaaatataacatttttacatttttctccttagtaggaaagataatctataactatgggtgagcttatcatcaagaactccaggaaaattatgaagtgatttctcttgccacagtgcctgtcttagtttcctgaggctgttgtaccaaattaccacaaatttggtggcttctaacaacagaaatgtattctctcacaggtctcaaggctagaagtccaaaattcaaacttggcagggctgtgatccctgcagggctctggggagaatatgttgtttgtcttttctgcctttctttggctgcactggttttccttgacttgtggtcgctcaaggctctaaccttaattgcatctgcaagtactctttttctaagtaacgtaacattcataggttacagaaattaaggtgtaggcatatcttttgggggtgccatccctcaacctacttcagtcctcttttcctttgagctttcttcaaaatccctatttcatctgctacctgtgattagagctcccttgctcactatgctccccttctacttcattgtagctcttaggaagttgtcaactctcttgttcagcttttaaaagtactcatttgattattcttgctggtgtctagtttcgtgaggtttctatgctctacatgctgacaagggtagtaagtatgatctcaatacagtgaaatcacctctcaatagagttaaatttctgaagtcagcaggataggctgaatgtgtatatgacgtaaacatggtaagccagaattaatatagctgtactgacaagtacacaaaattggaagtttaatttactcaaaggtcttgagaaaattgtttattatctttaatttcatatacctttataggcttctaattttttctgtaatcttatagagtacccttaaagttcctggaagtagagaagtattactcttctattttaagaaattacggaaagaaaaagatagaggtaattactccaggataagtgttcatttaatagaatggtaataaggaatttatgtgaatcacagacactatttaaatgattctctagtatgactagccaattatctcagcaccatttactgaataaggagtcttcctcattgcttgtttttgttgaccttgttgaaaatcaggtggttgaaagtgtgaagctttgtttctgaattttttattctgttccattcgtctatatgtatgtttttgtactagcatcataaaattttcatcagtatagccttgtagtatagattaaagttaggtagtgtgatgcctccagcttcattctttttgcttaggattgctttggctattcaggctcttttttggttccagatgaatttcatgttatttttccaattatttaaagaatgatgttggtagtttcataagaatagcacagaatctgtaaattgccttgggaagcatgaccattttaacaatattgattctttcaatccatgagcttagaaagtatttcaatttatttgtgtcaatcattatgctgaaaagacacatgcatttgtctgttcattactgcactattcattattgcaaagacatggaatctatccatatgcccatcagtggtggactggagaataaaatgtgatatatatatatatatatatatatatatatatatatatatatatatatatataaaataacaatacaagcttatagctgctcagagaattttgatttattcaagatttatatatatctatatttatatatatactatggaatactacacagccataaaaaaacagtgaaatcatgtcctttgtagcaacatggatggagctgaaggcaataatcctaagcaaaataacacaggaatagaaaaccaaatattgcatgtcctcacttatatgtgggtgctaaactttgagaacacatggacataaacttgggaacaatgggagcaatagacactgtggactacttagagggcagagggaggaaggaggacatgggttgaaaaactacttattgggtactatgctcactaccggggtgcaatatacccatgtaacaaaccttcacctgtacccctgcatctaacttaaaagttaaattaaaaaatataaaatgaaataaaaataattattctattcttgcaccttctccttctggttgaattggtcaaaggcaaataagaatataatttgactccatttagttatgttaactgttttagaaaatacaatagttacccaattaaaatctactttttttaagacgagattaatttaagtcagaatatgagcctatttgttaatttggtcttatcaaatcatatcacagggcagattgttgctcaattctggcttgtgattgacttgtctctggctgaaagaatctagagacgcataacttaaaaactctaacggaagaagatgttactaattaattcttcaaactcagtatacatcacttaaacaatgtattattttacaatattaaatgcttatttttattattaacattattctctaaattctatgtctatcattgttttagaaatttatttttaatagcaacatctgtgaactataaatactaataatatgttgcaacataggattgtatccatacatggaatattttgacagaatacactagacacatctagacaaacttgttgttcaactgacatagttggtcaaaagtacaagcttggctgggcgcagtggctcacgcttgtaatctcagcagtttgggaggctgaggtgggcggatcacaaggtcaggagttagaaaccagcctggccaatatggcgaaaacctgtctctagcagaaaatacaaaaattagctggctgtagtgcacatgcctgaagtcccagctactcaggaggctgaggcaagagaatcgcttgaatctgagaggcagaggttgcagtgagccaaggtcgtgccactgcactccagcctgggtgacagagtgagactctgtctcacaataataataatactaataataataaccacaataacaatacaagcttataactgctcagagaattttgatttatacaggatgccagttgaatgttgagttagttttccccttttcaagtgatgtcatgttttatcagtttaatttatcaagacagtcaatatgtatgttgggaaaagcaataaagctctcgttactgaataaatatcactgggacgatcaaagctagagtaaaatcctgggtcaggaacaccaaccacaagattcagggagcaatcagatttcagaatgtgattaccaagctgggtcagatgtctggagaataggatctggatgaagtagatacggaaggtgtaagtaagtttgccaaactaaaatcagaataatgaaagtcatatttagaagtctgagggagccttttcaggctgctacagggatagggaggtaaacaagcaacagaaaaaaattaaaatgcctctttggaatgttaagtagcagaatgcccctgttggtgtttcctgccacacctgacagtgtggcaaattagcttatacatttttgaagaattttaagaaatggaaatattgcatatgagaacgcacagttagttaacctctctgatatggcataggaaagaagattaaactacgtgaatgataaagcaaggtgctctccatgtaaactaacttgtaaaactgaccactcccaaatttgtatgtttttattcacactgtgatagaacaaggtaaatctatggtggaaggatggagggggagaaagaaacattacaaattgatagggaacattttaactgacaatagttgctatacctaatgtttctattcatttatagtaattgtaacctacccaaagtcacaaagatggtatctgacacaactagagttggttattgaaagatcactgctacaggcaaggcaccaagatgcctcatccaagctgcataatgattcagtaattcccttgaagaaagttagtaactataaaaagaaggtaaagataaaatgtcatttctgacttccagaagccccagcagtaatatactttattatatactgtatgtaagcaggaaataaaatattataggaattgtgaatattaattaaccacatcttcatagagtactcagaaaagagtttctggaagatcaatggttccaaacagattctaaatgatgatggtttaggaaggtggagagacacattcaatattttatgcaaagccaacataattttatataatattttatataatacttgttgaataaagaagaatatggcataaaattgaagcagtacatcagaataagttaatggagagattaagattcagactaaaaattctgggtctagttcagtagatattgagatagtaggatgattatgaagagcgtcatatgaagaagtactatacaggtttgacttatgaggtatggagttgtatatatttgatctaaatctcatatctaccactttttagctttgatcttaagctattttacattattatgcattataatttctcatatttaaactcagattaatgaaaatatttccttcatattacatggaaatatgtaatatggaggattacatggaaaacttcatgtagcgatctaatcatggtgcttaccatacatttaagaattatctatttattaaacaaatatttaagtggctgctacaggcaggtcattttgttattgttatttttataattttaatattatcattactcttattttcgatattgctaataacttgaggacgtttatggcaaatatatttaggctggatgaagcatcctaatcctggaggatgacagttggggattgggaaggaatcagtgagaatattcaaatgtttctaattgaataaatttatttgcttatatggcttttatttatgatttatattgtccttatatataataaataaggtgtgtgcatatatatatatatatatatatatatatatatatatatatatatatagtgtgtgtgtgtgtgtgtgtgagtgtatgtgtgtgtatataattcaggaccattataaagagaaaaataggccagtcctggtgactcacacctgtaatcccagcactttgggaggcccaggtgggtggatcacctgaggtcaggagttcaagactagcctgtaaaaccccatttctactaaaaatacaaaaattagccaggcatggtgtcacgtgcctgttgtcccagctacttggtaggatgaggcaggaggattgcttgaacctgtgaggcggaggttgcagtgagctgagattgcaccactgcactccagcctgggcgacagaatgagactctgcctcaaaaaataaataaagaaaaatgagagagagaaaaacaatttgcaaaaatatctgtaataaaaatatttgagaattttaagcttcagactttgcatatgtcagtgtatcatctgctctgcattaattttatgtttgtatgtctgacataaaattttacataaattttacgtggaattttacataaatagctttctaaaaattttctgggcctggaaacaagatttgaaattgtagaaataatgagtatagtgaaaactaatcatgtaaatatacagtagataacaaaaatgatggaacttgtgaaatccaccaagaaaactatgctaatgggttctcattaacactcaaattagattacctgacctctggtttctatttgtaaacttgaatctctaaaacataaagtggccaattcaacattccagccagtatgtaaatcttataatgaaaataaaatataaaaatataaataaaataaaaaaatataaaattagtttttatttttaaccacttaaaaactaaagatagctgaccggtaatcacctttatcatcccattagaagcacatagtaaaaaataagtaattaatgtaatatcatgccctttggtatacagcataaaaaatagaaataaaggggtacatcattcataagcctcatattttatataaattgagcttcttacatttttcctttcatatactccttgtcatatatgtaaatataataaaacttgaaagtttaacataacttttccaatttgacatagaaaaccagattaatatttatgtttgctgaaatttacattctgtcctttcaaaaagtgatgtaaaatagccttataaatctctctctctttcacacacacacacacacacacacacacacacacacacacacacaaacacagataatatagtaggaataagaagggtaagaatcaacagagtaaaaagacaaccaatggaatggaggaaaatacttgcaaatcatatatgtcataagggattaatatccaaaatatataagaaactctacaactgaagcagaaaacataattcaaataaaaatagataaaggatatgaatagacatttctccaagaagagatacaaatggcccacaggtatatgaacagatgcttaacatctctaaaaaatttttaatattaggttttggtgcaatgatacagctcagagatatggatatacagtataacccaaaggaacgtttaattatggcttttcttcattagattttggtgttcatttcatataaattatcaaacatattgatatacatttgtttatgttcttcctcccttagcctcttaatgtctcttttatttctgatatttgtgatttgtacattctcttttttgttatgatctatctggttacaggtatactatttttgctgatctttccaaataactttattttaattcattttcctattgcgtttctgatttatatttcattgatttatttctcatttatttctttcgtttaaacagaaagtttaattcaagactaattttttagacctaaatttatttttccagtttcttaatatagaagcatagatattatattatttcttgtatttaaatttaaacatttaatatgatacattttagagttacttttatgtttaccatctagtgctccttattttttgggtagattccaatttctatctgttattatactcgtgctgaaaaatgaatactactactagaacaggccttctgacattaaaatctctcaagtttttgccagtttcttcattttcttttcatttttgaaagatatttccactagataatagactgtgggatgaagtgattttattttagtattttcaacatatccaataaataactacattgtctttgtcttgcaagaatttctatctttttatctttattcttctatatgctatatcccactcccctgttttccccacccttgctggctttactaattttctcttggtctttcagttccaacaatttatcaatgttttctctaagtgtttgtgtgtttttaaattgttgtgggttttttgtttgtttgtttgtttgtttattttttcctgctacatagtgttgtcttgggttcttggatcggcagttttgtgtgttttgtttttggctttcattgattttatgaaattcttgatcattttctgtcctattgctcttctcctctaagaaaacaatttcatatatgttataacatttgatattgccctatagctgttagatattctgatttatttattctttgtttttcctctttctgattcagtttgtagaacttcttttgattcagattcaggctcagtgcctcaactgtgtcgattctgttgatgaattcactgatggaattttgaaactctgatgtcatgattcttatatgtagctattgcttgaatgctacactttctataaaggtataatgtgacataatctaatactcaattcctgtcaaatgtttggttaaattcttacattcattttggggatataaaaagttaaaagaggacaccggttctgacaaccagtgagaaaaagctgaataatctacaaaattataactattattcaacccatcgaagagctgagatcacaaggcaaacaaataaatcaacttccccagtatgtcactttgaaatagcagagatccagtcacaaggaaacttagcactcattcacaacttatcttcttatgcctccactggatgctttttagaaggatttggggtgctggcatgaaggaggtaactgctgagggatcattgggaagcttgcactacttttctagactctcatatgaagcaaaatctttatgttactgggaaatgggaaacaaactaatctccacaagcaaggcaaaattccactgcttctgaggtcaaaatgtaaccaaaaacccttctgtctctggggtaggcatgctgcccatgggatttaatcaaagaaatgttaatgctgaggaagggtaaaagaacgtacctcttgtgcctgaaggagaagtgagaaatcatctggggctcaggactctgcattctgcaagcacaggtctgataatcctggggaaagaccaggaaactcccatctgtttaagaatgatcaaaaataaaggcaaggtttggcttctttggggaatagacatgctgagaaaactctactcaaggagtctcatgaccctctctgtgcttgtctgaaactgcgactacagtagaacaacagagcctacccaatttataccaccaatttataacacaagcatacctagtgatagtacatttcccatagtattgctgtgatgattatattagacaatagatagaaaacacagtgtataggtgggtaagtcctcagaagacattactacccacaaaaatactccctatgagtaaactaaatatgaaataaatatggttgccccttctactgtaactacaaacagcaataataaatatgcagatttaggaagtttacattgcactctatggttgataacaatataatttttttaatgaagctgttttaacttaaaaactcaacagaaataattatattcattcagatatttttaaaacatccatgtcctaaatgttatttaagaaatcaaaatacatcaaaattatataattagatacatcaaaagcatatttagacacacatctcattgaaatctcgattttgtaacaatattcctcaaaattattgaatgcttttgattggtgcagaggaatatttccatgtaacaacaataataaataaaatcatggtacaagtttaattgtctttgattgaacaatgatgaaatgattcatctaatttgttcattattgaaagtaaataagggccgggcacggtggctcactcctgtaatcccagcactttgggaggccaaggcgggtggatcacctggggtcaggagttcaagaccagcctggctaacatggtgaaacaccgtctctactaaaaatacaaaaactagcaagcggtggtggtgcgcgcctgtaatcccagctactcaggcggctgaggcaggagaatcacatgaacctgggagctggaagttgcagtgagccaagattgtgctactgccctccagcctgggcgatagagcgagactccatttaaaaaaaaaaaaaaaaaagtaaatgatttcacttagagtaaaagatgactgttcttctgtgaaattcatgaaagtttaaaattaaggaagtctttgcatttttggagctacttctttatatgaggatgtgttccaaacaaggaaactaaaaatatgtttccttaaaatcaaaagtacgtttccttaaaattagtcacagggatcactttttaataaaataacttatttaactgtagtgttgttgaggaagaatttcatttggaactacaaattctgttactcatgctttatagtaatagatgatatcattaaaactttttggctctatgttctgtattcagttaaaattaataagatagcaaatatatggaaatataatctgcctgtttgtaacctttatcgtattcaaaattaaaagatgcatttggatggtgtaggtttgtgagaacacagaaatagagttagaagaaaaaattataggtatctttattgatttgtaaaacctggaatgccagttttcttatgtgcttgtaatttttgttcattttatgagcccttatatagcatcctgctctgatcagtttagtgtatttatcattaggctttattaagctgaacagcaaatggacaaatgctttattgaagtgaatagcatattgcagccattatgttcccaagatgatttagactctggatagttattttacgttggtttattgttctcacctccattagacactataactctatcatattgaagaagtagtgtggaataattaccgtggtacattcattaacatgggaaaaaatgaaatgctgattctgaattcccagtatgaaatcccttattgaaacagttccatctcagcatgagctttatgggggatttcataagaggccgtcctctccaaagtccccaaataaagcatctggggatgattctcctcaaattctcctcaaattcaatgttaacctttaagaaaaaccagaagaaacaaatttaaaataccaacaaatgatgcctgttttgcatcattaaccgtaagtgttcacattgagaaatccatacaattgaaacataaaatctagtatctatctaaaaataaaaacaaaaatagaatggaatgaaaaacacatgcaactggagttattaagctagtattgctcttttgtattttatctttctgtttacttataatttctccctattgcacaataagcaatttatagtaaattgtagatcttatatatcactgcattccagccacctggcatttttccctaacatattagcccgataaatatttgctgaatcactatttttgaaaataataaatggctggataagaacatttatttgtaaacctttggaaggagactttttgaatgaaaagtctaccacatgcatatatatgcatcttgcatttgtgacatcttggttaaggggtcttagataatatcagctatgcttccagttccacagtttctaagagctccggtcctgttttgtgctggatattgatgcttttatcttctgctataactgtatactccccaagtctaacataagccttcttgtgtacttttcttattgtcatcaggttagctcagttctttatcacttccaaattgtttaaagtaacaaattaacaactgatatctagctcaaaaacattggtgttttactacattctctttcccttgccatttgaaattaatgatgcaatgacttgtgccatttcttattaaactgattttttttcattgtcatgtttcacatttgtcttgtatatgcctcatggatagatggaatttgttaataaatagctgtttccttattgggtgtgtgtgtgtgtgtgtacatgatgtcaacagaataaagtaattcattttcaatattctatgatttcactatggataaacataaattatgattaattgttctatggtttcttcagtggatgataaaagcattaccatttctaaacatttctcatatcactttatagagtactttttggagatatgcattaatagttggatcaaaattatttaaaccacttcagtaatgccttttccaaactgtgcattgtacatgttcctaaattttgcacaggatacaaaaatgaatgaaaacattttctgtgaggatgggctttccctgacatcagtctattcccagaatccgaatctttagtcattcataagcttgcatttttaaatattattttagttatatctatcctaaaaggctttgtatgctcatcaggacaggtattttaaatgtggaagattattctcctattaaaaagtaaacagagtctttgaatctagaaagggatcttattaaaactgttgttttcctatgagtatattctggaaagaaagactctaccgaactgtcaagagcaattctcttccttcactatttggttattatatatggttagaagattctttcttggtaaaatagtctcaagattttaaccgtccccaatgttgtgcaattagcaaaagtgggacaattttttgacaaaatgatgtttattacatgtgtaaacatttagcattattctgtaatcaggcaattgtatagatacataagagcatgtatcattctgagttagagcaaggattattttgtagtgatcattggttagcatccacatattccattagaacatcctttcagatattcttggatagagaacagaaccacatttttatatctacaaagcctttatgtagtttcagtctatttccatatgatatctgaggcatagatattccatgtttctcagagtaagtggtatctctgtaaacacagaatatgaagctcaaaggctcctaggaaccaacagcttttaaaatgatgcatggcacaataggtattaaggagtcatatctgaaatccaccaaaaaaattttattatcaaaaacgtttaaaaggttgcataataactaagtaaacaatacccagggctaaatggaatacagttttaggccaggcgcagtggctcatgcctctaatcccagcacttttggaggcctaggcgcgcggatcactggaggtcaggagttcaagattaacctggccaacatggtgaaaccccgtctctactaaaaatacaaaaattagccaggtgtggtggcacatgcttgtaattccagctactcattaggctgaggtcggagaattgcttgaaccctggaggcagagtttgcagtgaactgagatcatgccactgcactccagccgggggacagagcaagactccatctcaaaaaaaaaaaaaaaaaaaagaattgaattgaataaagttttaaggattaatgttactatttcgctaagaaaaaagtggtttttatcctagtcactctcctaaaagagggcattataaaactattctattaagtcttcaagaagcacagactcccgactctacaaattccatgaattcagatgtctttcaaaaatattcttatttaactttcttccacctgatacctatgctgggtaatgcatcaccatcagcttagtagctgaagccagccagaaatcatagtggacaagagagacatagcccagcactcataaaattctaaagctacttcattctccacatgaatgaaatctttctgagactaaccttcaattaatgacggagtgtgtcagctgctctaaactcaagtgcagcagcttagaggtgtgtcttgcatccttgtgcatcactcacatttctatcccacacactgctgctaatcaatttctaaaataaaattttaaatctaattatttcacttcctttatttgtctctcattgactcccgttggccttaggataaagcgtgattgccatggctaaacgctcatatttttgaaatctagacttttctagctatctaatttgtttaaattattgctatcattttgaacagtttgaccttttttagccttcagctgtttccaataggagaccactagaaataaccatataaagcaatcagttaaacactttcctcaaaacagaagcatttgttagaaaacatcacatacattgacttaacactgtctttttagtttacgtataagacacaatatgatttgaagaaacaaaaagaaatgcagacaaagacaattagtattagctccttgcacttcagctatttaactattattttttacatttttgttgcagagccaaaaagttactgtgctatattcattatggtatccaaaattatctgaaaccaattacatctgctattgagaaaatttttcataattgctttgcctatattaccaagatttttcttccccataaaactctattatgttgatgtgaacatatatttgtgtctgtggaacttggtttttttgtttattctttggagagagagccattagaaatttataaatttaatggattctcctttttataaattcctagataggaaattactaaattactaaaaaattttcaggaaaattttttagtaatacacttttacatgtataaaggagggaattttattcctatgtatttagataaccaggtcattagtattagaattagcttacattatatagacacagaaacatttagtgtgtttcttattttacatgtcacatgagaaaaataatattgttttgataatattaattacaaaaaacttctgcatgtatctaggctttgttttatctcatttatattcacaaatctgtaaaagagagttgggcaaggttaccaggataacaagtaccagaatcaagtctaattctgctgatataattgctggcacacataaacactgtactaaaatggctctgttgtaaaagatttgccaaatgtgtattttatctttacatttgtagtatgtttatgcatttcattttttcattgtatcagtaatatttctaattttactaaaaaaggggctatgtacacagtagccatttagtacatttttagtttggtgcaaaagtcattgtggtttttgccatttttaataaaatacaaagaaaattattgcttaaaaaataatttcactttacattttcctccattgttagataaaaattatgcagtgaatttctattacattttatattattgggatgaagcacaattaaaattccagaatagagaaaaattaataaaaatattatcaaactttgttcaaatatacagaaagtgaaaagtatttaaaaatcacttttgtagtagtagagaaatgaaagcattcatgtggaatctattataatgtgtttccagtcaagcaaaaccagaattctcctcacgagagagtgtctagatcaaagaaactgcttctttcttcagtttcttaaccataaaattatctggaatacatttcaagctccctgtgttcatataaccttcccagtaggtttattttacctctgagcatctggttattggtcactgagaagaaactatttcctagaatctagggctagtcgctatgggggaatactcaacatacacaatagcaacatagattccctgttatacaatgaagaaataaggtagaggatctcttgtataaacaggtagaatgaaataattttaggtggctaagaggatcacaggcagagatgctgataattttaggttgccatagagacaattagcaggattgacacaattatactgttcaggcataagagtagaatgttggaagttatacagaaattaagggaactaacagaaatgtaggcaagattgaatgagatccgggtacataagcatcatggaggctgaatgaataatcacagcagcttaatgtaccatttaaaggggatattgattgtttagaattataaaaatataatgtaatataaataaaacattacaaaatatatgaccatatttagagttagttctaaattaaaattcaaagtaattgtgtagggtggtcattttctgatctgagaacctcctgataggtgagttgtggagaggaaggaacatcagaacatattcctatgcttctctagtgagatcggaaagattttagatagtattcaactccatgacattggcaactatacccagacatgcaaacttttgatgcaactatgagccatctttatggctaaataagttatagaggctttaaagtaaatatgtatgaactgaatttgtatttcctcaagacagaaaaaaactactattcctttagcaaaaattattctgcactgattattattttcaaataagtaaagcttaccatgtaagcaccatgtcctttaaattaatgttgaatattttgaaaatgatcctttacaaaatgaattgcaaatttttatttattttaaaaaactgatatttatcctaatttcagaatgactgacacacaatttcaatatatgtacacactctcctttaccttgtattccttctttgtggatgtcagaaatcagtttctaaccctccttctagttataccctacctttgaagatttcagtttactggaatctgaaaacaaaacaaaacaaaacagacagccatacttcttagatcttgtataaatgagcagtaaagaaggtctgagtgaagatttagcagaacttgccttttgccaacagaacttcatgtatctgactacaagtaaaagttggaaaatcatcactaaaactgtaacagaaattcaaggactaaattgaaagagaagttgaagtttatttatggtattctttccagagagattttatagagccttttttcagtctttcccaaccatgtttatttatgttaaattaaattattggagtttttttttagaattcttatagaatatatgactaaaatgaaggataataatataatttgacatttaaacagttttattgtgaaaatgaaaatgaatgttgttaatacttatgctaaaacagtaggcatgaaatgacactgtggctaaccagaagggacatatattcacaccacctaaatatgagacatgtttgttaaaagatcctccagatatctttttccagtgaaattaaaaaaaaattacttaatttatacactttcaaatattgtctttttttcacattcagctgctaagttatttgtttctagttccctaaaattggcacagagggaaacaaatagttaaaatcacatttatcccctattttttaccttatatttatataagaaagtcataaatctttctttagtccttagttcaaagattacttttagtcttcttttacaaataaaagcaatagtttggagagtgggaaatgagataggataactttcctctggttaaaaaaaaatctttgagactttgttgttcactttaatgcttcaaaatacttccaaggcgtctttgaaggtttaaaaaaggatttgtgaattttttatggaatgccacttagtaggtgtcaaaacatatttagcaggtggtatctaattttcattttaatgaagctaatcttttcagactaggataacataaggttttaccatctgtgtgtatcctatttagtttatccaggttggagaaatctgaaagaaggtctgtgaaacaagaagctagatgttgttcaacaccagccttaactacctgaaagcattactattttaaaaattaaaaaaatagagaatacaaattttagtatattagcctataattttatctaaattatatctttgtattcagattgaatgatcttttacagcattacttagaaaggctttacatgtaagacatcttaaaatctagctaagaattttctgaggagacacggtacaaatgtgtttcaagagccagagaattaaaaatatgttgcacttcttcacctttttctctcttgcagatcatcactaattatttccctgcacaatctttttttccagctttgcttccagcacatatttgaattttcctattgacttcttttccactgcttgcaagaaccttttcctttatggtcatatataaatttagtacatatttaaaaattttacgtaaaaggatcgtgccatatgtttgtcttttttatttttggaaataaaaaattatcattgcttttcaaaagtgacttcttaaatcttagctgcataagtaataaatacagctgtaaacattcactatgtactaaaatttaaaaagcattcagaatatcatgagctcagtgataatcaaaaacaaaactaaaaaagaaaaatacttcattgctcaaaataaaatgagatatatagaagaagataaggaagacaagaagggagaagtagaaaagaggttataggtaaaaaatggagagaggaggaggaagtcatcccacctttgcataaatgttgtagttgttgttgctttaagtattattataaggtagcacaaggggaataatgtgattggaattcaagagttagcattagtaaattggtcccaagtcagttcacaattggattgcaaaatatagtgaatttcaggaacttatttagaagaaatctaaaatttattagaaatgatgaagaactttgtgcagtaagagcatatatgtgccaagtatgttccagtaaagggcaattaagggtatatctgtcaattaaaggcatttatatttaaataacaaagctaaaaactgattatgcaaaagataaatttgttgaatacacgaaaaggataaggtttttaattttaaaatatcatttgcttttaaaaataattccttgattatttttaaagttttgctcaattggattcaattgatttaaaaaattaactttcttaatgaatggactaggaataaataaataaaacatgacaaaaattaaaagctgcttgaattgtgagtctatcaggtgcaaacttaaaacatctgtgagactattgtataaatttacagggaagcataatcccatcgacattcagttctataaatgcacaaacacatattccttcagaatgtcctccaaaatatatattaatatattatttaccatgcatacataatcattcatatatagtgtaggtagtatgaatcatggaaatttgaatttatgagtatgccaaatcatgtaggaaatgagacaagaacttatttaggtaaaaaaaaaaaaaaaaacaagttagaagaactgtgaccataatattgtccaattttgtgacctgaataaaaagaaaattagatttcttaaaatcaaatctagggacaatcttaatataagtatttaatagttgtcttacttttatacagatgcatagtttgaggaaataagatacattgtagatatgtatactacctgttttctttacatttttccttttttcttatttttatttgatgaagttattgattacatttcagagctttatatttatcatttgttcctttccttatattaataatcaaacatgtatctcctgtaatatttgaaagaaagagagaaagtatatcctgccctaccaaaactttgattctccagcagtttatatttgatctttggcaagatttctttagaatgttgttatttccttattctgctgcccattcctctccatagatttatccaagttcttttaggttgttttctctatttgttcctaagatttattcaaacaatttaatactttccttcaagataattaatagcttttactttatagactggctcttctatatttagaattattattcagcagaaataaaattccaaatggaagaagctcatattgagcattttaaataaatagtgtaggtaggtgatacaatctatgaatgttttgtttatttatttatttattattttgagacagagtcttgctctatagcccaagctggagtgcaatggcgtgatcttggctcactgcaacctctctgccttctgggttcatgcgattctcctgcctcagcctcccaagtagctggaattacagggacgcaccaccatgcccagttaacttttgtatatttagtagacacagggtttcaccatgttggccaggttggtcttgaactcctgatctcaggtgattcacacacctcagcctcccaaagtgctgggattacaggcgtgcgccattgcgcctggcctatgaatgtttttatacatccaaatttctttcttattcctgacaaataattgatattttaaattcaggattataggatttcagtcctgttctttcattaatatttttcccatgcaacttattattgtggttgaaaagttgacaacaattcgttctctgtcattttttggtctaattcatcggtcttgaagtgtgcaaggttttttctttgtaagtctcaggcattttactaggatttgcttacctgtgtttctttttttttaaatcttttatccagtaacttagtgacccctacctagctgtagttgccaatatcagcattgttttcacactttaaaaaattttttctttcataatttctatttttgtgcttcgttttgagatatttcctccacttgatctcccagcgcaatcattaagatgtcattagtgattcttctgttctcagtctatctacaaaagttaaattcttttaaaaaaaaacatatttttattcacattcctttgagaactaaatttttaaaatatcttctgtttaggtggacttaagtgaaatttctctgaattcccttgttgtttattcaggctggcatctgagttctctagcaagtctgtttcatttaaaataaatacaaatacttgtgtttttacttattattcctgtcttttgctgccattattttgcctcaccatacaccagtctgattgttggaatgctttatgttgctaagccctgaaattggtgggctgtctctggctttaaaagaataccaggtggtatgaaatctttgtccgccagaagccaggagtaatcctgcctgatacctgattttctcagttacaaagctagggcatttctagccttaggaatatgggtgaaacaatggtctagaagctcttccggggccataaaaaccactaggtcttttgggtgatggtttcttaagtgagtattgcatttaattaatcagagtctcccagtactattcaggttaccagagctccctttattttctaagattcattcatgttctgttctttgttgcttatctttacagctctggttctcattctttcattagggcccagagttacgtgctatttttctgaataccaatagaaaccttaggcttatttcagatgctctgccaacccctgaagattcttctctcaggaggggtgttggttaattgaatttgattaggagggaaggacaacaggaatgcattcgggaattctcaatgatttgttttcagaagtatactttaattgacagtaattactgtcagttgcagtaattgattgatacaggagtagccaactattgtgtggcaaggaataaagtgagtgctggccagagcatctgtgagggggcaggttatgccagtgggctcattttaccagcaattcaattccacattcgttgaacacttaaagtatgttctaggcactgtatcaagctggtccatgaaatgatattgtgaataaggcaaggatagtgctttcaatgtgcccacaaaacagggttggcacaggaggaatgaagggaatggagagcatgtcaactaatggggggtttcagctgtgtagtcttctccaagagaaatgcttacaaggtaaagcacaatgccacagcaccatctcattctgccttcttcctctaatgatcaaggcctgtaagctctttagtaacctctctgatgcaggtatcacttcaagcatcagtgaacaaatcatgccagcagcctccagccttaccctgtatgacctggttgcttagcactgccaacaagttcctactaggtcggagtgtactaattagtcacaatggaactgttatggatctatactgtcagtagtgtttaaagtttcttcttcctgcacttttaaaattatattccaaccaagaaatgattgtttacatatatttgagattgtgacgaatatgacaataaagacaaaatcatcagatgacatatgaaacagtttgatgattttgtttctggatataggcatagaatattttcatgaattaaatttttaaacttactttccttcttgaatcatggtaatgtaatattttctctcctttatatgacttctaagcagagtagcttaactaatatatgtatctgtttattaaaaaattcctttggaaattgttgtcaaattatgaattaattagtattccttttaaaaaaataaaagactaaaaaccaaattatgatagttaccacaaagtgagcaagtattttaatttttttaacatatatttctattgcagttttcaaaaatttcttttctattttataagttcaattaatgttagaaagaaaaacatcatctgcttacataaaaattacatgttaactaaaagctgtattaaaaagtgtaattcattaaaggtaatatcaattattctacaattattaggggctaaatgcaaattttcttgagaactgcagatgatttcaactctcggtaatgttgttgccacataaaatataaaatgagtaaagattttaagagtttattttgatgtttcaaggtagtttgattaaatataacataaatacatgcaactacatgatacattagaaagaaatgttctgagtaagaagtctggtctggaacatcgagggtatagtttttatgtaagtgtttttaaagtagaattaaattttgatacaaagatatgttgttatccacccagagttcttggaaatatattacagcagaaataatagtataattttgcaaataaaagcaatgaactaatgccatgtgatttcttttttttttttttttttttttttttttcctatacgaagtcttgctctgtcacccaggctagagtgcagtgcggcaatctcagctcactgcaacctccgcctcctgggttcaagcaaatctcttgccccagcctactgaatagctgggattataggcgcctgccaccacgcccagctgatttttgtatttttagtagagacggggtttcaccatgttagccaggctgatctcaaactgctgaccccatgatcagcccaccttagcttcccaaagtgctgggattacagacatgccatatgattttcaaaagcaaagataaaaaattaaggtttcttattacaggtggttttaaaatgagttccttgaaatgtggataccttgatcacagttttatgtaaacgctttctttctagaaatccagaaagcctgtactaattatgtacatgctatatagtatgtaacaacatgacaataaaaagatagtatcttccattctcattatagttagcaaaccctaaattttaaaaacaatatttctgcttgaatttcagagattgtaatattaaataagtttagtttctcctttctgttttctgattcttatgtaaaattagtttactaagctcattttagaattaagttatcaagatacagcatattggcattgaaaattaccccacctcaaagagagatacaatgaaatcatccaatccaatttagtttacactatggttctatccaaatcccttggtgtcatttccgttttttatgaggtttcctaaaaagatgtcccaatattatttgaagtatgtgattattgtgataatttgataatgtatcactaaattgtttccatgatccttatagctgtgcttctcaatccaatgcatcattcagttgtttgattaaatgccaatgctgtctgaaatgctgtctgatactgagtcccagaacagcatgatttccttcccactgaacatacataacactgtataattttacttttcttataacgcttatagttacaacttaatgccaggaattatttttcctactttataaagctagagtaaacctgaaggaaagtttttctacttaataaagtgcccagggatctctaacagatctattatagaataatcatgaatatttattgagcttaatgaggtagaggtatatagttaatgaagaactggaggagctcaagaagagtaaacctctctccccaatctcaaaataataacagttagattgaaaatataagaaataaaagtatgaaaatagcaataaaaatttatatatcatttcaagaccaaaaatgtgtagtacattattaattgtcaactacgtaaagcagaccataattgatggatgacttcatagaaaagaaaaatcacattagggtgctgatgttgagaaaggatttttatagaaattggaaaagtaattttgatgaatgagtaaaatttccatacccagaagagaggagaaaagggttttctttgtgtatggaataatgtaagcaaagtcatagaggtgtgattctaagagaaatcacatgagatgagattctaagagaaaagacatgagaatgggagaaaaacccaaattcctagaggcctctgtgtggtagggaatattacatgtcaggactgtgtgctacctaagcaagttggaaaataggattcagggtggtggtgataaggagacagctgtagaaaaaatgatcaaatctacagactctttgcaggaatatgttgagattgactccagaagagaatggaccaattgtatttggagttcctgtacctaataaacaacataattttctcatgccgaaggaagttaataggaaatctttttctttcatatgttttggtgcagttgttgagataatttttatcactaataaggttcagcctcttcaactagaaaagcacaactcttcctgatatgcttagggatagatcatgaatatttggcaggcagtttgataaaactcttataaaaaaacagataggttcctaaaataatcacactggctggcatccaagatttcattaaaatcgtaccttttctatcttgcttttaaactgaaatttattttgttatcaaagagaaaacatttcattttgggatatcaaaactttaggtgcatctacatgagccaataatattcagaatttttttccaatataaatatttatactagaaaataaaattgtacttgttttgtaccagaatacaagtcaaactaataataatgggtccaaatattgcaagaaacattttattaattaaaccgtcgaatcatttaaaagagaaaatgtaacttaagatggtgcgaagatggcatcaagtagtagagttaatctacaaaacttgagagcttttacactacataaaccatagtggctttttgaatagcctcataaaacgcagtgtcattgccattctgctcacaacatgtggattctctcttctgcaaatagaataggactcttggagcaatcataatgtaagcccactgaattttctcatttattttctgtacttataaagaatgctgtccataactttttatttttaatggcctggattaaatggcaactttctactgctgacaaaaaggcaaaatcctatgaagaagtcagagtcatatcaagtgctcctaaattataatatagatcttttccctatttttcttctttcttccttcttcctttctttttgcaagttaacatatataaaacacctgttcttattcttaagcatgcacagcatagtgataaaattttgcacagtcaatggtcatgatgcccacgggttagtgttgtaatagataagtgaatttaatgccacatgtgccctttgttagagtctggaaaacagtatgttaggggagtggaggagagggagttgtgaggtgacaaggaaagcttacaagaaagacattgctttaatctgttattgcagatgttaatcagagaagacagtagggataaagtggaagacccagaggacaggactacttggcaggcattctaaatttttgttgaatatatcttttagtgcaatgtatatctttaatcctcagcagagctttatattgatatacacttctaaataagtattgttcacaaaagaagagtgtcaataagttatatattctaccaccatttcctgaaatctctttttatatttgagatcaagaattatagaagctggcatttattatattgagcaataaagatacttcaatcaacattaaatgaaagtaggtatagattaagaatggcagttcttctgcatttgcatattgactaagcacatgaaaatgtatatattgaattcatggactattttaaaattaaggaaacactttggagctttatatagtgataatttgggcaatttagtgtagtagtaactgaattctagaagtacatgtggccaagattcaagggatacaaaatatagcatgcagtaaaaaaaggaaaatcaactgtaggcaaccagcttgatgccagaatgtggtggtgggattctaaatgattctgtgataaatgagttgagctgctttctaggaaattggagaggagaacaacaatagctttctggacagaactttaagtgactatgtgacacaatatctgtatggtcattcaaagtgtcatggatgcataaaacaggttgtattaagtacaattttaagcaaatgtgaaagagggaagctgtttttagaaaagaaatatataataacattttattggcatgagcaaaataatcagaagaaacattgatggccagttgattatattgggaaaagtttgtcatgactatgaagagtactgaatcttgttgaatgtctgagcacatgacagcttgaaaattgtcttttttttattagattaagagaaaatgattttctggcatgtattctcactgtatcccttacctatatacgataatacatttctatccttttcttcttgctttgctgaaggcagttattaggaattggagaatacagagcattcaggtattcccaaataatatacattcacctcctttgagacaataggttgatgtggtatgtgtcttcctatttctactcaggatataacagaaacaaaaaggtagcaattggcgtcatcagtttctgaaaaaaatctttcattttttctaatatgtcttttatttatcttcttcatcttgttctctatttctctgtcagcctcctgtgcttctactgctaaatggattatttcctctaatactttagcatccctgcctcctgctcaggctatgtcactttccctccctaatttcactgcaaatctctttgaaaaaaagcagtctactttcactatctctattcttcactgtcaattcatgtgttaatttattacaatctggcttccttctatccccagcattttgatgattctattctgtcagaatattgtgaggttaatgtttttgatagctttacatgcagtatttcacttcagtcccctttgaagagtgtcatatatttcctgcagggatatttctttgaaactacagagcatatcacagctccttctaagatgatacaccacttggatgtcctgaaaaaatctcaaactcaagacattgaaaatgaaaaattatattatttcccactgcctactccactgctactaatgtgctttctcgtgtataattgtgtgtgtgtgtgtgtgtgtgtgtttgtgtgtatgaagggcatcactgtttacttggtcctcaatataaaacctttggaatcctctccctttcactattcctcataacccctatgtagttaatttctgagtccagttttttttaattgaataaaaatttaaaaaataaaaaatcagtacaagagctacttctgtaaaaactctcaatattgtccttatttttatctatcttagcagtgagtacttaatatctttttttcagtttttccttcttcctttcctcttttacctgatgcaatagctttataacagtgcttcttgcctcagttgcttcctggcaaacaacatataacactcttggaatgtgagtctcaggtttccaacttcatctcaagtcattcttcaaggtattctagtatgtgctaaattcacacagcattagtgccatgtttgtagcaagccctttcatatggtccatgctttgggctgtgtagcctctattatgtagaatacccttccctggctttactgcattgtaaattccttcacagcacagtacaaaaaatccacttctttcataaattatttctgtcttaggcagaaatattctattttatttattttagtagcactttttgcagcatcatattttactggaaggtccttatgtttctgaaactcaaaatagactatttttcctaggaacagtatttatatcttattctttttgtaaacacagtttttgaaaaagtgtctggtacatagtaggaattcagaaacagttgttgtataaagtactttcattatagcacttattgcattccatttattgattcaattaacacatattcattgaaaaccttctacataccactcatactacaactgtgagtggtatgtagttctagtgcttaaggtatggcagtaaatacttgataggacatattctatcggtaaatactgataggacatattctagaaggggataagggaagaaataagtactatgaagaaatcaacgaatggtatattttgaacactgacagatctaagtgttattttaggaagggaggtcatggaggcccttactgaggaagtggcattcagttgagacctgtacaatataaaggagcaaagatctaggagaagacactgagaaagagcaggcacaaaagccggaagggagacataagtataccatgttgtaggaatggcaagaagacttggtgtttggagaagaggaaagaaaagttctagaagatggtgcgagagagttggatcttgtaagtctgagtaaggaggttggatttcattctaagcaagatgggagaactttgggagatcttgagcagggaatggcagacaatactttttttaaaggatgcctgagagaggaaagagtttaagtggagagaacagttaggaggctaataaaatccccagttgaaataactgtggtttgtaccaaggtagttgctgtagaggtgttgagcagtagttagatccaggatccattttgaagatgtattacataaaaataactcaggaggcttagacgggaggcacacttgagcccaggagtttgaggttatagtgagctatgattgcaccactgcactatagcctgggcgacagagtgagaccctgtctgttaaaaaacaaacaaacaaacaaaccaaaaaagaaagaaagaactgatagattggatttggagttgaacataaaagaggagtcaagaataattactgtgtttataacatgagcaataatataaatgacgatattattaaaaatggacaaaacttcagaaaaaaacataaccattagtttacttgtttgtatctccaatagaatatgaactcagtgaaggcagggctcttggcttattcttctttgtatctttaatacagtgcttagcagaagtagacacttaataaaaagtgatcatctctggatcttaatcagcaaacaactattggcactattctcactttttaaaaaattatctttccttcattcactcaactgatgttattgagtacctactaaatgcactgaggcaaaaaggatatattaatgaataaaacagacataaatgcttgttctcatggaacctatgggtttataatccagtgagatgatttctatgatataaaactaaataaaatatagagtgtattagattgtgataagtgcttcagaaaagttaagtagaaaaaggacattgaggtagagtagtggcattgcaaattaatagagtggttgaaaagggcatttctttggttaatacctttatgaaatgagactttgagataattaagtatttgagtaaagagcattgtggctcaaggaaacagcatgcacagaagctctgagatagcagcatgctcggtatattgtaggaacaccaaaagcccagtgttgccagatcatactttaaaaaatagagcagaaaaatgtgcattccaagggataagggaaggccaaattatgaaaagccatgttggctactgtgaggattttgacttttactctgagaaaaatgggaagacaactagagtttttcagcaggctaatgtcatattctgacatatactttcacagaattcctctggatactgcgttaataagagactgtattgggttggaagggttgaggggacagaaataagcaaaacaacagctacaataatctgagagggtggatgcccagtccaaggtggtaatagtgaatgatagtaactatggtttaactgtggatatatcttgaagtcagaatctatagaactttctgataggttgatttggggcaagagagaaaaaaagcatataaggttttggatctgaaccagtacaatggatttgtcatttactgagatggagaaatcaatgaggaagatgaggagctcgtatttgaatttgaacctattgaatttgagatatccattagacatctgattatagacagcacagaggagttttccacataaccctgaaatacacattgcaggctaagaagtgtccaggctagaggtatgaatttaggagtaatcaaattttagctatttttcaagtcgaaagactgggtatagtcatcaagggtttgatagaagcaaactctagggaagttcaaagttaagaaatagtgggttgtgaggaaaggagaggggaagatggagagagggtgagtacaaagttacaattagatacgaagaatacactctagtgttctattgcacagtagggtgactatggttaacaataagtcatagtatgttacgaaatacgtaggaaagagtttggatatccaaactacaaataaatgataaattcatgaggtaatggatacccggattaccctgaattgatcattagaaagcatatatacgtattaaaacatcaagccatatcccataaatatgtacaattacaatgtgtcaattaaaaaaaaaaaaacagtggcaataagaaggaatccagtaaagagtgtgctttctaaaacaaaaaccaggagcgtgatgtcttagaagtcaagtaaataacatacttaaatatggataaagtgagtaaatatgtagaatactgagagtttggcttaccataagatttattgtctgttttagtccttcctgtattgctataaacacatacctgaggctgggttatttacaaagaaaaatggtttaatttggctcattgttctgtaggctgtacaggaagcataatgctgacatatccttagcttctaggcaggccttagggagcttacaatcatggcagaaggtgaagagggagccaacacatcacatggcaagagtgggagcaagagagaagtggaggaggttctaagcccactttaacaactagatcacacataaactaccagagtgagaacacacttatcaccaaggggatggcactaatccgttcatgaagaatctgcccccatgatccaaatacctcccaccaggtccaccgccaacactgggaatcacattttaacatgagatttagaggagacaaacatccaaatcatattatcatccaatctggtacacttctgaaaatgaaaggggtcactattagttacatctaaactataaatacaaactggtactctttcaggaaacctggaatatatagtcaccaagtgacatttcaagtatgatgaagactgataaataatcgttgcattcagcactgtagagatcttgattaccttaagaattaaaatattgttaaaatattaggattaaaagtctagttgaatcagttcaagagaggaaggaaattggagatagtaggaacaagcaaatcaatgaaagttttgctataaaaattaagtggagctgaaggaggttgtggggaaaagatgtttggttttaattgaaataaaatacacataatgtaaaattttctagtttaatgattttaactatgtgtggtagagtgacattaattgtatttttgtgcagcaatcactaccatccctctctagagactttttattttaatgaactgaagctctgtacccattatatataatacctcagtctcccatcccctcaactcctgacattcaccattctacatcccatgtccatgaatttatccaagacaatgaccattctatttttttttttcttatgtaaggtactgtaggtactttactcactgtggatacctcatacaagtggaatcatgtagtatttgtcctttgcaattggcttatttcacttagcatagtatcttcaaggttcatttatgctgtagcatgtttcagaatactcttgcttctaaggctgaataatatttcattgtatgtgttataacatattttacttaccatttatctgtctatagacatctgtgtggctttcaccttttggccgttatgaataatgctgctctaagcatggttgtataaatattcattcatgtgagttcattcaagtctctccttttaattcttttggatatatacgattattttaagacaaaagaaattctaaaacatagtaagctttctctatgtctgtcagccagtaaagaatctggaaaagagatgaattatttgtcactatgtccagcaaatagctccagatatcatttaggaaggaaaattacaaacttaaatgacaatgagcctttataaatgctttaactaaattaatattttggggtcctaggtaggtagaggtatacactatgattaataataaagcatatttattgtctattcaaagttctgtttcattgcttggtgcctacaccttagttctgtgtgttttcagaatctaccttaatagatattttagcttatatctcaactggcaaatcatatcctgttagaagtaagaatgggatagttttatttgtataaccactaaagattgaccctgagaacgtaattatatagttattctttttactctgcctcttttttagttggctgtaatatttttgaaaaagtatcattttaatagatgtgtattgtggttgagtcttaaagttttaacttactttgaattgagtgagacattgagtgaacacacatttgtgaatatatcataaaacataagtacaagattaacatatagaatggctcctagagaatactttagcaaatagtgtaaacagcacatttgcaagatttttatagcaatgacaaccttcctaaactggtgtgtactgtattcgtgtatatggatttgtatcattgttaattgctgtgatctttgtcaataaaagctgactctttcttaattaacctattgcccctatcttaccaatagcatcagttagacattacaacattattattcaatacagtggaacacattttgtcacaggattctggcaccttgaaattgatcagtacaagcaggtttactagagaatgaaaaattttggccaagcttctgtttctatcacacaccatgttctgcttaattctgggaactctatgcacattgacaggagaaagtttgagttcctggagtattgcacgttcttgtttcaaaggtttcaaagtctttgcacacagggccacctttactcaaaaataattcctcctctttgcctctatttcaatggtgaatttcacaaagaagtatttttttgactgtatcctaagttagctccctcttatacaatatcatagcacaatgtagcactctttcctagtacttattatcattgtaactttacattttttgtatggtgatttcactaacctctgcttcacctacaaaactgtcagcaccatatgggtagagatcctgcctgctttcactcaatgctgcgtccctcttccttgcatagtgctggatactgtagtctgtactcagaaatatttattgaatgagttgaagggtaaataaatgaatgaatgattgataaagatctataaaggaaaactattttgaaatatattttatgtgagtttaatgtactgtgtagacctctaattagaaagcatagcatagaacttggttaccagtttcttcaggattttgaagacgaattgaacaataaaaagttaagagctgatatcaaggacctaagctgtattttcatttcatcaccttgaattgaaactttggaactgtgggacatggaaggaccaacaatgggcaggcatttctcaggggaagactataaataaaaaacatgaaaagggtttgttgtttctttactaaactgcttatatgagccaactgatgagttctgttttacccataacagccttaatttcacatagacagcattatattattgatccacatattttattgtattctgaatctgtcatgttcaacccttatgtataactgtaatttgatagtacagcttattttataaatcactttataatcactttgacagcacaagttactttataatcccaataaacttgagatatatgaaagtttattgaatttattattgatagtgtgaataagaaatcatttagcacttctatgactcaggtactgatttaggtaatttacatacatttttagtttttaagatattttacatttcattttcaactaaatgaaaagaaagtctgctatttccataggctgtgaaaatctaatgttactatactcagtcaagtttaaatagatatactgttactaccactgctagctgatgtgtcctcactgacttcacaagttttcacaatgaagaatgatcatataaaatcttagatctttctatgaagaattacacttctatagcaattggtatccatatagactatgtgacaaaaaggacagaagtggccactggtcatttccacataatacacatgttaaaactgtactttgctctatggctgctgctgctgctatttgtaaaactcagctctgcttgaatccctgcctcatagtcacaaagcctgccagactcctttgatcacaaagttaccccatgcctgcagccatgctctaagttggtctgtctgtttctcttctttctaagcagtgatattagaggttgtggctcagtatgtgtataaagtatttcttcttcttacctttttgcaattgccctatatcaggtctccatccagcagcggattggattagtgattctccacaattgccctcaactatgcagaaataccaagctgagggaagtgcagtttcttcttgacatagtcgatacatataatgttgttatatttttatattgacgtgatgacttagtataaattatacttcatttgtagtttttaatttcatttctgattccactatgagaatgaggaaaaattgctaagctatattaaaattctgttgttcaccattttttatttctgttcctacatagaattcaccattgaaatccaattaacacaagtctttaataaactgtgatcactgtagtgcccgtcaccttgtttcttaaaactaatcttctaattaaactatcaactaaaatagacaacataaaagacaataaattatttccattgaattataaaagattatattgaataactatatgtttttcctctgggatctattttttcacttgttaatttattacaaagaggttggatttcagctcagaagaatctcatttcctggcaattataataagagagtattccaaccaatcaagaagtccagtgattttattaataatgggtttatcctatgtgactagttcagaggccatcagataactttcgaaagttttatatttgttctggataaaatctaccttgggtattgtagaagtatattcacacaaatggtacagctgctacaatcttgttatttatgtgatatttattgagtacctactaacggttgagctttgttttaaataattggatacattctgtgattaacagagaaaaaaagaatattgttcttttgtttgtcgatgttacctacattttgtgactttctacgaaggcaaattattctgacactagtttctcacttcatttgtcagaatgattaacatttttacatagaaagtagatttttttaaaaaattgatagtcaggctcatatggagagtcctgcagaccccaaaccactcaatgttgccttccttaaaccatgttactttatgtttttgctagaaaattatcgttctgtcagatacatgtaaaagaaaagtcacacaaggcttgtagttgggatctttctgttctttataactcaaatattttgtttgaaaattatgtggaggaatgcttaacgtatgctgcagagaatcaactcaactagccctaaagggaaagactggctagtacattttgctttgttaaactttatttgatggtaagatgcagttttgctataacttttgaccttttggtttataatgtcattcatgttgtatatatcctttattctataacaattctttgaattctaggagtaactttgtaggcaatcaaatacttaaaataaccaacaacttctttactataacatcattaaaataaaccacatttaatagtaggcaatcaatgatgttcagctttgacccagagttgacccatcttctctagtaatagcaaccctatcgtttcaaattacaatcagttcacaaaatcattttaatgatatcagattggaagaaagccctgtgtggtttgacagctgtgctctatatttaagctcagataaggctcactttaaagcagcatgtctttgtagtcatgtagctccttaatgctgtgacacgtctgtgattctgtgcatcaatcatggcggcagaaaaccataaccttccctaagaggaggtgccaggcaaacaggcaacgagatgagtgttgccatgtttcggttactgtgcaggcttcctgcagtgtaaattcccaatgtcccttcttagctcccactggctctcgacactctcatcttctttataccctttccaggaatacagtctgctcttcttcgttaggttgtgatggtaggtagtagattctttgcctaattactttctttctatggattttattatttataaaaatataatcatagctctgttttcattttaaggatgtgactaataagcaccattaacaaggtggtaagaaatcatacagagagataaaaagagaaacttataaacatatctgggatagttacatattttgaagacttttttcacttcttatagtattgctctttgcttgtataataatgaccaatttgccacgtactggatgccctcgtaggcttacccagcttttcaatcataaagtcagaattcaaaccctactcataataagatcgttcagcaagacggctcctactctttgtagcaaatagtcccaaaggtaaatttaaagtgaaacaacaggaaagaaattagttcctcccatttttttagtcatttgttcatttgctttatttattcaaacactccttcatttttcactcatgatagaatatttcataatgttatctttcatcatatttattgagagctggtaaacaaaaatgaaagtgttcatacctttgaggatataatgatactttgtaagcaaaagtcttggaaagcttctcatattttagatattattctgttaatttgtgtgtgtgaatgtgtatgttgttaaaaaatattaaatatctttcaactatattggcctcatatcttctgtttccttttaacgtatatgaacaaggtcagtcataaatagttgaaccaaaaaatgagtagtacttgggtttaattcagaagactgtgccttcagtcagctacatgaggtagtagtttttaccataacattttccagagttaaaatagtcaatttttaaaaatttctggaagtatatgaaaagtacttttaaggaaatgttccaaatattaatacatctcacttggttttccagtattgagtgccactatgtggagacccacattttgtgtccatatctataaatcactttatcagcttttgaggtctatcaaagatgaacaatattttcagataggcaaaaacaaacaaacaaacaaaaaaccaaaaaaacccactgtattgtaatgcaataacaagattttataagtaacttctagaggtaaagtgttttctcatcaaatgaagaaatgaacttctaaacttatatcaagtagctgaacaataactacttttccccacccataccccatttctacaatcttataatgagtgtgtctgtgcctcccatcttctctctctttctctctcccttttcttctcctactcttcatccccctttttttttctttctctgttatttttttcagagcagatttaggctcttcagtggattctttgcctgataattctccaaattaggagttaaggtaaaggttagctcaacaggcttattgctactataaattaaatcctggccctgccaagatacaaaagctcagaatatacctgcaccaagatccaatttgcttttcacagatttaaaccttacaaggaaaagccttaagttagtgcatttggttgagcactgaagctggttactggtgaaagttaaaagaagtttaaaaatgagaaagacaaatactgcatcattccacttatatgaggtatccaaagtagtaaaatatgtagagagagacagtcaaatggtggatgccagaggattgtgggaggaggaaatggaggattatttaatgggtatagagtttcagttttgcaagatagaaaagttctggaaatttttttttcacaacaatgggaatacacttgaaactattgaactgtacatttaaaagtagttaaagtgtaatttaccacagttaaaaataaagtaaaataaataaatacataaaaggtattgacctttaagaaatagtttattccttttaaatgcagtcatttactagaatattacatggaatctcttcaattatcttcctttttctgaaaatagacaagctgtaccattctttgaagcaaagtattataaactatcttgccacatagtttatcacaagtgatcagttttgaaataaatagcctattgggataaaacatcacatttactttaatccatatgaaatggttgatactggataattttctgacacagagttttgaccaatgtaagaaaaacagaattccagaaccccaaattgaagacaaactatgatagtatgtcatagctggggtgaggaataagggaaataaatatgcatattgaaatacatgtatcaaatttaacctttatttagcttggtttagttataattttaattatttattcaaataatactcaatggcagcataggatggcatgaatttttaaaaaattatcaagcccaaacctgagaagcatttgcctaaaagtcactaaagaaaaaagtcatttaattcataattttgctaagggaggaattctacccataagttattgtgaagaacaaatgagatatgccattagtaattagatatttacctgctataatatctaaaaattaccctacctagaagaaatgtaaagttttctttatttcaaagttctcagaatctaagtactaaaaagtaattcacctagaaaacgtaattttatgtgcaactacacaggcacataaaggccatagtcctaataccatgaattagagctcttgtactgaatccctctgggtcttcagagaaccataactaataggatatgcatatatatatcttatatatgagattatatatatatatgtatgtatatataagagcgagagagagattgctttattataggaaattggtttacatatttataaaaaagaataagtcccaagatctccatttagcaagctgagacccaggagaaccaatggtgtagtggtttcagtctgagtccaaaggcctgagaataaggagagctgatggtttaagttacagttttaacctgagtttgaatacaggagaaaactgatgtcgaggctcaaatagagtctaggcagaaaaagtgaattctctcttactcagtcctttggataaggtccacccatattggggggcggaatttgcttttctcagtctaccgattcaaatgttaatctcatctagaaacaccctcacagacattcccagaatagtgtttaaccaagtatctaggcactccatgaccctttcagtttgacacaaaaaagtaacctttacaagtccaccctttgtcaacttggcacccatatgcaactccttaagtcatacttaatctccaaatgaaggaaataagaagttcataatttttcctaatatgatacagctatcctgtgtacagttgaaaatgtactaaacccttccccagaagaggaagtagagttcttgattaatgtttactcttcttcaggataatgtaatattaataatacttaaatattagaatatgaagtcaacataccttatgttacatgatgaggaaataagagaaggaagaaaacaaagatattttctatacacatgaacatattgataaaaaaaaacaaggaatatgtatgacaatgacagtcctcatttttgtaactgttcacatgggcatagctggtgtttataactaccttcttccactgccaattttgtattctctttgccttcagcaagcatctctgctgattgtgtttctttaccaggtggagtgacctaagccctgcctggatgaggttgctctagttttccattgatcttaatcacagggaatggtatgctaataggcgccctaaagatctcctacagatgcactctttcttacctccattggggagtgctattccaattcccccttggtagtcaggatcaatcatgctaagctggaacagtgactcttttccctgatggctaattcagatgcgtgaggagctcaaagtggccaggtggcagtcttaacttccagttcaatggcatcattgtgtctcaatcaacatagaagcattcctccctttgtaactaagatctctaggccagcagaggataaggtcatagggacaggaaacagaaacttagaaatttggattgtggatcactagaggaaatagtgaatgatgccacttccattttgccctgagctgagaaaaaaaggaaacataacagttattgagttatgagccattataacaattaccgttcataagtaataacaatttcactgttttcagaacattatataatatttttagaacaaaaactacctcaataaataaatttattgagtttaatatttaaaataagaaattccagttatcacaaaagtgatctccctaaccagtagtaatcagcatatcatttgcaaagaattcaggtgcaaatataaacatttaaaaaaattccttaatactacacttcttattactattgaaatttcacagttgtcttagaagtaaataattcttgacacatgatttatctatgttatgcaagttttattatataacaaacaagtataaaaactaaaaatcataaaaatataaaagaaagtcatatttcagatttgctacattttaatagtatcgacaatttatttaaaagatttgctaaaataaatgagttattaaatgctcaggattcactatttactgagcattactaaacatttactaaacatttaattcactgagctattattgtccttatctctgttgcatagaattcctttattcacagagaatcatttattgaatacattctatttgacaaatattatataaattggcaagaaatccaaatttaggcaaatttttcctggaggaaatggtgcctgagcttatcttaaatgataaaccagcatgataagagtgacgaatcatgttggttaataaaatttcttgcagagggggcattataagaaaagacatgtgagaatcagcatggaatagttgtgtgagtgtatatggccggcagtacaaatggcttagtctcctggaaagataagaattgagagagcagaggcatataatagatggtgcagcattttgtaaaatatatttttgagttaattcatttaataatacatgtagtcatttattattatgtacccagcactcttctaagtgcttgggaaatagtaaacaacaaatcaagattccatccctcgtggagcctatattgtacaacattagaaactaactagtgcttttgggggaaattgaataagataaagataatccactgtggggcagatagagtaggggctggtggcagtattaaggaggagcataggagtagagataatagagaaggtgatatatgagcgaattcctgaagaagatgagggagatagccaggcagatatttgggagaagagcattccagacacaggaaagagatagaacacatattctaaggttaaattgtgccttgcaatgtcaggctgaaggaacaataaggaggcaggggtcactccattatagtaaacagggaaaaaaaataacaggaaagcagtacaaaagatgaacagagagcaagacgatgcagggcgttataagccattgtgacaacttacacatttactctgagtcaaacagaaaatcactggagggtttttcagcagaggaagcaggatctgagatctgacttaggctttaaaactgtcattccagctgctgagatgtgactaaatttcacaaagtgcaaaggtggaagtaggaaccctcctaatgaagctattgacttaatcatctctagctgatagttgctccagcaacgctgctagtagtggaagtggtgagtagtcaagttatttatatgactgttaggtagagcctgaaggattttctcatggattggatgtaggatcagagcaagagcagtagtcaaagataacttcaagttttggggttgggaaaattgagaggaaggaatgcttctcaaatgagattggcaaggcaatgacaggacaggtttgctgagaaatgtgaggagttcattattggacatagaaagttgatgatgtttactaaaaaatcaaatagagacaaaaaacgagtaattagatattcagaaatttgcatggccccttaagcagtggaaagcctctgcaaggttttaagtttggaggaattatagccaattgtatgctgtagtttagtgctctctggtgataaataaaggagatagttctgaaagaataaaagactgagctaagggagaacagttaatagttttgtatagcaagataatttcaacaaataaacactgagtggtggcaaagatgggtaagaataggatgacttgagaaatactttacaagtaaaaatcatcatggccatgattgtgagtccaagagagagggaaaagtaaaatagttttctaaattgattgacttgttaaatgtaaatgtcattatctgaaatcaagagtgcagataaaaagcatatttaggtggaagatatttttgacttgtttcaatttcagctcatatggaatattcagatggaggcaaccagtagacagttgtaaatattagagtaaaattctggggacaggtccaagcagagcatataagttaaggcaaaaattagattaattttaaagttgaaaccatgagatcagatgtgagcatgtttgagagtaaaacatggaatattcccaagatatccaaatgaatgcaaccacttaaaatttaggtaaaggaagagagacatgtgaaagaaattatagactggttatagcaaggaaagtcatgagtcactggtaaaggaataaaaatttcaaaaataatatgatccactatgttctttgcacacagtcactctgtaagataaagactgtaaaagtatgctagaaatgagatcttggtgatagttgtgatagcaggttcagcagagggacgcaggtggaagtagaaggacacagaagtgggctgtgtacagagtcaggtgacaacaggggctcagagagtgggagtgaaaacagggcctacacttccaagaggttctaacaagaagggaagggataaggtggaactgtagctttggttgtgggcaaagagagaattacattatcctctaagagtatcatgtctccctcattactgggaggaaggaatataggaaacaggacaattggagcaaagtcccatagaaggtaagatgtgcttaaaggggaattttactttactgttaacagcatagatgttgatgaggaagaacaatccttcagataaatgtataggggttaagaggaagaaagtcaaggaaaactatgttttttgaccacgaactttttgatggagccctaagagttgtctttattggtaaacaagggttgagtacaaacttgaaatacttgcagaagaaaatagaagtaaatcctagacttagggagtcaaaaggattaatgggtatattaatttccttttgctactgcaaaatttaacataaatgtaatgactttaacaaacactgctttattactttacaggtctataggtcagaagtctaacatgggtatcagtagctgaaattaaggtgtcagcaggcctatatatctttctgctctaggatttccttgtctttttttttttttttttttttttgtttaccatctagaggctgtcttttttccttggttatgacttctcatatactcactgtcaccaatggtcagttgagccttcctcacaccacaatgcactgaccatgactcttttgtctctctcttccacattgaaaggatcctggtaattacattggacctccccgaaaaatccagggtactttccctatcttaaagtcaacttgttaacaaacttaattccgtctactttcttagtttcctgtgccatgtaacctaacatattcacagtgggctgtgtacagagtcaggtgacaacaggggctcagagagtgggagtgaaaacctaatatattcacattttccaggaattaggaggtagataccttctggaaactgatatctttgggaaaccaatgtcttgcctatgacaatggctgatgttgagggtcaagctgaatttagatacagtgaatggaaattatacgaatttgtacagggacatttacagagcacaataaaggaatataaacccttggttttagcatggattcagggttcaaacttgtggttttcatggaagaataggaatacagatgaataatgtgataatgagagagtattttttatactctctcagtataaaagaaaaccaaagtgtccagactcatttgcaaaagaaaaggctgatcagttgcagagagtggctgtgaggtgggaaatggaggaatcaaagaactggtggaaccaatgagatggaaaaatagctactatatatttaagaaagtaaaagaaccaaaagagaatattcagagaataggacatttgaatataaaaatcttagagtcagattggtactcggtgaaaaaaaaacaaaaacaaaaagaggacataagcgttagaataagtggttaaagaacagtggaaatgatgatcattgaagtggaggcagtcaagcatttgttaagttatggtgtcaaatggaccttacataccctaaaatcacctagggtgatggctgaccttgcagtagcaagaccatgagactcatctgtcctaaatcactgagggagaactgtcaggaaagtagtcaaatatggaggtactcacagtggaggtacagatggcatgagaaaaaagaagcagagatttatacttgaatctagaaaagaaactatctggaagcagctttagaaaaacagaagaagcctccctctacctcctgacactggagtctgtaagaggaatgagaataaagaaccatttcctagagatgagtgcagaggaaattttgggttgagccaggttttatttaaggcacaaaaatgatgacacggcaccataagcaggtgaagatgcagagacatttgtttaaccatagaggagcacttaaatggcacagtggaaagttttgcaagggagagtagcatttggagccagagagaggaattgtagagcagtattctatgctggtgagaacgcaagagaagttaaagggctctaagttattgaacttttaaatgacaacaaaggatagaagtgataagttttcacaaagaacgctctctatatatttatactaccacggatgaaaacagaggttctatggtttgtaggaagctgatcaagttaagagtagatggtatcatttatagatactacagcaagctcaggaacaagtctcaaatagatgggtcatctctaaaaaggaagaagggaaaaagggaggcaaggaagtaaagatggaaggatggaaggaaagaaggaaggagtcaaggaattaaaaagagagaaatagaagaaaattcattagattttttcccagtgctataatgatagtaaatttgtcctagaatactatcaacacagcccctgatattatcctttatttttcaggatggcattaaaaaccaaaaattttgatagttgcattttttgtttgttttgtttttgagatggagttttgctattgttgcccaggcaggagtgcaatggagcgatctcggctcactgcaacctccacctcccaggttcaagggattcacctgcctcagtctcccaagtagctgggattataggtgcccacaacatgccaggctaattttttgtatttttagtagagccagggtttcaccatgttggccaggctagtcttgaactcctgcccatatgtgatccacttacctcagcttcccaaagtgctgggattacaggcatgagccactgcacccagccaatggttgcatttttaaatattaaaatgtaagccttaagttaggtcaattctgcattaaaataaacacctatctaattggccacatgcacacacacacacacacacaaacacacgcacagtcttcctgaaccataagtcataggtttgacttatgatttttcaatgttatgatggaggaaatgtgaaatatattcagtactctccttgacttactatggggttatccctgcataagttcattataagttgaaaatattgtgtttgatgaatttatcatcatgtagccccattataagtcaaggagcatctatatagatataaaatgtttttatctttagagatctctatttttaaattggcattgttttggttttgctaggtgagtgtttgttaacatcaagggatgaggatacgtttgactgagaaaaaaaaaactcacaatgttagtaaggtcctgctttgaagaatggcatgaaatagtggcataactgttgtgtacctctttgtctagttacagtctatcactcctaatggaatctccatgcatttagtacaacaaaagagagaagtaagattttataacctcttacaatttgaataaatgattctgattacattactacactagaaatgtaaactgagcaagaaaatgattttaaaattgatttcttcagttttggaaagtgaatttgaaattatcaaggctactactttatacatatctgcacccagtgtatgttttaaaatgataatggtctgccatttaatctgtgttatatatatgtaactcaaaagggtttggacatactcaaaaatatcttttagctctatgtgggaagaagtagcaggaaaagggagatacagtattacaaattataatgggagatatagtcatctgagatactaaaatagctgaagcattaaatgaatatttccaaatacatttacaacagagaacatttatgactatctattctatatcagaatcactatggcaaaggtaataagacagaaaaaattcaagtgtgaatttttctcacttagtgtgttagtagcataagacaaacctccaaaaatgtataagttaaagtgcaattcctttaacatttcatgagggattgaaaatgagagtgtaacatttgtttataaagccaacctgcaacctcaaactttactaaataatattattcagaaaacatttttccattttatgtgaacatagcattattgcttcctaacaacatagttattgatcacaataattcattacagggtccaggttacagtgctccattcttattactttgcttttattttactgtaaatagtgacagtaataatgctaaagataaaaacaatgatatttttgacacataatttgaatcactgaattttacagcttgcaaaatatggagaaattggttgaattggccttttctggtaagttagtatgagaagtaaaacttgagatagcatcatcaaaattactcttcttaaaacacagcttaggtggttcatgatttcttttaaacaataaagaaactgatcagttaactggaaaagataacaaaataagtgtatgtacaagcaggcttggcctcacaaattaaccattcttacttgggttatgaatatatatatatatatattttgagtatatatatatatgtattcaaagataattactatacatatatagtaattatgtaatttagttgtatcatcttaagaatcattgtttgaagattgatccttgtattctttgtttcagtatttaaaactttccttttccaaataagaacaataatgttacaaaatagaatgtgacattgtcaataactttcaaaattattaggacataaaattaatatccgttcatttagatgggatttattttttgttcatataagcatttagaacatatgctatgtttagcagcattctcagggtatactggggaagaaatgtttgactgtaatcttgagaaagtaatgagctctttaagcaggcagagcatacatacatgcggggaaagccagctgaagaagtgtgtggtaaaattatctaactcagctctcagactgtaaatgaaggaaggggtcgaacatacttttggcagcctctgaacatgctccactaaagtcgtttctttgttctaaatccaagaacatcctgtaaaaaaaaaaaaaaaaaaaaagtcttgcagaaaggaaggatacttcatacacgggaaaaatatgagcaaagaagtaggaataagcaaaatgtgtgtgggactggtaaaaagtcttttcatatacagcagagtaatctccttagaacatctaagtgaatcttcaatttaggcaatggaagataggaaactgcaaaaagataaaaactccacagtagatgaattctcttgggacgtgagtcaaaagaatgaatgccagaaaccaacgctgaacttcggtcggggatgggagggctatttagagtgcaggtaaggaaaacaaacataatgtgctttacaggactaatcataattcatcattatcatgtacttatcatatatagaaaggactgccctaggcattgaagttttggcaataaccagattgcccttgtttttgaagcgcttacaatgtagtgagagagagagagagagaatgacaaacgtgtatacaaatcgttcagccacgtaataggtattatacaatcacagagtcttcctaaaggctgtttaagggaacaaatacacagatcaaaatgcttttttcttctgggacaatgagagaagacctcattgaatagctgaatttgaattcagtctgaaaggatgaatactgatttcaagagcagaaacagaggagatagggattccaggcctaggaattatcaggtacaaagacatgtgaaaacatactgcaagttcaagattaccaaacagctaaatggaactgcagcccagtaagcttactggggaatggtagaacatgaagttggcccactaagcagggattgggttgtgaaaggcctggcttggattttaccctgagaagataatgaggtgttaaaggatttaagcgttttaaactgtcaaattatgttatcagattctgcacttaggaccatctcttcaatagttgtgtcagggatgaattgcaagtaaaagctagagttatagaatctgatatgatggccattgacatgaaatgctgagtatatttttcttaaattgctggcagtagagaagcggagaatagtaaaaagctttagagatagacaaatcccggctacaattacatatgggtgagaagaggaagaattgtagacaacatgatatactttgagttggcaactgtatggagtatatgtatagagtgtgaagaaagagtaagtaagaaagagaaggataagaagggttttttttttttgaataaataagaagatcaagcatttatcctaactttactctaggtactgattttatgcagggaaagttccttgtttagagatgatatccagcaaatgcagaaggatgatagaattagaaaatcaccattttcaaactatcataaaataatagatctaggtgatagtcattgatgaatacggtaatcacatggatattgacagagaatttcaaaaggcaggtatcaggctgatattatctgaatgtgtaaataagtctcagcattactaaaagtaatgccttgttgtgtgatgcaataggaaaaggacagtgcctcatacgaactattcttctattaaaaatcaccctaacgttttcaagactttggatctaattaccaacttatggaaaatagtgagaatagtggaaaaagtcaaccactaccacaaaaaagtgagtgactagtacagaaaaaaaaaaaaaaaaagagagacttccgagacacgagaatcaaataaattttgtagaatttgtctgggtccttatttgtccaagttaactttaaaaagaggtccttaaatggctgggcatggtggcttattcctgtaatcccagtacattgggaggccaaggcgggcagatcacgaagtcaggagcttgagatcagactgaccaacatagtgaaaccccctctactaaaaaaaaaaaaaaaaaaaaaattagctgggcgtggtggcgtgtgcctataatcccaactactcaggaggctgaggcagaagaatcacttgaacctgggaggtggaggtttcagtgagctgagatcatgccactgcactccaagctgagtgacagagtgagactccatcttggcggggggggagaaagaggtctttaaaacaattcccaaatttgaatataaatttggccttagatatttttaagatttattgttaattttattgtgaatgttacctaaaaagtccttattatttacaggcatatactgatgtatttacaagtgaaaaatcacaatgccttggattttatttaaaatcaaacaaaaataaaataaaaaaactttgtggggggatagataaactgagattggaaatatttgctaatcactggagcttagttttcggcatagatagatgttggatcaatgagtgtttcttgtagtagtctctcttttaatgtttgaaaatatgcataattaggaggagaaaatagtttaattttaagcagattcattttagatgaccacgagatattcaggtatagtttttcagtagaacataatgtaaaaacacagtctagattaattacaaatgaagtatgactagaaatgtataaaaagagtagaagatgagaatgaaaccaacaaacaaaacatggagacaacaacatttagtgggaaggcagaggaaataaagttattggaaggtaccaaaaaggatcagagagatgggaagaaagctaagatgatgttacaaaaaaatggagagtcactaaaatgacccatgtgtacacagaataagtgttgaaatactaactacattttgaataggtcatcactggtgatcatatttaaagaaattttagaggaatgatcatggagagaacagaggagatggaaaactagatagaaatgaatttatgagaggactagaaaatgagacatttaagagggtttttcctgttattaaaaaccatagctatgacagattttcctttttgataattctcagttttttttcttcatttttaaacttatctttcagtagagaaataaaatagatgtcagaaatgtaatgggagattaatgagagcatggtcaaatttaccaaaaaactaattcaacttatgtttagagcagctcattaacgcaggccctactagcaaatatctttccaagatatgccaatgtgtgtgtaggaacacaggattttataaaagtataaaagataagatgttatctctttctacttaacttccaacacattttccctcaaatagagttgtggttgagtggccactagcatttttggaatcccactaaaacaactttgaattgggaatgaattcagtttctgttgagtgggatatgttcatgtagttcagttagagtttaaattattctgactagtcaggtgtatgaatggtttacaggaatactcctacctactgtgaaaactcattgtgacagggaagtgcaggatcacagtttgtgttgtaatatacaattgtccaatgatacctggccctacatgtatgcaagaagttgaggaaaaagcaaagtttgaaatatactgagctgtaaaaattaaaagaaaaggatttggttatcatcaatacctaggctaaacagaatttctccttgtcggggatttactaagcaacacaacaacacaacatatataatcataaatgtaccggatatgttccccttttttgatgataatcatgtgaaagtgtaattaatcagagtcccttttacagcacaagtcttcagtattcaattatgtttataattgcccgtgtgtagaataattttaaaagaagtttttccaaatttgacaatagatggcctctaaccaataacgttgtcatacgaagaaatgagtttagagtatgtggtcaaaaaaggaatggaaaaggtatttatcaagctaagtcatgtaaatgtaatatgtttattttctacatttcatgatgtctagggtattttgccattttttaaatttgtacttctagacttacagtgtggctcacgcctgtaatctcaacattttgggaggccgaggcaggaagattgcttgagcccaggagttcaagaccagtcctggcaacatagcaaggccctatttatacaaaacagaaaataaaataaaattaggtaggtgtggtggcgtgcacctgtagtccagctactcagctacttgggaggcttgcttgagctcaaaaattcaaggctgcagtgaactgtgaatgtaccactgcactccagcctgggtgacagagtgagatcctctgtccaaaaaacaaacaaaaataatttttattctccctttctgttcagtctaaataaatattcattgtcatgcctggccctagaagtatgcaactaactgcacaactttggtgtgtttttttgttttttttgttttttttttgagaaactttcacaaaacttggatttaaatctgtatgggagcccaaaaaggtacaagaaagtagaggaaaaatattcaacatttacacacacacatacacacagaaaactataaaagctttcatctttcttagcttttgtccaagaaaaaaaagcagttggcttttaacaatacagaaatcatttttccttaaaagagatattgtgaaaaatcttaatgctcaaagtactaggacacatacatacatacatacatacatacatacatacatacacacacagggtaccttacacattaaaaataaaatgtgtttcattcacatctgaagatttcttttcctactctaccctgttagtcactcctacccctatgagagaaacacaataactgttcatcccctttctttatttttttgttgtcaagtctgaggacagaaggcacataacacatatgaagatggaatattttttaaaaacaaggagacaaaatattaaacaatatggtagtgttgccttttagggaaatccgaataaactatttactatttcttggaaataaatctaaaaagtcaaatacttaactgaagtactttgtccttgacaaactatagtaacaccacaatcagcagacttaataatttatcagtacaacagaacatttagatgttctgttagctgtagattctatagatttaatctataattctatagattaaaaaggaatattaaaaaggaaatttaaattttagaagtatatttgtattctaaattgatatatatttagaagaaaataaatccatatatttaattattcatatggaaatatcattgttagtgttgtgtggatgtatcctttcaagtaaaatagcttatttaaatctttttgaagtaactcttcataaattcacagtctaacaatttcttatttttcgggagcaaaggtatatattaatgtttaatcaaggatccagcgtttgatctaaggtcatcttttgaactagaagtaaagcttttatttcaaagaaagtctatcctcttaccttttacatttacatatttaacaggaatgtagacatacttgcaaaagtgactggatgatattttgctgttgtagcacacttcaaagattagaattatccattcatttcatgagtgtagaccagcccaatttgacccatagtctttctgtgaaaatataattatcttctgaagataaaaacagggtaaattataggtggttgtagagttggggaaaatcaaagagggggacaatttgtggtagtcctgagtttaaatactgaacaagtcatctacttcttatgtgaccacaggtgagataattccttcaattataaagtatgatagcaatttaagtgttactatgttctctaataacatgagctaaccctctttttcttactgtcagaatgacactataacaaatattgcatttttccctatgaatccaaaagcttctgtcacagtcgtgattaggaatgctgtggatggaagccttacatcactggtgaatgccaaaacaaagcagtatttatcactggctttgatttcaacattattttaatattttcccacctttattaaagacgttaatattatgagtgagtatatttcaatgaaagtagcctacttgagcttggaaagactaaactaattaacaggaaagtaatgaaatagcaggtttatatcttgagcccccagtgatgaaaacctttagcaaaatacaggttacatgtttaggatttggttaattattttaggagcaaatatagagaaaaaatattctcatattttaaagaccaatattctcatttaggcctgaatataacagtgaattctctaccttatatgggctaactatccagttttgacagcagagaaaattataataccctatagacctaagtttcatcaaccctgttctctgaaatatatctgtaattattctggtacactcagatgtttatattttaagaatctatatctacaatgtagttaaagaggtgttttataattaagtaattaaatataagcgtaacttttaagtgttgttagaattcaaagtaaagcactcattccaaaatatttcaactttcttataaacatttctctttgtactacaatattctctttcccccaagtgctatgattaatgcaatccttaaaaacaatggaaacaactatctttattactgattttataattttggaaattccagggactagattccctactgttaaatttggaatatataaacttcctgggattgcagttatgacctaatgtactaaggtagcactcaaaacagctattaatttacatggaacaaagtcataaaaggccagaggaacagcaattattgtcacatgcaattaccaagagacaagctaaaaaagaacactcgtctgcaagtgtatcaattaaactccattattattaaaacaagtggtaagtgaacctgccctagaaatctattgtgtctggaactggttccttcagtgggttcttggtctcgctaacttcaagaatgaagccacggaccgtcgtggtgagtgttacagttcttaaagatggtgtgccaggagtttcttccttttggcgggttcgtcgtcttgctcacttcagcagtgaagctgcagacctctgtggtgagcgttacagctcataaaggcggccgcatctggacttgttctcctcctggtgggttcatggtctcactggcttcaggagagatggtgcagaccttcgtggtgagtgttatagctcattgttacagctcataaaggcgttgcagacccaaagagtgagcagcattaggatacattgcaaagagcaaaagaacaaagcctccacagcaaggaaaggaacgtgagcaggctgccactgcttgcgccggtggcctgcttttattcccttatttggccccacccacatcctgctgattggtccattttacagagtgctgattggtctgttttgacagagtgctgattggtgcatttacaatcctttaactagacagaaaagttctccaagtccccacccgattagctagacacagagtgctgattggtgtgtttacaaacctttagctggacacagagtgctgattggtgcatttacagtcctttagctagacagaaacgttctccaagtccccacccaacccagaaacccagccggcttcacctctcactacgttgcatagtactagacagacctaccctgtagaatttaaattaatatcctataaatactgataactctcccatattttttattcacaacttacataagtgcttaaagaatgaagatgaaataaaaatgatttacacaaaactttaataagattgttattttaattttttgcttacttttctgttatttcttcaaacctgaatacatatgtgaatatggaaatatcttcaaaatcttgctattttagttctttcctttaaaaaataattttcttcccagattttttctcttatatgcctcttgctcaccagtttttcttccttaaatgcaaatcgtctgagagaaatggatggcaataaatgcccccaagaatgactaagtgtaataagcagctgttaagatgcggttttcaaaattagacctgaaaaaaatgtttcttttctgtttgtttccatatgaataccctagatgagtagttactatgtatttattagccagtgccttatataacataacacgttcaggagacagttagcaaaagaacagtagaattgtaaatactcagagaaaaggagacatgcacagtcttccttctataaataggcttacttcagcttcatatccaataggcttaaccaagcatgaatttacactcctcctctttatacccttcaatacacaatttcactaaataatgataatgttctatttttaaatattttacaacttttttcttgacaaatttaccattgtgcactcattgtatgttggagatgagggattcactttggttatgaacgtgaaatcttattctaagttgttgtatataatttaagtaatttatatacatactattattaattagctaatattttcccctaaattaataagcgtttagttcataaagagaataacacatttttgatctacatcaggaatagtgaaagacctagattgatatattattaggttgcagtgagctgcattgaatgtgtccctttagctacagtggtaaaatagatttataattaccaatcttcaattatgattgaatttaaagcagttgttttaattggcacttttttgtaatgactgaaaggagaaagtatttggatttcaaagttttcatgcaaatatattttcttatatttcttcctgctacaatctacccagaacaaatatgctatattatatgagtaattatgttttaataggcttgttctgcaagcaattctaaatagtacttgtcttgtgagcagtgatcatggtttgtgtttgcaaacagtctattgcccttttcaaagacattcctggaatacaaacagctggcaagtgatctgctttccaaaaacttgcggtgtgtgtgtgtgtgtgtgtgtgtgtgtgtgtgtgtgtgtgtgtgtctaatttgagcaagaccacccagagaattagtagtaataaataaatatacaatgagatttcatatcctattttgacaatgtattaagtagattgaaaaccctctctccatctctataagaaaatgttatcttctgtccaatcttcatgttgccatttccctatttcttctggttcttttctcagaagtagtcattatgattcttgtatgtaaccataattaaatcattttacttttctgtatttattagttacttactatagatctgttagtgattatatataataactatctgtgagatcttattaagggctaattttaagggctaacattttgcatgttctctcactagtgttcaaaacagttcatgagaaacagattgtaatctgaacccaagcctgtaggactttatattcaataaccctaacaattgttctcattcttctaaactcttttcaagattaaaatagttatcagttttagacttctcaaatttcatcattgcctgataaatgtagattctaaattgagtgtacagggatgcttctttttcatctatatgatcctgtaactcaacaatgtgtataaatgactaatgtgctcagtgtttttattagttgcttgtaagaaaacaaaacaaaggaaatgcatttgcctattgagtctcatgagaaagtatgacttggagctccacaaagcaattacaaaagggataagttgtatccagcaaacttgtctaacaaagttgttttgaagtttaaataatataggtccagcccttggcatagtaaatactccataaacagctgttactctacatgctctgtgaggaaatagacatcacacttgtctattactgcattcctagtcttaggatggatcccagcacaaggaagagtcacaaaataatgtattaaatggatacattaatgaatgtaaggtattgtaataatggcaagtcagagtatggtgagtgtcattattaaaaatgcctaatagtcaggagatcaagaccatcctggctaacaccatgaaaccccgtctctactaaaaatacaaaaaattatccaggcatggtggtgggcacctgtagtcccagctacttgggaggctgaggaaggagaatggcgtgagcctgggaggcgcagcttgcagtgagccgagatcactccactgcactccagcctgggcgacagagcaagactccatctcaaaaaaaaaaaaaaaaagtgtctaataggagatgaattttgagcaaaactttaaggaatgtgattgacatcaattgagaaatgtgttccaaagcaggggactatattttattaatactcaggatgagaatgggcttatttcttgagatagataacataacacaatatacgatttgcagttcaatatagtgtgtactctatttgtttctagacttgaaactaatgagtgtttaactatcttaaatttacacagagaaacatgttgtgtctgtaaatttattactataaaatggtggccttttcctgtgcattaatggtgacaaaaaattagcaaatgagtaaaacatagcatttatttgtattaaaatattttttcaaggtagaaatataatttttcttataatattaatctactgttccataggtaattcatttcaaatattaatttaaatttttattacttttggctgtttttttggtaattataatcctagacaatccattattttcatttctctattggattatttacattacagatagaaaagtaaacttccaaatggttatatttaaagatatttctcaattactaacaattaaatgattgtcattgctaccaaattagtaattgctgggatatatgatatatgcattagaaaagcagttcttatatgcctatacattcttaaaattagctgtccatgaactggatctcatgttctaatatgtttctttacgtaaaaagtgaaaaaatgaaggaagaaagaattgtaaaaataattatcactgaaatgtcctggactgtttgtgagaaatcaaaatcttgaagtcgggtagctacctgacttcaaactatactacaaggctacaataaccaaaacagcatggtactggtaccaaaacagaggtatagaccaatggaacagaacagaaccctcagaaataatgctacgtatctacaaccatctaatctttgacaaatctgacaaaaacaagaaatggggaaaggattccctatttaataaatagtgctgggaaaactggctagccatatgtagaaagctgaaactggatcccttctttacaccttatacaaaaattaattcaagatggattaaagacttcaatgttagacctaaaaccataaaaaccctagaagaaaacctaggcaataccattcaggacataggcataggcaagggcttcatgtctaaaacaccaaaagcaacggcaacaaaagccaaaattgacaaatgggatctaattaaactcaagagcttctgcacagcaaaagaaactaccatcagagtgaacaggcaacctacagattgggagaaaatttttgcaatctactcatctgatatagggctaatatccagaatctacatagaactcaaacaaatttacaagaaaaaaacaaccccatcaaaaagtgggcaaaggatatgaacagacacttctcaaaagaagacatttatgcagccaaaagacacatgaagaaatgctcatcatcactggccatcagagaaatgcaaatcaaaaccacaatgagatatcatcttacaccagttagaatggcaatcattaaaaagtcaggaaacaacaggtgctggagaggatgtggagaaataggaacacttctacactgttggtgggactataaactagttcaaccattgtggaagtcagtgtggcaattcctcagggatctagaagtagaaataccatttgacccagccatcccattactgggtatatacccaaaggattataaatcatgctgctataaagacacatgcacacatatgtttattgcggcactattcacaatagcaaagacttgtgaccaacccaaatgtccaacaatgatagactggattaagaaaatgtggcatatatacaccatggaatactatgcagccataaaaacggatgagttcatgtcctttgtaggaacatggatgaagctggaaaccatcattctcagcaaactattgcaaggacaaaaaaccaaacaccacatgttctcactcataggtgggaattgaacaatgagaacacatggacacaggaaggagaacatcacacactggggcctgttgtagggtggggagaggggggagggatagcattagtagatatatctaatgttaaatgacgagttactgggtgcagcacaccaacatggcacatgtatacaatgtaacaaacctgcacattgtgcacatgtacccttaaacttaaagtataataaaaaataaataaaataagagtcaggaaaaaaaaaagaaatcaaaatcttgacattcaagaaacaattttttggtcaaagaaatcaaaaaatgttttagttatatgataaaatcaaatgaaaactttaatctttatatttgaaagcttcatggaatgtgaaaaaaccatattaatcttatctcaattttccaataataataataataatatctaatccatctaatttttttcacaggcaaatttatagcaatctatgttcatattaaagccagtactatttatcaaaatgaggattaatacatggggatacatgatttggtatgcctaaatattttcatttaaaacatgtataattaatatgagtggtcaaaaataaaagaaaatattgtttttaatgaagagtgaagagaaattaacacattgattaaatgatgatagtgtttgcatccatgtagagggtgagagtgggcaatgatccagacagatatttctggaaaaaaaaaatcttaatttactgttagagaatcctggttgttcacctttcacctggaataactaccaccaccacaacaaaatattgtgattttttttaaataggtgaaacatagaaaaaagaagaggaagatttctaaaatatatttttcctcaaaattatgatttttagaatatgattgtgctgagtgaagtgtgtttgtgttcttttttattttaactcttaatcctttttttgcaataaggttcaagaaaggccatatcacaatgtaataactgtggttcttaggtcaagaatatttgaaaatgtagttcccaaatgcatatcctcattaactttttagaaaagctgatatggtataataattatggagtgaccaaaagtatagcagttctgagtatactatttattctctacttgggagatgaagatgggaggatcacttgagcccaggagttagaggctggagtgagccttgagcacaccactacactccagcctaggtggaggaaaaagaaaaaaaaagattatgaatccattgtacctaaacttttcttgaatgtgatcaaaaagaacagttttacctgctttcttcacagaggtgttgaaaagatggttaaagttaaggatacagtgaaaatgttcctcagccataaaaagaaaaaatgtcatttatgaaataatggcatttgcagcaacgtggatggagttgaagatcattattctaagtgaaataactcaggaatgaaaaaacaaacatcgtatgttctcacttataagtgagagctaagctatgaagatgcagagcataagaatgatataatggactctggggactcggtgggagggtggaagggaggtgagggataaaaggctacacattgggtacagggtacactgcccaggtgatgggtgaaccaaatctcagaaatcaccactaaagaacttttccatgcaactaaacataacctattccccaaaaactattgaaataaaaatttaaaaagaaaatgctaagatggcataaatattaaattattagtaagtaaacaatcagaaggtaataattgattatagtacgtgtgggttctagtagaccctgttcttctaaataataattcttgcatatctaatgagtttttattcattttgcatttttctgtttcagcattatagttatatgtgcacacatgatgcacttctaaataaacaaacagtaccatgataggctcatcttttttggaactcatgtattctacaaatatttactaaagttaaaaaagtgcaaggtattctgtcagatattataaaggaagagagatgaattttccttgaacacttggagtctaggaggaaaagaaagatatataatataatattggtaatactgctcctgcatgccaaacacactactatgttatttctgctcttctcaaaacccagcacaaaacagcattataatctccattttgcaggttaggaaattgcccaaggtcacactgctaataagttagcagagctgtgtgaacagtctagagaataagaaggtaaatgttattttcactatagcacataatattaaaaataaccaatttcaaatagtaagtgctaagttctataaaaattttatagcaaaaattcatatactttaagaattaacttgtaaatatttattcttataatatgcacatcctattagccttaatgaaaattcactttccaatcatcaggcatttattttgttcactccatcaaatactttagttttgcaagaagcatttttatatgtgcattcgcttttgaaatccatgaagatgattaagttttttctaaaaccaacaccagaacctggaatgcccaataattgctgaatgaatgaatgaatgaatgggtggtgaattagcacaaaaaagtaattctttccctaatatttttagtgcaggttaacattttatgttggtacatgagatagatggaataggaaaaaatgacagtgtcaaaattcaaggcaataacaaaatcaattcattgtgggaatggtagcagaaatcaacagatcattttggtcagttattatcagagggaagcttaataattttgtttaacatagtgcttacagagttttaccagtggtgtgagaaccagttatcctaagggctaattccaactctgcacacagtaacatcatgttggtagcttgacaaagaacatggttggagtatttatatcttgaaaattgccaaatactagtcatgactttttcctgagagcagacatgttgcacatcactggcttctactcatgcttagtggctggcagaattcagaggtgataaatatctgcaattcttggaggagttcctctcaacaaaatgttgccctgtaattatctgagctgagacccctgactgtttgcttaaaaggaaatttaatttttgcctggttttgaaatttaatgaattttctgaaaatgtaactgtcatgtaaactgatgaaccactgaactttgcataatcatcattttataaaaatctctttactgagggaaatggcttttatgctgtttgagtcgtacaactggtattagtttttgttgctgccatgtcattcaatttgattctgttgaggtgtaagcacctggtgacttcagctatgtcttcaatgtggttgcgccagagcatttatatactcaagtatacatcattttatcataaaaattgctcatttctcttttatattatactcaatgcttttaattgattttttgaagccaagagtataggtggctatattatctgtgaactgcattttaacatattaaaagagcactgacgcagttcagccttttcatttccagaagagagagtgtgacctgatgaggtaaagtgacctgaccaaggtcacataactcactgacatttcagttttttaatttatctattttccattaactttcagtaaccaatattatgtgttagctttatctggaataacacatgcatagtatttgtgaaaatacacacgtagtcctcttgactttatttctaacagaagcctctgctagatttgagcaatatagcttcatctaaatcatgccgcattcttatgttcaatgacagggatttatttattaggtaatgagcccagaaattatgctgctacttttacacctttattctttttatggcacccgagaaatacatcccatatttcatatttctaagcatttggggagccacttgctttgattgaaattgctggttcatgctaccacctagacaaaagccactgacctgaatgccagagctaatgtgactgttgcatactaagctgacttttagcttcaaactttactaatgtgtttacactgaaaaagaatgaaatgaaaacctattttcaatttgctatgtcagctaaagaaagtaaaaaaaaaaatgtgtggtagatgcttaaggcagaggaaatgaggactattgctggaaatttagcactgcacaatagagaaaaacatggctttatattctaggtccccatggatagctgcctatgaatatcatagcaatgctgttctaagcaaggtaattcttctcataccagtttttctcttgctcaaggtcatgtctaagagtagaatgaaatcagcataatgctttaaaatatacgtccagtgaattcaggttaaattctaaaacgtcaggttgattctttttgtaagcttggttccagattttagcttgtgcaatgagaaaatgttgcctgaatatttttctgtacttgaattggcatactttaaagttcaaaatgggaggcaggtaaatttaagttctagaatttaaaaggtttaacattataatctgttttctgtctctgtatgtttgaaaatctttaggatatagccaacatattattctcaatatggtgctttattttccatttatgtaacagataaagtgggtctttgattcacttggctgcgacactcatttcatctatttatgcaattgcacgttcatatgtacgaaagccagctcagatttttcttcctccaaagtcctccttcaaggacttctcagagccttaagtaaaggctaacataaaatataaatctccaaatgaaaaatattactggcactgttcccaaatttatttttcctcaatgcaactttattctaggagcatctgaaaaaatgtacttctatttggcaaacttttaaaatgctgctcttttacatgatttactttttgttgttgttagtttccgatacaccaaggcctagcttccctatcacaatctgcctgttcagggaagggacaatcctctttatttatctggcacagttaatttaaaaaaagctgctcaacctttacaatgtgactgtatatttagagataactaattacagaagtctctttgattaatatatttatgtgtgtgatcattattgtagatgttgttttttaaaagcacacagagaaaccaacatgcaaaagaaaggaaaaatattgtctgcttgtttgcttcatgaatgtgatcatttagattatttttcgttatcacacttttccccatcgtgccatgttttcagacagacccttttatcatggagagaaaagcaacggcccataaaaagagtgttttgaaagctagcactatgacattaccaagtttttctattattattttttctttcaccacgtgaccttatgttgttcggtaactaagaaggtcttctaatgtttaaaattatactgatgcatgtgtgtgtgtgcgcgcgcgtgtgcatgcacctgcacgtgcacatgtgcacgtagttgtgtttttcaaaatcaaacgtaatataggaattcaaaacatagaaatgcaccttagtaaactgagattaccctttctggacttcctaaattgaagtagaatttaaactaccagtggatacacatgcaagtctgagattagctttaggattcctagtcttactattatgatatatactgcctacaaaggaaaaaataatcagtagtaattattaatatgttcagtggagattagaccttgagaatgattttcagaactgaggcataatgtgaaagtcttcaccatggatgctcatagctaaacaccaaatagttggtctaggctccctacatccctcctgtttaaggtcaggattgttcctgggtctttcagttatgaggttcacaaaccctgagagataagtagccaagacagagctagaacccagatcttttaagtcttactcttgtatcctttgagaattgctcttccaaaaataggagggtttctgtaactttgaaccagcttctccgatacctaaatatttggtctctattatatcttatctcattttagttaacaatgtttctaatgagctatgagcctcagtttctcatgtataaaattcataaaataatacttgtatatagactattaaatatgtatacacatgtataacatttattcagaataatagaattagcttaccttactgaagatacactttagacatagaattataatagttcttgtattgaatatttacaggcacagttcaggtactatactgaaaatatatactcagtacatttttgaatttattttgtttttatgtatgagttgattaaacattttaaaacaattggaacaaacttagtgagatttgaatgctttagagttctaattctctagtgaacaaacaaagggaagcttaattggaaagtaaatgattttgtgacattttcagtttatatacatacaaaatgacaaatcaaaaaatactcacattttaaaattttgtcttacccaaaatggaaaatacaggacttatattgttatttggggtaaatagttaaaaatcctgaaaaggaactttttttttttcattgctttctttatatgccagcatacctcatgcacacacaacttgcagcttctttttgttctcacacataatttgatattataagtagggaggatttaaatgaggatttagaaatgaatggaaacctcaatggaagcaactgcatgttgaaataattctaggttctacaaaaagaaaggagaatattggcaacatagttgaaggaaatgaactttaagaagtagattccaacaggattagtctactactgtgaaatggaagaagtaaataaaacaaacagaaaaaataattaagtagaaaaagaacttacaagacctgaattcttctgaattccagacaaaagagtaggcaacaataatgataaaatgtatacatctagaatggtactgaggacagaaggacaatttggaataatataatactctgaagtttaacatggtcactaagaagtatatagaagtagaaaaatatggaaatgacaaaatcaagacttctcaattaaagatgtaatatgttgagttaggtgcactactcgctgaggacaaggtgtatgtcttccttatgtttacacttctagtctgcttgtgctcagcactgcacttgccatgtagcaggtattcattcaatgcccttttatttaacccagtttggtaatccaggaagctcattgtattagtccattctcaaactgctatgaagacatttctgagactgtgtaattttttttttttttttttgagacagagtcttgttctgtcacccagactggagttctgtggagcgattttggctcactgcaacctccgcctgccgggttcaagtgattctcctgccttagcctcccaaataactgggattacaggcactctcctggctaatttttgtgtttttagtagagatgggttttcaccatgttggccaggctggtctcgaactcctgacctcaggtggtcagcccacctcaacttcccaaagtgctgggattacaggagtggccacgacgcctggctgatactgtgtaatttctaaagaaaagaagtttaatcagctcatgatttcacaggctgtaaaggaagcatggcagcatctggtcatattctggggacaccttaggaaactttcattcgtggtggaaggtgaatgggaagcccgcactacacatcgccagagaaggaggaagtaaagaaagggcaaggtaccacacacttttaaacacccagatttcataagaactctatcacaggaacagtaccaaagggagaaatctgcccccatggccaaatcacctcccaccaggacccatctctaacattggggattacaattgaaaatgagatttggttggtacatgtatccaaaacatgttactcttatttggggaatgtaagaaagaactaatgatagatgatgataggagctaaagatttttaggtcttccgcaaaaaaaaaaaaaaaaatgaacacttaccaagtaatctcaaatagatgagctttaatgagaaaatgccacattgattttgcactttgaaggaatgtataacacttaaatatttgttggatgtaatttatacggtacctactgaaaatgaggaaactgaggctcagtaaaattgaacattataccattaatgtgatctgagatatggttaccctcagggactatataccacaccatgtcaccatgttgtattcatatttagtcttcttctctctaggaagtgatctcatttttgtcattcttcactcattggatgagtcctcattcacacacatcacacacacctccaactatctgacaattcttagtcttagaaaattctctgaactctgtgattcccaagtgatgcagagtcaaactgatgttattaaatgacaaagggactgagggctatttaagttttaaaaatctaaatcttagcctgaggcctttacagaaaaagaaaagaaatccccaagaattttaaggcattttttggtattatttttgtgatttccatttttgaagggctaagattcacagtttaggttacaggtaagtcatttcataaataaatatgtagtagcttaaaaaagatgatgcccgtgatgtttcttaaaatcctagtggtcatgtttaaaatgtaacatgacacttgataccctgcataatctatatgactatatgtacttgagaagaaatactaatgtaatctagtaactctttattctcttaatgaggtatgctattccatagctctttagctttttggtagggtaaaactcaaagagacaacccacataacattaaaaagaactcattaaataaaatgcaacattttgagatgcataattttcaaatggaaccactgtgtattacagtgagataattaaatattttatgttttacctgaacttccagaataagacattgatatatacatttacagtatatagagccactgattttaccatgcatagaagtggatggaatatcaaaatgctttgttccagtactttgtgattataatgaagacttatggttttttaaattttgacaacttttaggcaacagtaaatatgaacacatagattatattttttgtttgtagagtatttattaactatataagcaacatctgtgaagtatagaataatttccatctacaaaaggaaaatgttgtaatacatatttagtttataatagtatgttaagaaccatcaacttattcttttaattccatattccacagatgttcattagacacctaccattaaatgttaacaaaatttcttcatgggtgaattgaatacacttagaggcaacccattttttaaaaaagtatgagtataatctggattcctgtgagtataaatgtagctcatatttattaatgattgtttactctaaaaatattcagactggtttggcaggctctctgtctgaggcttgaagagcttgctctgggatccttgttttctcagcctctctaattgagggcaccttcacagtttcagggtactttacagcacggagaagaacctaaaaacaaaacgaaaacatgatgggtcataactatgaggaaataaaaagaactgtataaattgcaaagtctgaaaatcaaaaatgtaatacttgaactaaattcattttaagataatattaatgtggaaaggaatgcatctgattgatataaaaagtgtaagaacacttgcagtttaatgttaagcagttacattgcaaagactagtctcaaattttagaacttcattgaaaaatcagtcataaattgtttctccataaacaattaaaaaccagttttctgattctggttaattgtttctttttcattaaatttgttaaatggggatcactaaaagtaaggtctcacaagatagtgtgcatattgctttacattttaaacttccatatggcagatctttcccctgtgaacttgaaaggatagatagtatcattttattttataaatgatgacatccacagaggctaagtgattagctgtgtcattccaacaaatagtagactggaaatctaaatcagtatttctttgaagggaaatatatacatctacacctgtgtgtgtgtgtgtgtgtgtgtgtgtgtgtgtgtacacgcatttcttatgtcacaggactaacacaatgaaatgttattttaagaattgaaacttagtgtgagaagtattatgtgcaaatgtataaaacattgtcacacattatacaatcgatcccagattgtgtcccttagttgcctgtagcattgacatttaacttgtctaaaactaactttatcatctataaaatgcaactaataatatctgccttatctcagagatagataaattctatgtgtcagtgcctgggaggattacatttgttttagctaatcattcatttatgcatctattcatgcaacaaacatttattaagtgcattcaatgtacaagcattagtgaagatgttggagataaattaatggacttatactgcatgaagaagaaatgtataaatcataaacaatagtacaaacacaaataataccatcgttaataacatcagacaattataaacatgttgcattggttggagaggaagctgaggattgctgcagtagtctatgcatgaagtgagaagggcctctactggaaagatgctgctaggaatggagaagacttcatatttatgagtaatgcattttaagtaagagagataaggtttctctctctccagtagaaaggaatagagaaaaaaagagctgaggaaagtcagttatgatgtaaaacctaagataaaggcaaaatagtaataagaacactaaggggtgggcagtattagaggaacagtgacaatttcagttttgatcaggttgattttgaggtgactgatacattcaagatgaaagaaaattcaaaattggaatttagatgaaagggtagtgcatgtattcagagttagcagtacttcggtatgaggaaaaactaagtttctgattaaatgttaaaagaccaaagtcagagcttaaaaccatactgatactagaatgcagaatgggcaaagcaaaaatgaaaaaaaaaaaaagtagtaatatcccagaaaactgtgaaggaaagaatagaaactttgtgaacattaaaattagcacaacagccaaaaatgaatactgaagagaaactatcttaatttaataataagcagatactttgtgacatttgatagagtagtttcagaaaacttgtgggaagtacaatgggttacagaaggaacggttggagaggaggtagagaaagcagatgttgcactgcaaaatggtgtgaagtagctgtaagacagagctattcaaatgatgaattagtaaaatccatgatggctgaagagaagagatggaaactaatggagaatataggagtttccagaggaagacgttctcttaagatcgaatgaagcagattttaaaagctcagctacagtagatgactcttaagaatctaaaggaaaagatgaagggttatgtcttagcaaatagggagttgaagttttggggagcaacaaagaatgtccagacgaagggaaggcaaagttcaacattataactaataaaagttggattggatgacttggggacttagaataacaagcaaagcaagtctcttaattcttccctttggaattatatagactgaactgacccatctcaggcatagctgaacaattccagtcttctctctcagtcacctttggttgctccaatgattttgccaaaggtagatcagaatgtgtgttttggtgagcagatttgctcacataagtgaaacaatgaaatgggggcaagcaagaggcaggctgcaacatacctacttgcttatttctttgatatcacctataggatgagtcattcttctttttggtgggtggggagcaaggctaagaggccataatttttctccttcgaaattctttccctttatggaacttagaatagggtgattaccaattatagcttaatatctaagacggacctaactttgttcccagaatgcacctgcattgggtaatctgtgtaaaacacaacacatcatataattctttatatgaaatttttataatgtgttttgaatttttttggtggtataatctgtctttgatagcataggaaaggataattcatataaaagctgaagaatgatggtttaatgtgttgaacagaatataccatgagcaaaagcttgttgatttgggtaagtctctaccttgtttctttaggagaatgtcatttatgactcctcctgcatttgtataccttcgtaattctcagtaacatagaaatttgatttataggtatttttataatgtatatattttacataaaatattttgatgcatctcacttattttttaattgcataaattatattgaccacttacatctattattaatgacatacctccccaacttcccaaatccttatcattaacttttctttttttttatttttagacagtctctctctgtcgcccaggctggagtgcagtggtgcaatctcggctcactgcaacttctgcatctgggttcaagcaattctcctgcctcagcctcccaagtagctgggactacaggcatgtgctaccatgcctaactaattttctgtatttttagtagagacgggcttttgccacgttagccagagtggtcttgatctcctgacctcatgatccacctgccttggcctcccaaagtgctgggattacaggcgtgagccaccgtgcccagcctatcattaacatttttatttatctcagaatcatagtatcaggatatcttgaaggatttggccaaatatatttcagcaacatattcaacaacattatgttaaacatgaaaaacatgaaaatcacataggtatgtatatattgagagactaaagggagcagaaaagcaaggtactgataatacagaagggctgttgttcctagaatggaaatagctgagattgcaaaggggcaattagaaagatgtcatggtgttaacataactttatatacgtatacacatgctgtgttcatttatgagcggcagtaaacctatagtgatgccgtctataagaaagaaacagagaaatcgagtaatatgatttagaaaataacaaagaatctgttataaagtaataattatcacatgaaatctgactttcatattttctcaagcactttgaaatgtacaaggttctgttccgagtataaagcttgctgaagaccatttttttcaaatttatagacaaaatgtaaaaacaatttgataagttctcatttcagaaagtttatgtcagtgacatgaaaacatatcagtaaatgcattgttaacaacttaatcgagtaatttgcctgtcatcatgactcctgggtaatgtcaagctgtttacagctaatgtaatttttggtagaaaaaaatctatccattggacatttttcatttcaccttatgggaaatattttattatagtagacaagtttccaaaaagagattattatgaaagtagttattctagcagtaacttctcagataaatgatctgtataaatatttttctcaatctctgaatagaatcccaatcaggagtattggtattacatgtaatccaacttctagctctatcgttatgtatttgtgtcatgtcagacattattttttactggttggccctcaattttctcaccttttgtccttagctttgaaccaatcaagttatggtaattgtgtttattgctcgtcagtaaaggcaactataataagatattttgcataaggttagaatgtattacagttgtttaataaaattaactgattaaaatgcagggaatatttttcaaaaagagaaggatgattttcagggtgggatccagtcgtgagagttgcatgagtttgcaggcagaagtaccataaaatattaaataaaagaggttcttgaatgccaagtcgaggagtgtgaatatatttaatatctgtagggtatggaaggcagtttccctcactgagtgaatataaaaggccatattaacccatgagagttatccgcagttagcatttgtgttgaagtaaagttgcactaaatgtatgtagggttataggagaatgatttagatcatatgaaactgtgaagggagaagaacataccaggatgaaagaagtaatttaagagtcaaagctacagatatttcaagtaatatgtaggagaaaaagaagcttaacttcaatttcattaaggatagtgaaaatccatctcagtagtgttcaggatgataacagattgcaaaagaaatggaaggaagagatggtgagaaaaatgaaggcagctggcatacatcatatcttctaggggtctggcaatgaagaaaaatagagaaaaacttcctaaaatattgggatgaaatttacttaattgcattttggcatgttctcgaggctttttaacttctcgtctgtggtttgtcagaagtaaagacagcttttcacatttcctgtcttttcaaatttggcttccaagccatgttgaggatggagttatcttcaaatttcaggggtgtgatgttgcgtattggaccacagatgctcctcaattctgtgaggatttttcattattttgatttcttttttcctataaaagtttgcatttcacccttctcatttttccctcagttgttagaggctgcctcagtgagctctaaattctctggcagatggtactcagggatgactttgagagaattcctagatttcaaagacatataccttttccctgcctccttgaataatttatgttctttggcttctcttacccatgacaatgggccctgaaggagacccaaatctaatctgagatgtaatctccagggaaaactgaaccactggggaaagctcagttgtggacaacctgtgtcctaaggtgagaaggagggccactagcataaaaacaacttgaacagaacttccttcacaagccaataaattctaataacaaaaggcaaaggaaaaagttccctatagaagctaaggattttccaaagcctaatgctcattttttatatccttctttgtatggtcaaaggttgattcttcctttaccagacacaaaaaagggcttaattaaaaatttgaaatcaaattttagagatataaactataaataaatacatttgcctttcaaatttttagaacattatcctagttaattcaaatttttttatttgagatgaaaggcgatttaagctaattttcattggatcatttattattattattattttgcagtgtattagttaactactgttatataacaaattaccccaaaacttaatggctcacagcatcaaaaatatattagctcatagtttttgtgggttaggaatctgggtgctgtatgtctagtgctcagggtccttcacaagattgccatcaagttgtcgactggggatgtagtcatctgaaggctcacgtgagtgagtatcaaattccaagctcactcactttgttcaagtttttgacatctgctggctggagaccacttgtttgccttgtgggcctctccacagagtagtttacaacatggcaacagcctctctagttagtatgagcaagccccagaagcacatttgccatattctaattattagatacaaatcaataggctcgaggtgaggggattacacaaggacaaggatactgggaggtggaatcatgggaaaccgttttacatgctgcctaccactcacgtaatatcctagtataataaaatcatcagctcttactaataaggacattttaccttttagttttcattcataaaacatctattgcccaacagagaaaacgatgctgaattttaattttataaggagaaaccacaaaataaaagacttgtagaagtgttctcttttgccccttcttggtttttgtttgcaaaaaattatggaaaattttcagcagtaaaagattaaaatattaacaaaattatatatagcttttactattttttaaatgcaaaaattcatttgtttcctacacaagtaaccagattttcaaattctactatagacacttgtaaacacaaacattcatatttaaaatgtattaaataaaatattttaaattttcaaaattttaattttataatgatttgatattttattcttaagctagtaatgacattggcttttttgatcaggaaacaggaaataagagatattaaagacatggaaaattatgcatggatctacaaatacaacataaatttaacttctcagtatatcctaacacatatattttttcttctaaaatggaaataaattgcaaccaaataaaaccttatatttctgtattagatattttaatactttactgcagaaatatatataatatataccttatatttgtgtattagatattttaatacttcactgcatatatatatatggttatatatatatatataaccaaactgtcgatttcatatacttctagtgaacagaaatgtgtatttatatatggcattataaatttatagaagggccttggacatcctctagtcctaggtttgtactgtgtatctaactaaactgaaacacaaaggcatcaggtgaaaggctgaaggctacacctaagtagctgaagtaaatccactttaagtacacgcatgcttactacactttaaaaaacttttatgccttgacattattgaaatattctgcagatactttgcatagaatcacagggccagaataatttttagttttatttacttggtctagattttgtcatcacaaatctgagaatggagctaaaaatcacagcctgtaggattcctccattctatttttggagccaatgaagtttcttacatttggccagccctctctcaaatgcttgcaattgggtaacattgttcctgtgagggaaggtcgaatatcacagaggttatcttataaaacctcatcatttttacaatgccaagatatatagacacttagatggggagtttggaagagtaaaataaaggtcaattagaaaactatgcacatgttcatgtaagagatgatggtgacattgactgaggttataatcatggggatgaaaaggctattttttgaaaatgtcattctcctaatcaaaaaacttcagtactatcccattcacattttttaaaggccaaacttctaaattgaacttttataaacgttgttgagcatttgcagtatttttctttcatagaaaaagaagcactatttttcttacagtaaatgcaagaagcttttaatctacttgaaattcactccacctgaaattcactctaccgtccattctttaaaaatataatcctttcttcaagtccctgctcaaatccctcctgctccaacaagacatccctggtgagcctagctgcttttattcctcctacctctaatctctttaatatttctttgttttgttgtgcttttatcaaaggcaccaacagatgctgccttttatgacagttagggttatctatctgtgaaccactagatcatgcttcgcaaggcattgtattccctgtgtccagcactgagctttgcaccaagggcacatttcataagtattttttgtaagataaatggaaataatgaattcattactagagctgatggtgccctcagagcaactgatctcagatatatttgtggctgaggtcaacaaaagacgagacaattactggttttatatctcttaaaagctgagtcaaacctttaataaatttactgtgactggaaacctattccatatttatttcactattaactgttctccagttttcagcataatttatatgcaccttactctatgaaaacttctaagaacagtttgcctgttcattatttatgccaatgcctataacttaaaagtaaattattcctattttgcttaatttaattttattatatataagccatttgataaatatacataaacactttcatagttatgtaacatttactaatatagattttaaagcacatataatttgtatagttgccatgcaaacatcagactatcaaatattgataaactggttactgatagaaaatccagtctctacatttaagaaagagtttttttcttctaattacagaaggagtatcccttctctgaaatgctcgggacaagaagtgtttcacattttggattatttcagattgtgggatatttgcgttatacttaggttcagtattcctaatccaacatgcctcaatgagtacttcctttgagcatgatgttggtgctcagaaagtttcagattttggaacattttggattttggagttctggattcgacatgctcaacctgtattattttcttatcaacttcaccactttattgtcttccacagtcaaagcaaggtatgagtcaaagatatcaaacttagagggaagaaaatcccattgaggctactgtctatgcataaacaaaggaaattcaaatatcaccacataagttattacaaatttacatattaaaacatggatcaactccccttttctaaattggcaactataattccactcaagtgacaggtttgtatacaaataagaggataagctgttagcagttactgaacactgagaccaaatcataactcaggattgcaaagtgctcatgaatgtggagagatatagtcattgcctaataattaattttaattttttaccaaaattagacttcttataatttcattaaaagtcacaaaagaatcaaatcagtataatttttaatttactctgaaaggcattttctttacattttcctaacatctgtattattagaatatctttggccttatatcattactaaataatgagatagttgaaggaaatgacattttaggagttctaaatgagggacatatctcctccatattccataatccaaaatggtgccttcttgaggaaggataaatgtggagaagaaaggagaggggagcctgcttaatgagatgcagctggattcatagtgtggcctgatagtaagtcccaaatcaaattcttactcacatgcttttgagatagcctcccattagaacccctttcctcttttcccaccccacatacttagcatggcagagggtaggcagatgccaggtgtattttattatgaggtcaatgagtaacaattctgttcctctctcttttgaagcctgttataatacggctacaatgttataaagcaatcatattttattcttttccccagcccacatcatgaatgttaagcaaaaggggagactgaatattacattgaggatgaactgcaaaatactaaagtcccttatgatagtgtttaatcctttattgatcaatgtttcacaaaggtgcattggtcattaccactgctgtacctttggttagatccatttatctgcctggaacatcctctcatttctcatttatctcacttatatcctactgatatttccagaccttgttgaagcccaccttctacatggaactaattttttttttcttgagacagagtgccactcttgacgcccagactggagtgcaatggcaggatctcagctcactgcaacctccacctcccgggtacaagtgattctgctgccccagtctcccaagtggctgggattacaggtgcccgccaccatgcccagctaattttttgtattttttgtagagacagggtttcaccatgttggtcaggctggtcttgaactcctgacctcaggtgatccacccgcctcagcctcccaaaatgctgggattacaggtgtgagccaaggcacccggccgctttctaattttttaatctactttaggtgaatcacaccctcctttgatatcttcctgaatatttcctataccttgtgatagagacagcagagtatagcacagtctttcccaaaatatctttctaatatccttatttgaaaggaaatgttgaagacttaaaaagcatattgatgtgtggaagtctttgaaaagtccttgagtaaatgaagaagtttgttcaactttttaaaactgaacatttcttaaacttctacaacaattgcatctttatttcatgtaataaccttcttgcaaaatacactggagaaatagaaatatatacaggtttggggccagacagacttgagtttataccttacttccatggcttaataaaccatctcattacatttacttaaatcactttaagcttctgtttttgcattaggcataaagaaatgtttcataccagtaggtattccaaaatatgcttcttttatattgtttctccacaggccctgaaattcaattgttttatgcagtttagtgtgttttcttctacagagcaggatatatgttgtgtgcatcttttaaatattaattacaatcttgcacatgataggtgtgggatagattatttctgcctgagtaaagctttatagtgtggctacattgtttagcatttctgatgtagaagatatacaacttttagattcattaacaaaaattttttacattagttctaattttgaatgcccgatgtcattattctcttacatcaaccatatatttgagagttggtggattgttgggttgtctatctaatttcatgagtatattcaatctcagttattcctcatgctgaaactgtcttatcattattgttactgctaatgcatgtcagaagatcacgtgattctggtggtgctgtgactatgaaaatttcataattcaagatatttataaaatcacattatgggaggattccttaaatagtggactctctttaataggcaaactcacacctacaaataaataactttgttttagccagatatgtagtctttatctctgagaaagtttggattgtggttttgaaagatgattacttttggttttgaattcatttcttacaattagtctaatgatccattctttcctggagggcttaatttgtgagttctgtcctctgtaacaacatgaaatctccttgaaaagaacaagttcagtttatttagactgaggccattgcaataaagaacaaagttcagtttgtgctgttctctaagtgccatagataaaattattctgattttccccaaggttaatgggcacagggtgacatttaaatgatattgtaataatctaataatttccagtgctaattagtacaatcccaaaccatgagtgaacataattaaaaatgttttctctttttgagggtaagtaccataacttcacaactaatctaatggtaggtgcttcattacagtttatgcaaacattgaattttactataaatatttggataaattatattccaagtagtactaacagtcaattctcattttttctgcattgcctgctttatgtagagcccccacacacagatcagtgaggagctgctatgtctcctgtgcccggtaggcccgacctagaaacatgaaggaacatagatgggcaatgagtatcatgagaagaacctgggctttggagtccaaactggatttgaatcttggctctccaaaccacattttatttatctatgatgcctgcctcacaaaattttagtaaaaattcaatttatctttactaaggctatattaaaatatgtaatcgttttacatacatcatgtatatgtaaaatgcctggcagagtgccctgatgctaagagctctcatatacatagttcccttttactatgaaattttactacggaatcactttacagtcttatatttatcaataataagtaatgtaggtattctatttatagttctaaattacccaggcctactctttttctcttggagtcagctgcatatttgatagaatcttcttcccatgactttgagactgcctcatgagtggcagtggcctttgtggagtaactattatcagagtgatttggggaaggattaaattgtcatccctccaccatgctccccgtttctagtttaatggtttaaaaaatggttttatggttgttaggattatgtgctaataatattagttaagcttttagaaagtttggaaagtgagaagctgctaaggaatggaatgagttctctatgtcctcaactagaagctcttttcccctccactacttgtttgtggtatccttcaagagctagtaggcttattaacttttctgcctcagtaatgtgtgcataatatataaactaaagaagtgctgagctggaaaattgattttatgcttatagtggtttaaaatttctaccaagcctaataatattactatttttttctctaagagctactattttccgttgcaaaaatagcaggagaggattatgtatagttctaattttaccacactcctcctgaatacaattcttccagaaacacttaatgcttttttcttttttattctttaatgactgcctagtatattgtctcagtattataagtctctttccttaccagattttcagcatatgactaatgagggaagccagtcaactcagatcattttttatttctgagatttatgtaaagttaatgacatcttaaatataattgtgtcaaattagtcagatatttttctgtatcttccttctagttccaacctactcagttacctttacttctctctacaccttctcatggaccctagtgttcagctaaatgaaatacctatcagtgcgcactccatacattatctacttccatgacttttcttacgctgttcctttctcaatttgtcctttctttactctttaatgtcttacttctacctattcttcaaggttctacttaaactatattcttctacataacattctttcatctatccatgatttctgaatctcttttaatctttatatatttaatccaaatacatggattatgtcacattttattacatatttggaaactcatgggtctgtcttacccttagtcctagtctatacaccaaatgaaataagaaattatgtctgtggtatttaatacttaggtttcatccatatggggaaaaataaactctaagaatcagacaaaaattattttaaataaggctaacttatttagaccatagtcatacccatatgaaattaatgtgatttaattaattactagtatgcacagaaaaatatgaggtatgaaagctgattttaaaaaaatcattgttgcccctgagggataaaattttaatggagaagaaagacatataagcattacattagtacaaatcaaggttgatagacacttaaacaagtgccaatagagcacctgataatatcgagaggagaggtcatttcatcttaaaattcatgataatataaagcattcctttttaaatgaaattgaagaaggccatctctttagagagtagaagggtttctatcccttatcagtactgagaacaatacagttttgaaaataaagaaatataaatttaacatctaaaagaatctcaagtgctctcttcggcagtacatacactaaaagaatcttaaacattcctaaggcaaatgtttcagttaaagggggttaaccaatacacttaaaatgcaaacattactttgtgaaacatgttgaaattaaaaataataaagccaaactatttggaatgtcatatatttataaaatatatattttcgtgctacaaggccaaatatatttttttctttccagtcctaaaatatgccctgtatcgtcagtgtagtttgtaggtctgttcatcaaaagagtgggaagtatatcatgccagaatgcatttgctgttcccctatcaagtgatcaccattgttattggctttagaattattagcttctgtacctggatctgaccttaattttaaccacaaatgtgggaatggttttgacaaggcatacagttttggcaagtcacctcacttgggtactaattacttctgggtacccagttactcctgggtcctaattttatctttaaatgcttgttatgttacttattactttcatatgagaattttgataatatgttgtattaaaaaattattagttttatagtgatcaatcaatgaggaaattctctgaaagtgatgtttctttacaagaaaagcacccaggctggaaacaatataaacattgtaaaaatatgtgaatcaacactgtcaattcatattatttttcttagtatagttttagtttactgaattcatatgcttgctaagagctagaagctttatatatattcccactttatatgacagtataagaagatcaaactattatatcccacaggggaaatattttaaatctttcacaattgctggttttccccttaacacaatttcttgattataacatttaagctattatactgctatctatctatctatctactaaattttatctatctatttatctatccatttctatagctagactataatctcttcaagactggtatctgacttcagtttctactactagttcctaacgcagcggtacagttcctggcatatgtacatactcctatagtgtgtgctaaagaaaggaaagaaattaacaagtctttttctcccatgttgtataagcccagtactagttgctctcagacactagtgaataatttattactgttcatagtttaaagaatgctgataattgagtgtattggtttgttattgctgtgtaacaaattaccacaaacttagcaatttaaaacagcacatatttattaattcacagttttgtatgttagaagtctggcactgtgtggttctctcctcagggtatcacaaagaagaaatcaagtattacctaggttgagtttacctatacaatccctatgtgtaagctaggaatatttggaaacagtggaggttcatgtgttcttcgctgaccgtttatggttttgaaggcctaagaggtttcaataaactatgtcgatatgcctagcagctggcgcaaaatttttggtgaagtatttacttaatttggggaggtatgtgtgatgcatgttaagataaaagtaaagctgctcaatggagagcatctcaaaatatgattttcatgcatagaaaaaagctaaaaaatattattcaattcaatatggaaatatttctgtttttttttaagatggaaaatgatgccccagagtcattattctgcatagcacgtaactatctaattgcatttagagaaataaaataaagtttgccaacaacgaaaaagggggaccagaaaatttgttgacagcatatccaatgaacacagtttcggacaataggatgcatgttaagcctgactggatctattcattctcctgtcaacagctggcatgcctccttcacaatggcagaaaagctacaggaagtttctctttggaaaacatgttgagaaattttcttgtctctctatgctccttactgtacactgagatatttttctagagaatgagtgaagaaattatgctattactatagagtgataactaatttacactatgtaaagggatagcacagatattgttttattcacactaaaagcaaataattggaagaatttctatgtaactatgaaaactagaaataaatggtgctaaaatgtgcaaaagatgatacattttcaggcacatattacagagtttcactcaaagtatgactagtatgtgaaatgctggtactcagttgtggatgattttcactgcagtggttaggtaggaaagcttactattaaaagtttttgaatcttatatccccgtttctgaagagctgcccactctggagatttgtttcactgtgattaacattgtacctctcatttacttacttgtcagaggttttattcagttagtatctttttctaaatagttacaccttaaaagtttaaaaatgatcagatttgtatttgattgttcactacttcacttgcaaaaacaagtattacagaaaagtaatatgttaacattagtttatgtatgaaataacctgcaataccaccaaaacttatcggatcagataacctccagttgacattagcaagctttctaatggtgtcatttcttcttttttgaattcctttataattccctctgacatttttaacttcaaaattatattcttctcaaataatagaatatgttgttttctactacatataaatgatttaactacacagtggtttttcttatttttgagttagatacctgataggcttacatttgccacttctataggaaaatgtgcttgcttagattcacggcatatttgaatatctatagcattactgaactgtgatgatttctgctggttcgtcatatcttaattcaagaaggatacttgggaatttgttaaatatttgcgctaataaatctaattgcatttagagaaataaagtttcatcgggaaaataggatgctagagcttgcagcttttcaggacactcttcaattagtgatttataaaagcatctacaaggtgaagtcaaaggcagataaacctcagatatgatctcttgccaacaattttgtctcaagaacttggtatacatactttaagtattctttagaagtcttactacactattaattttatgattgttgatatcttttaaaatattcaatcatataatcgtattttatctatctattcaatgaatttctactacttacctaatatgcgatgaacacatttctttgcattggtaattcagagttaacacagcaaacaaaaccccttgccctcatggaaagtgcatttgaaagagaaggaaataataaacaagagatatatagttaagatatgtaatgcatcagatggccatataaactatgaagtaaaataaagcagggatggcagaaagggattgaaggcagaggctgcagttttaaacagggtcatcaaggagggtctcactaagaagttgagcaagacctgaagcagttgaggagaagctgtgtttttctgtaagagaaggagcattacaactagaaggaataacgagatcaggactgctgagatgggaatatactttttgtattgcaggagcaacaaaaagacttgggtaactggatgtcagtgaggaagaggcggaatactaggatctgaggtctgaaatttaacaaagtgtctgattatagaagactcaataagccctgggaggattttgacagtttctacaggtgtgtcgagatgccattcaaggctgccctgacatacaaagaaacttttacaacaatcttttgtctccccatggtttctctcaagttttttgttggttcctcagatatgtgctacctttattcttctgaagtttctgaatatttgattttggtggcgggaatgaggaactctactagtctgtcatcttgtcagaacttgaagtgcaaaatttcattaaaaaatatgtattttttcagttttatttcaagttcaggggtacatgtgcaggtttgttatataggtaaacttgtgtcatgagggtttgttctacagattatttcattacccaggtattaagcctagtacccattagttacattttctgatcctctccctcttcccaccttcaccctccagtaggtcccagtgtctgttgttcccctccatgtgaccatgtgttctcatcatttagctccaacttataagtgagaatgtgctatatttggttttctgttcctgcattagtttgctagagttaacagcttccagctccatccattttcctgcaaataatatgatcttgttctttattatggctgcatactattccatgatgtatatgtaccacattttctttctttttttaaattcccaacttttaagttaaagggtacatgtgcaagacatgccggcttgttaaataggcaaaagtgtgccatggtggtttggtgcacagatcatcttatcacccaggtgttaagccaacatccattattcttcctgatgctctctctccttccaccccacaccctccaacaggccccagtgtatcttgctacctgacatgtgtccatgtgttcttatcatttcactcccacgtataagtgagaaaaggtggcacttggttctctgttcctgaattagtttgctaaggataatggcctccagctccatccatgtccatgcaaataacatgatctcattcatttttatggctgcatagtattctatggtgtatatttaccatattttctttatcctgtctaacattgatgaatgtttaggttgattccgtgtctttgttattgtgaatagtgctgtaataaacattcacgtgcatgtatctttataataaaatgatttatattccttcgggtatatacccagtagtgagagtgttgggttaaatggtatttctgtctctaggtctttgaggaatcaccacattgtcttccacaagggttgcactaacttatgttcctaccaacattgtaaaaacagtccttcattttccacaaccttgccagcatctgttgtttattgactttttaatgtctattctgagtggtgtgagatggtatctcattgtcattttgatttgtatttctctaataatcagtggggttgatcttttttcatgttttttggctacatgtatgccttcttttgagaagtgtctgttcatgtccaatgcccactttttaatgttttttttccttcttgtgagtttaggttccttatagatgctggatattagacctttgtcaaatgggtagattgcaaaaactttctcccattctgtaggtggtatttttactctgttgatactttcttttgctgtgcagaagcgctttagtttaattagatcccatctgtcaatttttgcttttgttgcataacttttgatgttttttcatgaaatctttgcctatgcctatgtcctgaagtgtattgcctaggttttcttcaagggtttgtttagtttaccactttacatttaaacatttaatccatcttgagttgattttcatatgtggtgtaaggaaggggtccagtttcagtcttctgcatatggctagctagttctcagagcaccatttattgaacagggtatcttttcctcattccttgtttttctcctttatcaaagatcagatgcttatagttgtttagtcttatttttgggctctctatgctatttcattggtctatgtgtctgtttctataccagtaccatgctgttttggttactgtagccctgtggtatagtttgaagtgagatagcatgaagcctttgggtttgttctttttgcttaggattgtcttggttatttgggctctttttggctccataagaattttagaatatctttttctaattctgtgaagaatgccaatgtgagtttaatgggaataatattgaatctataaattgctttgagcagtgtggtcattttcatgatattaattcttcctatccatgagcatgaaatgtttttccatttgtttgtgtcatttctgatttatttgacagtggtttatagtttttcttgaagagagccttcacttcccttgttatctcctaggtattttattcttttggtggcatttgtgaatgggagatcatttgtgatttggtgctcagcttgtctgttgttggcatataggaatgctactggtttttacatatttatttttatcttgagactttgctaaaattgtgtatcagtttaagcagcttttcaactggatgacggagttttctagatacagcattatgtcatctgcaaacaaggatattttgactccctgtctttgtatttgaatgtctttctttctttcttttgcctgattgccctggctagaacttccaatactatgttgaataggagttttgacagtggacaagcttgtcttgtgccggttttacaaggggagtgcttccagtttttgccactcagtatgatattggctgtgggtatagcatatatggctgttattattttgaggtatgttccttcaatacatggtttattgagagtttttaatatgaagggatgttgaattttatggaaggtcttttctgaatctattgagataatcacatggattttgtttttagctctctttatgtgatgaatcacatgtattgatttgccaacaaagatcaaaagagacaaagaaggccattacataatggtaaagggatcaattcaacaagaagagctaactatcctaaatatatatgcacccaatacaggagcaccaagattcatagagcaagtctttagagacctacaaagagacttagactcccacacaataataatgcgagactttaacaccccactgtcaacattagacagatcaatgagacagaaagttaacaaggatatccaggaattgaactcagctctgcaccaaatggacctaatagacatctacagaactctccaccccaaatcaacagaatatacattcttctcagcaccacaccgcacttattccaaaattgaccacatagttggaagtaaagcactcctcagcaaatgtaaaagaacagaaattataacaaactgtctctcagaccacagtgcaatcaaactagaactcaggattaagaaactcactcaaaaccactcaactacatggaaactgaacaacctgctcctgaatgactactgggtacataacaaaatgaaggcagaaataaagatgttctttgaaaccaatgagaacaaagacataacataccagaatctctgggacacattcaaggcagtgtgtggaaggaaatttatagcactaaatgcctacaagagaaagtagaaaagatctaaaattgacaccctaacatcacaattaaaagaactagagaagcaagaacaaacacattcaaaagctagcagaaagcaagaaataactaagatcagagcagaactgaaggaaatagagacacaaaaaacccttcaaaaaattaatgaatccaggagctggttttttgaaaagatcaacaaattgatagactgctagcaagactaataaagaagaaaaaagagaagaatcaaatagatgcaataaaaaatgataaaggggatatcaccaccgatcccacagaaatacaaactaccatcagataatactataaacacctctctgcaaataaactagaaaatctacaagaaatggataaattcctcgacacatacaccctcccaagactaaaccaggaagaagttgaatctctctgaatagaccaataacaggctttgaaattgaggcaataattaatagcttaccaatcaaaaaaagtccaggaccagaaggattcacagccgaattctacctgaggtacaaggaggagctggtaccattccttctgaaatgattccaatcaatagaaaaagagggaatcctccctaactcattttaagaggccagcatcatcctgataccaaagcctggcagagatacaacaaaaaaagagaattttagacatttattgatttgcatatgttgaatcagccttgcatcctggagatttgtgtatgttgaaccatccttgcatcctacttgatcatggcagataaactttttgatgtgctgttggattcggtttagcagtgttttgttgagtattttcacatagatgttcaccaaggatattggcctgaagttttctttttttcttgtatctgtcagattttggtatcagaatgatgatggcctcatagaatgagttaaggaggagtccttctttttcatttttttttggaatagtatcagtaggaatggtactggcttttctttgtacctctggtagaattcacccatgaatctatctggccctgggctttttttggttattaggctatttattactgcctcagtttcagaactcattattgccctgttcaagcattccgtttcttcctggttcagtcttgggagagtgtacgtttccaggaatttgttcatttcttctagattgtccagtttatgtgcacagacgtgtttatagtatcctctgatggttgtctgtatttctttggggtcagtggtgatatctcccttatcatttctgattgcatttatttgaatattatttcttttcttctttattattctagtgaggagtctattttatttttttcaaaaaaacagcttctggatttcagttttcgaagggtttttcatgtctctatctccttcagttctgctctgatcttgattatttcttatcttctgctagcattggggtttgtttgctcttggttctctagttcttttgttgtgatgttagagtgtcaatttgagatctttctagctgtttgatgtgggcagttagtgctataaatttccctcttgacactgctttagctgcatcccagttaatctggtatgttgtttctctgttgtcattagttacaaagaacttgtttgtttctaccttaatttcattatttacccaaaagtcattcaggagcaggttgttcaatttccatgtagttgtatggttttgagtgaacttctgaatcttgagttctaattttattgcactgtggtctgagggactgtttgttattatttcaattatcttgcatttgctgaggtgtgttttacttccaattatgtgattgattttagagtaagtgacatgttccactgagaagaatgtacattccattgctttggggtagagagttctgtagatatctatcaggtcaacttgatccagagctgagttcatgtcctgagtatctgtgaatttactgtctcaatgatctagtattttcagtggggtgtgaaaggctcacagtattactttgtagaagcctaagtctctttaaaggtccctaagaacttgcttatgagtctgggtgctcctgtattgggtgcatatatatttaagatagttagctgttcttgttgaattgaaccctttacctttaggtaatccccttctttgtcttttgttctttgttggtttaaagtctgttttgtcagaaactaggattgcaacccctgctattttcctgttttccatttcctgggtaaattttcctccaacgcctatgtgtgtctttgtatgtgagacgagtcccttgaagacagcataccaatgggttttagttctgtacccagcttgccattctttgtcttttaaatgggggcatttatcccatttatatttaagattagtatttttatgtgtgtatttgatcctgtcatcatgatggtattataactggttattttgtacacatgtttatgtgattgctatatagtgttactggtctgtactttagtatttttttttttttttttttgtggctggtaatggtttttgctttccatatttagtgcttccttcaggagctcttgtaacacaagtctggtggtgacaaattccctacacattttcttgtctgaaaacgacctctttctcttatgaaaggatctcctctcctttatttttgaagctgagtttgtccagatatgaaattctagattggaaattctgttctttaaaatgttacattttgccctccaatctctgggttttagggtttctgctgagaggtccactgttagtctgatgggcttccctttgtcggtcacctgcgttttctctctagctgctcttaacactttttctttcattttgaccttggagaatctgatgattatgtgtcttggggatgatcttctcatggagtatcttattggggttttctacatttcctgaatttgaatgttggcctttcttgctaggttggggaagttctcctgataatatctagaagtatgtttgttaaattatttccattatctttatctctttcaggtaccccaatcagttatagattctgtctctttagataatcccatatttcctgaaggttttgttcattcctttttctctattcttgtctgactctcttatttcagaaatatagtcttcaagttcagaaagtcttgcctcctcttgacctattctgctattaatgcttgtaattgcaatgggaaattcttgtagtgtgtttttcagcttcatcaggttggttatgttcctctacattgtggctattttgcctgtcagcccctgtattgttttaccatcatgcttaggttatttgcattgggttacaacatgctcctttagctcagcaaagtttgtttttatctgcattttgaagtctacttctgtcatttcagccatgtcagcctcagcccagttctgagcccttgctggtgagatggttcagtcatttagaggaaaagggacactctggctttgtgagttttctgtgtttttgcaatggttctttctcatatttgtggacttatctacccatgatctttgattttgctgacttttcgatgggtttttttgtggtttttgttgttgtttgtttttatgtttatttgttttagccttgctgcagtttgatgggggtcagctatagaccctagtcacctcattttttcccaaacctggaggtatcaacagtaaaggctgcaaaacagcaaatatggcagcctgtcccttcctctggaagctccattccaggggatactgactggttgccagcctgaaccctcctgtaggaggtggctggagtccttgggcaactcttcagctcccaatcctttagggctctcgaaggcccacagtctggaccagctgagatatttgaacagccaaggtggtggccacccccgttgttctccagacactccctcccagagagaaattagaactgttggctcttgaacatggacagggtggccagaagccctggctgggaggaccctcccatgagaaggagtggatcagggtcccccttaaagaagcagtctggatatgtcttgacaaacagctctgccatgctaaggaaccgcctctgcccattggcttggactctccaaagcccacaggctggaatggctgagttgtctaaacaaccaaggtggcaatctgcctttgcccgagggcactctgtaccagagagaagtcagcactttatctatagaatatgtgcaggcaggcatggctggagaccccagctgggaggtcccatccactgagaaggaatggaccagggtcctgcttatggaagcactccagccatgttctggcaaagcagctgtgctgcactgttggaatccttccttgtccggaccatttggactctccaaaacccacaagctggaatagctgattggactaaacagcagatatggtggcctggtccctcccccagagggctccatctcctctcaggcaggctccactctgttgctggtggctgctctggattccaaaccagtgggtcttatcctgtgagatgctatggaagttgggcctgaagactggcactgctcggctccctggattcagcccccttcctagggacatctcctaggaaggaccttctgccttgcttgagctgcagacaaccttgccagggttcctggggctggagtatgtaaagctcctggatctctgcatgtgcctgagcatctggtctcctgagactttgcccagcttagtgtgtcagacactggtggcatgggcccatgatgggacctcctgatccatggtttgcaaagctctgtggtagaagtgtggtttcctgggatcacacaatcactcatcgcttcccttagctggtattggagatcccttggctctgttgctcctgggtgggccattgctcctgggtgtgccgttgccccaccctgctttttttcattctgggtctgggatctgttctagcccctcttctttctctttgggctattttttaatatgataacatcttgtctcagatttttaatttccaaaggtaccttgattactttcaaatatatgtctgcagttcagacatctttctcttaagctccattttctacatatttaattgccaacataaattctccattttgattttaataggcttcagaagcatagcatattcgaaagggaaccattgatttacctcttgttactttgtcagttatcactgtttctgtaaaatggaatctccatcaactcagtgatcaggggactggaagtttctttgtggctgaagaacagatgtaatggaatgagtcttgaaaaaaagactgtgtagagtgttagataatagatttcaagatttctcatatagagtatacaggggatgtcagggacctgtcactggctgtgggtttagtggaggtataaacattaggattaagaaaaatgagattgagttgttactaaggtaaataagtcaactgttatcaccaaggatgatggtaggaccgaggacagagagaaagatgttgaaccaggtttcaatttacaaaatgaacttagtcatctgggcaggaggtagtcaagtgacagtgatgagaaggatcagagggtaggacagttaaatggcaagggattcagaagagatgattttactccataatggaagagtaactgtttggcattgtttttgaggagctaagcaatgttagctggttgtaacaggacttggtatgtgaaaaaataaatctccagttgaaaggactacaggaagagcaaggtcctctagagaaagctagaatttaataaaagctaggattcttctataaaggagttgaaaatattaatgaaatggaattaccatggaattaggtggtcagagtggagaacaattagcattgtgtaaaggtatggtgggcttttgtcaaaggaaaaacaatataaagaaaatgaggagctgatgaatggttagagatatacattttgggcggtaagcaaagatgccagtggtgaatcacgatgggattagctggcctcaaagtctcagtgagaatctcacataaattaaatggtgttttttccaaggttcaagtgaagatttgggatgacttactaaaattttctgaaacttagtttcttcttcttcttcttcttcttcttcttcttcttcttcttcttcttcttcttcttcttcttcttcttcttctttttcttattattattattacactttaagttttagggtacatgtgcacaacgtgcaggttagttacatatgtatacatgtgccatgctggtgtgctgcacccattgacttatcatttagcattaggtatatctcctaatgctatccctcccccctccccccaccccacaacagtccccagagtgtgatgttccccttcccgtgtccatgtgttctcattgttcaattcccacctatgagtgagaacatgaagtgtttggttttttgtccttgcgatagtttactgagaatgatgatttccaatttcatccatgtccctacaaaggacatgaactcatcatttttatttaaaatggaattattaaaagatagagcctctcaggtctggctgcctaaagcttgaaaagctacctctttaataaagcaaaagatatatggaaaacaacataattaaatagagaataacatcttcagaaatttatggaagcatggcctagtgactcacacctgtcatcccagtcactctggaggctgaggcagttgcttgagttcagaagttcaagaccagtctgggcaaactcatttcaacaacaaaaatatcattatctatctatctatcaatctatctatctatctatctatctatctatctacatatttgaattcttgtaattaccattttgacatgcatcatatatattttgttcaaactcttaataatgtagtaccagattacttcatcattagatcacaattttcaaaacactgaaatgcacatcgaggtcactgtaaattttcatctatttaccaaaaaaccagaattcacagatacaaatgtttgccaatttgctttatagcttatgttaaaggaaggaaacttgtttcttttttatttaaacaacaatattttttgagttttaatctgaagtcttaagatatatatcatagtagaagatcccgagaaatctccttatgtttcccttatgtacttcaactatggtcttcatacaccaggagggcataagaatttatccaaacgtgacttttattttattttttttaacttgagctctgtggtaaattacttaatatcaagttccataagtaaacattcttgctggacatattttgacttttagataatttttcaatatgtgtttaaaaggccacagtgtatactctatcatcgcttttaacatggcccacaaatcatttataaattattcactctttccagctcttttttgtttctttttcttcaaaagaggattactacattccatgtcttggtgtcaaactgtctaagaaaataaattaagaacacagtttgaaggcattcactgtttttctctttccctaacacattattccaaaagcagaatattttttctcaagaatggactacatttttaacatagatacagtttatataggataaaaactataggtcttggaacccagagagttttagatttaagtcctatatcatgtatgttttagcatgtgattaagtaattcatctaacttttctgattcttagtctcctcaactgtaaaatgaggattaagagagataacctacaaaaatgataaagtttaaaaacattatttcttttttcttagtatgaataaaacttacagtggcaagcatacacaactttgaccattttgtaaggtttattttctagcaagttattattaaaatactatttagaaattgatttttcttaagtaattgatatacaaaatgtcagagactgtgactatgatacagatcttaaaagatgaaactgagtctattatactatatatgtatacatatgtatataatatatatattttatatatgtgtatatattttatatatgtatatgtattttacatatatattttatatatagtataatggactcagttaatttcatcatatctacatatatacatataaatatatatatagtataatttgctgttatatatattgcagctaataaatacctagaaaatttgccgtccttctgagggaaactcatgtctcctttacagttgtctagtctacagttataatagaatttctgttttcttaatgcttttgaaatattttacatggcaattccctggaaatatctgtatattttataggacatattggaaaaataatcagtggatatctgtaaaatcttcattgttgctagttaaatgtacattcatgtaataaagaagaagaaaaaaattacaaatgagttcagagttaataaattatgaagtttgagatttatattggaagagtaccattttcctacctgaaatattctacaggctgcaatctgttactttagaactaaaacagtagtttacagaagttttaaaatgctcaattacaagaaacttatttattttggcccattcagataggtaaaatgatttttcatctcaaagtagagtaaatttttgtcttaaacataaaattagaatttttactctgtagaagacagcctacactatattatttgtgtgcaaaatgagtttgacccttctaagaggatcacattcacattatggtttcatacagatatttctttggcatatgattttacttatagtagtataggccaattctcacattttttttgtggaagttgaaggtaatactaaaaaggtagagtaaattgttacaagaagaaaaatgttaaatctgttcaatttctaaaaatatctgcaacttttctccatgaacatacttttcagtagctaccttatcagctttttgcctatttgtttttttttttttttaaatgcatcaggtcagtttgggaagaatttgaattggtgtgcagtgttcaaagtgtctattgtcaaaccaattctttttgttcttgtcatggcagaattttgtaataataggatattgtttcaattagatgtatgcaatagagaaagagactgcaacatagcacacaaggttctggttgaatcttcacggattcagtaagaagagatgtaaactaatttagagttaaacattgctgcctttatacaagaaaaaatccagatatttgagctttcactgtccagtccccccacccttttttttttttttttagaaatagtcacaagtactctttaaaaaattgcaaagtattcctattcaaagaattgatctttgaaatgtttattcactaaactagtataaaatgcataaactattctgagaggattgatattccaacatgaaattattttaaaaattaacctcttactatgctccatgtggatgactcagcttacctgttccttaggcaagcaccctacatttccttttctcccacatacttctggaagacacacagcagtcagacttttccagtgatagtattatcagtttaaatgtgctttgggtttctggataactatacaggttttccaaacgaaatgtgatttcacatgttattggagagtaaggctaagaaaagggtcttgtgttagaatgaagaatccctttgaatttgacttatttcacactatgagcaaatgtcacattcaaacataaatctctggagaaatctctggagacagtactgaaaatttctcttcttggtctatgatttagaccttctcattttaagtcactatatcaaaaatatattgaagaaaacagaatttaaaggtgtctgaattattaaaaatatttcggacactagctaaatgtaaattacaatgcacattcaaggatttctgtataatcattttaaatatctgcgtggaattttctccttccactcatacctttctacactatatcataactaataccctctgtgatcttgacaatatcctctttgaacttgatttcctatgtttaaaataaaaatgatgctttcctataggctaactaattatggtgggtggaatggaagttaatattataaggcactttgaactctcagaacaaagtgctaagtaagcactagacagtggaaaataacgagccagatagtttctgtacctggccacaatttgaatattatagacctaagtaaattatcaatgttccttaatatataaagtcaataactttatatattttatacaatttttattttatattttattgtcactctcttaggattattcgtcactaaagtaagcaacaacaacaacaaaactccttagaaattgaaaggctagagatttgttctgaattctgcatttaaaaatatgtcatagtccatattctattggaactcacttaacactattccaaggtaactgcaaagattgttatttaaactaaggtttagaaattcatatcaatttacatctttatatatattaattatccctaaacacccttaaatataaagtttgtataaaaacaggtaaatcaacttctgatatagtataaattaaatcactgagacaaatattgaacttcaaagtatgcaaaaagtactagaaattttataaaaatatgcctaattaataaaattttataaaacaaaatgtaagactgaaacctatttgagaattttaatatacaataaaattttattataattattatgaaatgatgggtgttgtggcttatgcctgtgatctcagcgctttgggatgcagaggtacagtgatagtatagtttctcaagtgaggaacacttgagctcagaagttcgagataagcctgggcaacaacgtgagaccccagtctctacaaaaaatttaaaaattagccaagcttggttgcatgcccctgtagttccaactactcagggagcagagacaggaggatcaggtgagtcggggagattgagactgcagtgagccatggctgtataattacactctagcctgggtgacagagaaagactctgtctctctctatatatattattatgaaagtaaaaatatacatattattttcttatctggaaatttgttttaatgtatatattgccagttattaagcttctagtgttttcagaagattgctaagaaactgagagctgtggattctgcagcaattattactagcttgggcctagggaaagttacttaacctgagtttcatttccctcaaagggtttttatcagaactaaataaaataatgtctatgagccacttagtacagttcctagtactaaaaaatattaactgccagtgtttctaatatttcaattattataaattggagagaaacacaacagagcacaattgtctctaattcagaataatatttgctaattgtcatgaatttgatgtatatccagcacctcctttccaacaattagagtcattgttttggtttccttctttagtcagtcagagtgcttgtgaagggttagataagatgaactgagaaaaatatacctcatgataaaaagatacagggttctgaaaaccctatttcatgcctgcaaggatattagcatagaacatattaggaaatgttctgttaaataagaggctgctgaaacatttgtaatacagaattaaattgtgaatgatatatcaacttaattaatatttcctgagcagataataattatatatatatatatacacacacatacacatatataatatacatataatttatatataaacacacgcacaaataagcacatttattacatacacacatatgtacattcattacatatacacagttgtaatatatatgtgagtatgtaataaatgtacctatttgtgcatgtgtaatataaatatataaacatgaacatgtattacataaatatatacacatatgcatatgtgcatatatatgtgtatatatttatatacacatatatgtatatatatatatgtacaaacattgccttcaccttcattgtaatgatatcccactgaaatagtagctgatactatgctaagtgaagatgcttattggtgtcaaagatactatctatgcttaagtaaagatactaaattgtatcaaaaacgctaatctcttttggtcataatactgctaatttctcttactacctagtagttttgaacatgcttaacattttttctccttgaactgagggtaacatgaatgagacaatgaaataaaggagaaatctgatttttacaatatttataatgccttttattatttgccctccttttaaaatgcctgtataatttccactggcaattgtaggaatgccatttgtagatgaaaaaaatgttataaatctcttgacttggatatatgcttacagtgcaactaacgtgtatgcaaaatgcattgtcagaattaaattaaaaactcacttgtgaatagtagcatctaaaacagaaaggatatatgatgatttaacaattctgaatagctctgcagaactgtaaatcctactgtgactaataaactccccaaggcagaaggttgcacttttttctttattttaacttcctaaactaaagtttttgaagcttctcaggcaaaggaattaaatttcatgtaaaactagtcttacgatcagcattttactacatttcatcaattttataaccttcatggcttaaaataaatggatttaatatgctaatcatcattatagtactatttattgaatatatatgtatatgtgtatatgcacacacatatatgtactgatgtaccctctgtctatatatagccaccataaaaaaaaatgcttaaagtgaaaaaagcataaaatggcagacatagctccaaacttgaaacaaggacacctaacctcctactctacatcttgtaacctttggctgtgtaatttgggtgaaaacatttaaaatgtttgcactacaatttatgaagcatgagaaggttttcataaaccatctctaaaattcctttcagctatgagtttacaaaaacaacatgattccttcttttcatgatcttcttatggcatcttatttccactatggctttattaaacacttaacccatttcaaatatttggccactaaataatttgttaaagagcacagtggcttggctttgatggttttctctgtgtttaggaaagattggtttgatgaatagatggatgaatggctggatgcatgaatgtgtgaacacaaagagaaaaagtgaggggaaaaatttggggggtagagagagtgagagcatgcacaaaagaatcatctctgttgttaaaaagaaaataaaagattcattgcatgtagcatctttgctaactttcagttaagtttattccttttatgattacctaccatatataatttatatgttagtcaaaattaagtgagtaaagagattaaaaagtttgaactttctgactaaaaaataaagatcagctatctttgattttatttggaattatgaaatccaacgaaatatttatgcacaaatgtttttatataagtttttctagatgatatgctattgatttgcaagaggaatgtagatgtgttgatgcttggtttcaatatttagagtcttttattttaaacacaacttgataaggttgttatagaatatgtatatcttccaataattctattcgctgtggaaaatttcttcaagatatatcaaattttttctcaatattgttagaggaaattatgtgcaggatgaacacataattttttctctactatcttatcaggtaaataatgtttactccacttgcctcttaaatttataagacacaaaattttcaatattcaaactaaaatgcaagtttttagtatgattattaattaccttgtgtatgattattaccttgctaacttgggttttctggaatcgtaataatgcctgtgacaacaaattaacatgcaagtacattttcaagtctacttttgttttaatttaggtttaggtgtaacttatattttatccatacatctgaatttaggtattttattttataagattatatctattttataagattatacctaatttaatgttaaaaagatttaatcaatgattcttgagtgtctaaactattcaggctcttttatacacagtgtaagtataaaaatagattatatggcctaggaaattatattttgctaattgataaggactacctctgtggtagaggaaacaccaaaaataaaaccaagaaggagaaaaatcttcgaatgtttggagacttgttgagttggttaggttagtgaacttataaatattttatttaaaaggcatatttgtgaatgtatttttgggtgaaatgattttatgatctgaagtactgacttatttcaagcacaaaaaatctacacacacacacacacacacacacacacacacacacacatacacacacacagacaccaagcatatatctattaggttaaaagaagaaatttggattgtcattttaaaaattggcaagtaagtatatgtattttgggaatatttaaatacctttctaaaacataattatgtttttttaacagaagtactgtagcttgtcagttagctttgaattgtacaataatttatgaattttcaaagggcatacctgcattaatacttttacatatgacacttcacaatgaaaatttaagccattatcattgctttaatattactataaattgtaattaagttgacaattatatttttgtagaactttgtctaaatttggtatttttttcatatatatgctaattggtccattagtccgtgaaaattgttttcagtagcattacatgtagtacaaactcataaacattaatatttttctaagatataagaagacatgtaaacatgatatagttttcatttaaaaatatatattttggccacttgcatgtcagtatgtttgtataaggattacataaagcctttatttctccccccataaaaggaacagaatatcaacctttagtgatggaaatgactaaaaattgctgtaataggaatattcaggaggtgttcctttcctgctttattgattggttattcttcccttcagtttggccaataagaaatatatagagagtactgatgaaatgctgtgtgtgtgtgtgtgtgtgtgtgtgtgtgtgtgtgtgtgtgtcagtggtggaataattattttatattgacaggtctaatctgcttttcccatgaaggttataaaataaaactgagtgtaaaatcatgctaataaaaatacctgagaaggatctagatgctttgacatcatgttaactacatagttaagaatgttacatttgagcaactatatagttaacaaagtagatctagtacctatagtattggattatctagattggtaatatttgtatattaatacaaagaatagagatgactttgctgtgactattggaagtgggtgaaattagaaaggaatttctgtcccaggatccttcctgtggaactaatcacattgttttcagaatgcttgtgttgaagacaaaatactgcatgcactcctgtagtacaaagtcagtttaagatgagatttttatagctgaagaaaaaagtaaataaataactgggatttgaaatgttggataagattttctgttctttgattacactgtttgcaataagatgaactgtttcttctgtgtacttccttgctgtttgcagaaagatgaactgtttcttttatccattttttcagtatatcttaattctgcaaaggattgactaatgtgctatcatttctgcaggtttctgctgtttattaacccaagtttaatgtttaaggcaatattaagtgttctgccatgtaatagtaaaatgcttccatcaaaaatgtattaccaatacagcagaagtcaataacgtcacctgctataaaacaaggttgataagaagcccttttttaaagactcatttagaacccacgacaacttgaaacatctttgtataaacacacattactactttgcgaatagacatttagattatctggtttaaaatgaattggttatttcagcttcaattgtaaaaaatttgtatcatacttcctaacaaactattaaagaaatttgtatatctaaacctgagagtattaaatttcaatgtaatgattaatctagatctacaaaggattatcacatattaaaataattcttatgaaagctgcttaaattagcaagataggtcaaacatttattgtctaaatgtttttacaagagcttagattaaaaagcattatctggttcagaaaagacaggttaagtaaaaattaaagtctataatatatatttgattaataaaataataatattctcactagtaaacatctgataacatattaaggaagtactcaatttatatgtcaattttaaaaattctggccaggcgcggtggctcacgcctgtaatgccagcactttgggaggccgaggtaggtggatcacgatgtcaggagatcgaaaccatcctggctaacacagtgaaaccccgtccctactacaaatacaaaaaaaaattagctgggcgcggtggcaggtgcctgtagtcccaggtaattgggaggctgaggcaggagaatggggtgaacccgggaggcggagcttgctgtgagccgagatggcgccactgcactccagcctgggcaacagagtgagactccgtctcaaaaaaaaaaaaaaaaaaaaaaaaattcttcattagtttctctcaagttctcagccatggacaggtattcaaaatatataggaaacaaggctatggcttgaggagactgatacaatccatgccaatataaaagagcagtgatggccaggcacagcggctcactcctttaatcccagcacttttggaggctgaggcaagtggatcacgtgaggtcaggggctcgagaccagcctggccaaaatggtgaaatcccgtctctactaaaaacacacaaaaaaatagccgagtgtgttcgcgtgcacctgtaatcccagctactcgggaggctgaggccggagaagggcttgaacccgggaggcggaggttgcaatgagctgaaatcacgccattgcactctagcctaggcgacagaacaagactccatctcaaaaacaaccaaccaaccaaccaaacaaaaagagcagtgaaaagataaagccagctccacactggctttataatacacactgtgtatataatgataatacacacaatgtgaggtttaaacaaatgtgtttaatacacacaatgtgaggtttagacaaatgtgtttaatacacacaacgtgaggtttagacaaatgtgtttaatacatacaatgtgaggttagacaaatgtgaggtgtagaatttgagcatgttgctcaaggtcgtatacttaacaagtgacggtcagtatttaaaatcagtttgctcttagaatcaatgtgtttaccaaatattccattaccaatcaaatagtcaataaaagttagcacagtgtttatcatcatcatatttacacatggataaaaaatgctataattatccattaggacttacattagttccttgagaaatatttatccattccctctgcacagagatttgaatgtctttacattttctataaatattattgactttactattataaaagataatgaaacccgtgttcaaaaaaatggggggagtaagaaaggaaggaaatgaaaaataaattaagatcgcaagaaaggtttgattcctatatattctatgaatggacctcaagaagttttctgaggttatttccttttattcagaaaagaaatcttccagctatgaattccttaaaaatttcatgatataagatatccaatgtattggatactttgtcatgtagaagctttttatacctattatgttttcttccccatgacctccccgcaataacactttgaggtactatttatcattccatttggaagaagtaactatattccttctcagctattacactgcttccagtacaatgtgtttcattaataaataaagtgcatgctctaagtgaaagtatatgttttttaaacacataagtctccttgtcatatttccagaggggatgacagaatatttatgttattatttaatggcaaaattcacttctttctaggagcaatttttgatgaatctgccaaaaaggatgatgaggtatttcgcactgcggttggtgaccttaaccagaatgaggagatcttacagactgagaaaatcacattttcagtgacgtttgttgatggcaacaaccctttccaagcagttcaagaaggtaaggtcatcagtatttattttggttttttggttcaattcaagtggcaatgaaattatctttgatgaaacttattaaacatggacatcatttttgtatcttgttgataatagggcattattttccttggagatcactgttttgtagatgttaatcttgtattccagttttgaaagggcagaatgtggaaagttattatattaattgaaatataatatgaaaatgaacaaatatttacatgtaaaagctttgcaacatttttatgacttcagtgtaaatgaaacatctttttaaaatagtattttctaacagaaagtttactttggacttctctgagataactgccaccttgggtattgttacaacttgggatgacatatcaggtgaactcatgacaaatgtactgctgaaagaaaaacccttggacactacatacaaatcaaagattttgtattaggactctaacatactgacctacgctataaattttactctctacgaggcaccaaatattaaagcactttcctccttttcctctgtaaacctgagtaaattaaattttttcattggtgcaaagtaatgcaaataccaattatttttaatatattggaatcatcattcctattatgaaggttttgattgaaagatcctagaaaaatggaattttctgtttgcttctattagtctaattaaacatttagccttgatccagaaagcactcactttaaatgaaactattggttgataattgggaaggtctgaatgtttgtgtcccctcctaccccgctgcataggttgaaactgaattcccattctggtggtattaagaggtggggccttcaggagatgattaggtcatgagggctctgtcctcatggataggattagtgcccttataaaacaggcccaagggaacttgcctgccccttctgccattcgaggactcagcaagaaggcaccgtctgtgaagcagaagaagatctctcacaagacacctaatctgctgggcccttgatcttggatttgctggtctccagaactgtaagcaataaatttatgttacttataaattacttagcctgaggtattttgatgtagcagcctaaactaagaaactagtctaccttattttttattgtgatgatgtatttaaactgaagataatgaatgcaaaattaatttagtcaaataaaacatttgcctcattaaaaatttaaatagaatttggcagaagaaaaggcagataccatattaactgtaacaaagttgggcaggattttttttgtaatgcaaacattgaaagagtaaggaaaataaaagtgtctgaaaatgtgtacttttcatttactgttttatctgcttgatgcgcaggtaacatttattgaaatatattttcaatcaatagcactggctactgttgaaacttatttatgttagttagaaaatagatatgtgattggtggtctaaaagttttttccttgttaatggaatggagtaaaaaatcattattttttgaaatgaatagaactgttttaagtaaaaactggctttacaaagaataggataataatgtttataataatacaatgagattttaatttttaataagtaaacattaatgcaaaaagtcagattgaaataaccattcagttatttacattttaaaatcagaatcatcccgacaatataaggatttcaatactggaaatgttaataaatattaataaattttctatggaaatatttaaaagcagtataaattaatattagaaataatagaaggatctggaaaatcataacatagaatttgaagataccaaatcattttaaagatatattcaataggaaatatatgtcattcatttttaagaaatctgtattatttttctttcttaactcttatttgtaaggaccagaatgtgagcaggaaaaacgtgaggactgatttctttctttatcttcttagtaactacatattaataattgtgaattaacttcaaagacaggctaaactacctatgctttttaaaaattaaccttgagtaaaaaagtagtaagaaaaaaaatgaaatgaagacaacacagtggtgagaaaccggaattataaattaagaagaaaaagtccctcacccctttattaaagactataatttgaaaagtaatgacagttttttaaatactacacctttttttttgtttcaacattgctctctttaattattctgctgccagctaaattctgaaaacaaaaatatcttgcaatagtgacgtgacggcactgaaagcaaattgagagaggcaataaggttcccagatagagaccactaggtatttgtcaagaaaaatgaaagagctggacagtttgcctgatggtttctgatactaacaggatgttctccaccagttattgtgatggtcagctttgggtaataaacctgaaatgagttccaggaagctttaaagacaatttgtttccctattcaatatcaagaagggtttcagttaatgttagaagtaaaaatacttatttatagaattttttttgtaaaacggtggcttgaaaaaaataagagaaaatattctattgaaagataacaaacaacccattcagaagcactattttcttcaatgttttgaggaagtaatttaggagaaaacctcaactgtgccattgaagatagtcaactttctctcacatgtttactgcaatactatgcaaacttgtattgagagggactaacatcaccttgtctgttttcatttttttacagtctaaagaaggaaaaaagattcaatgatacaattataagtgattgcttatatattagcactcctaatgaatttatagaaaaactcatggttttgatccctctgcctgtttattcaaatttgaaagtctcatccttgaacaaatagcatcatcaaacatatagatagtaataatgacaaatgataatagggatcactcagaggttagataagtaaaatctaatagcttgaaatcctcaatttattttattgttagaatttcctctaatcagccacatttaagagctggttttttattttaaaaatcaaaatttctgttcactgtatctttctactgttatcacttaataagagagaggaattcagtgacagcctatataacccataaacagtaataaagagtattggtgttttggaaatcttcctttgtagctttggctacagtacatttttggatagcaattaatcctttagaaaatgagtttctagacagatacctcagttataacacggggtacacattccattctctggagatcaatgactgtatctgttaattttgtcagtatttggtaacattgatttcagatctttgaaatacatgaataatagaaaaaaatttctgttttcacaaaagttatctggaaataaattacctattttgagattattcttttttcctttcttatgaatgtatttgttgataagccatttttcatcttttgtgtactgagctgcaggatattaactaagggcaaatacattttcaaaccttaactcacgaggttttcttgacaattttttttttcatttggataggctattttggtatctaggatgtagtgttctccgtaaaaagataaatacaaaaagaaaaaaaaaacgtatatgggttatttttaaaaaccttgagaattataggggtggaaaattatataaatctggttgaatattttcacaatttagatgaaataattgagacccagagaggttaaataattttccctagttcttctagggttaccatgcttgtgtgtagcagaaaaagaactaaaccaagacctcctttacatcactagtccagtatttttcttgctatatacccacccatgcatatatatagacacacatgagatagcacaatgtattataggacttcagtaaataatgtaaggactcaaaaaagtagcagatttatgttttgatatttatttgctatttattatttatgttcaaccatggaatagtaggaaaatttcaatctaggtgataaagaccagttacattatataaatcaatcttgttcttttggccttggttttcctcatttgtaaaaaatgaaggaatctgaatataatgtatttttaaggtaactttcatctctatgcttctatgacccttaagaacacagttctagaattagaaccttatagaaacgatcattatttagtgtccctttagagaaagtttcacgttgctgaaattgcctcctagtttttctgtgtctgactttaaaatagattaaacagatatagggtatccattgtttgttctgccacctcattcaactattcaccacaacccacagtactcattaccaccaatagaattcaaaggatcttgtgctgattcccttaacctgaaccaaagtagctgttcataggttactctttttattcataagttactctttttattttctcttataaattttttcttctgtggcatctatgtacaacatttagcataaatgtacaaatgtttttgtgaaaaacactgctgtcgtttctgaaagcagtacttattgtttatattgttagctcttagctgagatgaacataaaatgggccatgaaaggtggaaatttataagaaaacaaagtcaggaaatgtaaggatggtatatttgtagaaatcctcaagtcaaaaggtgaatgaagtatgaatccatatataattcttacatgtatttgatgtattaagaaggaagtgaagcatcattctttgatatttaatgacaagattcagctaaacaattttgaaataattgctcttattagaaaaatacctaaaaataagctgcatcgtgaatataagggcaacattatactataaagtcacaaatgattctgtttgaaagaaaatgtattaaactataatacttttttatgtattgcaaaacattataaacaatatcattataatttaaaaacacaaggtttttgaaaaaatgtccagtgctttttgaaatataaaaatttgaatcaatatctcaaagtacaattcaaagaagcaaactcttattgtaatatgcagtaatgggattcattaaagttaaactgttgtgatgctggaaatatgaacacaaaataaatgatatttttaatatatataaaaaagttgtagttaatagagatcatcttgcaagtttcagtctggtagaccttacgactacttctttgcatatcttaacaccagtgttgattacccattgctcttgtaaaaggtaaacatttcactaataaaatgatgatttcaattagatctgcctcatatatcttctaaaataaaataatttccagtatatgattatgcttataaaacaataaaactgcattcatttttggtttatgttaccaatctcatttctttatagttataaaaatacatacatatttatttcatgtgtgtaaatgggatgacaggaaattagcacagtcagaaaaagtgcaaggaaatataattaggaaaaagcacatctccaaaacacattaccatccatggtgaatatttctggtcattgattaaatctaaatagtctagtccaaagaagatgtaaatagaatgatttgtgtggctgcattatttgacacttctttccagggattattctcatttatatttcatttatttgcccactgctttaatatgacatttttactgtgattaaaaaatctgctaatttcaaacttcttacactggattctgcaactttcctagcataatactacagtatgtgtaccccaacagcctgtgtttcctggaccaattttgataacttcaattccagcttattttctgaattgtctgacaataaactaaacttgagaattgttgtctgtaggagctgagaaacaaaactaggagatcatgtgggtatgattctattcattcattcattcattcattcattcatccattcgttcatttattcactgttttcattcctactttccttcccacatcaaagtcaaggttgtgccttgagtctcaatgtctatcccagtgctctggttaactctggaccatctacatgtgtgaattagtggaaggagcaaatcgtgttgttgaacagccatctccaaacacctgcacatcaggagggatgctggatgtctattcagtgactaaaccccctgttttcctctatgagggaagatacttagcttggtcctttccccagcaatctcctgccaaaacctgtattactttttctccttgcctgtcacattctaaagactgggccacaaggtctggaattagaatctatcttatgtgtgatctttagtgtccatcatcaatgtagtattaaaggacaaataattctatgcttgttagagacaacaccaatatgcattaagaaaaaaaaaaacagctcacacaaaccttttccactgcagaatttcccattaagagcaattaaaaatatatatatttagaacctaattttgagattactcagtcaaattaatttattcaagtgcttattaaatgcctagtacttccaagattgagccagctacaatgggagataaccaaaaaacaaaagaacacagcatataactccaggaataaaaatgtatttgaggaaagctgtggatttttaaccatgaaaaagcatgccgttcccctctacctttaacttgaggtttaattgtgttaataatagaaggaacaagatggtctagctttttaagtatacttttcaggaaagacaggtattttcttttttttacgatcattataccaaatttatttatttttatttttatttttatttgtttaatttataaaggaaagaagtttaattgactcacagttccacatggctgaggaggccttagaaaacttacaatcatggcagaaggggaagaaaatatattctttcttaaagaaggttattactttacctttaaacaaaatattaatgaagatacaaattgcatagtctaatcttttttcctgttatttgttgttttactgctgtatttgtatgtctttcccttacctcatttgatatcatactcttgaagtaacaggtctctactacagtgaatggattgaaattcagatgtttacagacctctacatcataattttatagcctttgtgcttcgaggacttttacctcactatctacaattgtgatctgttgtgttacctcataaaatatatattttagcaatttgtgctgctctggattttgttttatttggaagagtctttagcagcgttctgtgaaagctgtgtttaaaggaagtaaagatttgttcttttgttgtctgtgttctttcttctaccaattcttttctcctaataatagcacatcactttcttgtattcttctatgtctgtatgtatggtgcatggatatggtaacataattcacttttaatcagtcttttttgaaactgactcattagaggaatcactacatatcttaaattaactctgaatatctggttgatttgattaaaaaccacatttacctacactcgcagttgtaatgagagatcattatgtagtcataaaataatttaagttcatgttgacaaaccaatgatgacttcagtatatttggaattttcaatctgttatcactattatcaatatccaacttttatatgatccagtttacctggttaattttagaagaaatagcaagctgacatttactttcacatttaacacctattttttgttgtccttgacaagtgtaatgaggtttatgggaatcacactgaatagtcttttgggactcatgcaatagtttgttatcttgtaattttcaaaataattattacagaaaagctctcttttaaaaggaacatgcaataagccagtgtgcaataggaaattgcatattctgggaaaaaaaagaaaatgaatccgccagtaccttttgggtgcctgtgaacattcagtcttgtgccaactactctgcacactgtcatgctctccattggctgccctgtcgtcttacatggttaatttggcctttactctgtaacctagtgttaggtcctgacctatgtgtacctctcttctttttgccctcccattatagtactatttttaaactctttatttagcccccttttaatccttgactctccatattatactgcagacactcaaaatgtctgcatttagttcggtatgtaaatcttaaacttggtttcatttacctcgcagggaaaaacatatatattaagttcatagcccatggaattagatacctgcctttattttatgtatgaattctgctctatgtcttattatctgtgggcccttgaacacacctactatttctgagtctcagtttcttcacatgtaaaatgaggataaatacatactccatagcattaatatgattatgtgattattgtgtaatgattatatgggattgtaaatatggtagatgggttcctccactaatctaattacattttaatgatagtgctgtatgtgatgatttagtaccattgcatgtgtccctcagtaagttttcacccgtttccaatatttccttcccaaacatattctagtacttttattagtggttcccatggatacctctgagcctaaccttattacctgcgtagtcagcgacatatttttgcccaaatgggactttccttaccaagattttgagtgctgtggttttaaatatatataatgaaatgcttttcctttttttttttttttttttttcctgtctctctctctctctctttccttgggctggttctgctagtcagcacaggaagatgagaattatacatgtagtgtaatttatttggcaaatagtagtgatgttgcaacatgtgtacttagggttgggaggatttaaaataccttgttaccatttctgggaagtagagaaaggccatggaggccaaattaaagctttctgatgatttgtgtaggcttaatacaatcggtgaagtaaataaggcgctgagtcatagctaaatggaatttggctgtagagcaacatagtgttgtaggagagtgatatatatgaaggttgaatatagaaattaattcaaggaaagctttatgctttgaaagatggatcatctctggcaaatttatatctgacatgattgtttaaaaggttatctttccatgctttgcacatttcattgcaattatacatagggaaatattaactttaaaaactcagtcatttgcttatttgaatttcttgtactgtacttcaaaaacacatgatatcatgttattttcttaagaatttatgcctcacttcaaaacagatttactttttggtctttgatagactaacgtgatatgatggttagatgggttaagtccatttcttaagctatatttcaaacataaatatacattaaaatgtctactatatataaaaaatatatattccaggccatgcaccgtggctcacgcctgtaatcccagcactttgggaggccaaggcagatggatcacgaggtcaagatatcgagaccattctagccaacacggtgaaaccccgtctctacctaaaatacaaaaattagctgggcctggtgccatacacctgtagtttcagctactcgggaggctcaggcagtagaatcgcttgaacctgggaggtggacattgcaacgaggcgagattgcgccactgcactccagcctgggcgacagggcaatacttcatgtatgtgtgtgtgtgtgtgtgtgtatatatatatatatatatatatatatatatatatatatatatatttctcagaatgtattttaggggagggtgtaggtggggaagcagttgacaaatcaaagtcagaaacaatcttagtatagagaatattcttgaatagtattaccttgaatgctaagaaatatttttgtatttttgaatgtatacttatacaaacagaaagttctgaagtggtctcatgtactcattcatgttattaaacctgagcaaggtatagagggctcaggtgagagagggtaactagaggattaaaaattaatacacaaaacagaaaaggtcacattcttacaggtcaagggatgagaagttgtcatattagcctcattctacctgctcagaaatcctgcttttattatgttatatttatttgttcagtaagctttagtgtttagaattgtgttgcacagttcaaagttttatctctatattaactccaagaactacgggattgtgtaaaaagactgaaatgatgactgactatggggactttttcgttgatgctgttgttgctgccttctgttgtttgtttttcttttaaagtcaggcccctcttctgtagggctgctgtggtttgctcggggtccacttcagaccctattcacttgggcccctcccatacctggaggtgtcatcagtggaggctgcagaacagcaaagatggctgcctgctccttcctccgggatctccgtcgcagagggaaaccgacctgatgctagcaggaatgctcctgtaaaaggtatctggtgacccctgttggagagtctcacccagtcaggaggcataagatgcaggacctcttaacaaagcactctggctgccccttggtagaggaagtgcactgtgctgggggcactcccatacatctggactgcctagattcctcagagccaccaggaaggactaagtctgttgatccatggagaccacagccgtccctcccccaaagggcttaaccccagagagaccagagctctgtccctacactcctgcctgaagttgctgaaattcctgcagggaggccccatccagtgaggaaggatcagtcagggtccagcctaaagaggcagtctagacaggatctgccacagatcaagtggacctgatagatatcaatagaactctccacccacaaataacaggatatacattcttagcagagcatggcacttacattaaaattcatcacataattagaagtaacacactctttagcaaatgcagaatagctgaaatcataacaaacaatatctcatacaacagtgaactcatattcaaactcaagattaagaaattcactcaaaaccatacaactaaatggaaattgaacaacctgctcctgaatgacttttggataaatcatgaaatcaaggcagaaatcaagaagttctttaaaactaatgagaacaaagagaaaacataccagattctctgggacatagctgaagcagtgtcaagagggaaatttatagcactaaaggcccacatcaaaaagctagaaagatgtcaaattgacatcctaacatcacaactaagagaaatagaaaactaagagcaaacaaaccccaaagctaacataaaacaagaaataaccaagatcagagaggaactggagggagagacatgaaaaacacttcaaaaataaatccaggatttattattatttatttaaaaatgtagaccacctgctgaaataataaagaaaagagaagaatcaaatagacacaagaaaaatgataaaaaagatactgtcactgaccccacagaaatacaaacaaccatcagagaatactataaacacctctatgcaaataaactagaaaatctagaagaaatggataaattcctggacacataccccctcgcaagactgaaccaggaagaagttgaattcttgaacagaccaataacaagttctgaaattgaggcagtcataaatagcctctcaaggaaaaaaaccccagggccagacggatttatagctgaattctaccagaggtacaaagaggagctgatagcatttcttctgaaactattccaaacaattgaaaaggagggacttcaccctaactcattttatgaggccagcatcactgtgataccaaaacttgccagagatttaaaaaaaaaaaaaagaaaagaaaagaaaaaaagaaagaaaaagaaaaaagaaaaagcttcaggccagtatccctgatgaacatcgatgtaaaaatcatcaataaaatactgggaaaccggattcagcaacacatcagaaagcttatccacaatgaacaagtaggtgtcatccctgggatgcaaagctgtttcaacatacacaaatcaataaacataattcattacataaacagaactaaagacaaaaaccacatgattatctcaatagatgctgaaaaggaatttgataaaatccaacatcccttcatgttaaaaactctcaataaactagatatcaatggaacatacctcaaaatattaacaggtgtgtatgacaaacccacagccggtatcatactggattggcaaaacctggaagcattcaacttgaaaactcgcacaaaacaaggatgccctgtctcacgactcctattcaacatagtgttggaagttctggccagggtaatcaggcaagggaaagaaataaaggttattcaaataggaagagaggaagtcaaactgtctctgtttgtagatgacatgatcttctatctagaaaaccccatcgtcttagtccaaaagcttcttaagctaataagcaacttcaacaatgtctcaggatacaaaatcaatgtgcaaaaataacaagcatttctatacacaaacaacagacaagcagtcaaataataaatgaactccaattcacaattgctacaaaatgaataaaataccttggaatacagctagcaagggaagtgaaggacctcttcaaggagaactacaaaccactgctcaaagaaatcagagaggacacaaagaaatggaaaaacattccatgctcatggataggaataatcaatattatgaaaatggccatactgctcaaagcaatgtatagattcaatgctattcccattaaactaccgatgacattcttcagagaattagaaaaactactttaaaattcatatggaaccaaaaaagagcctgaacagccaattcaatcctaagcaaaaagaacaaagttgagccatcacactacctgacttcaaactatactacaggctacagtaaccaaaacagcatggtactgacagaaaacacacacacagaccaatggaacacaacagagatctcagaaataagagtacacatctacaaccatttgatcttaaacaaacctgacacaaataagcaatggggaaaggattccctatttaataaatggtgctgggaaaactggccagccatacttagaaaactgaaactggacccctttcttatccaaaaattaactcaagatggattaaaggcttaaatgtaaaacccaaaatgataaaaaccctacaagaaaatctaggcaataccattcaggatagagggagggacaaagatttcatgaagaaaacgcccaaagcaattgcaacgaaagcagaatttgacaaataaatataatttaactaaagagattctgcacagcaaaataaactaccatcagaacagaaaaccaacagaatgggagaaaattttcacaatctatccacctgacaaaggtctaatgtccagaatctacaaggaacttaaacaaatttagaagagaaaaacaactccattaaaaagtagtcaaatgacaagaacagacacttctcaaaaataaaataaaaaaacatttatatggccaaaaacatgaaaaaaagctcaacatcaccgatcattagagaaatgcaaatcaaaacaacaatgagatactatctcaagccagtaagaatggcaattattaaaatgttaagaaacaacagatgctggtgtgactgtggaggaagaggaacacttttacactgttggtgggaatgcaaatcagttcaaccattgtggaagacagtgtggcaattcctcaaagaactaaaaccagaaataccatttaacccagcaatctcattactgggtatatacccaaaggaatataaatcattttattataaaaatacttgcatgcgtatcttcattgcagcagtattcacaatagcaaagacatagaatcaatccaaatgaccgtcaatgataaactggataaagaaaatgtggtacatatacatgatggaatactatgcagccataaaaaggaatgagattatgtcatttgctgggacatggatggagctgtgagctattttcctcagcaaactaacacaggaacagagaaccaaacaccacctgttctcacttataagtgggagctgaacaatgagaacacatggacacagggaggggaacagggaggggacttttgggggttatggagagagaaagcatcaggataaataactaaggcatgtggggcttaatagctaggtgatgggttgacaggtacagcaaaccaccatggcaaacatttgcctatgtaacaagcctgcatgtcctgcacatctatctcagaacttaaaataaaatattttttaatcctatttattatgtctgacaaaatggaaacaggcaggctttatgtcaaaccactgtccttcagcttacccacaatttatgccagggatccatgtgagcacagaataaatcaccagttgatatagttaggcttcctttttccacccaaatctcattttgaattttaatcttcataagctccatattccccacctgtgaaggaaaagaccaagtggaggtaattgaatcatgcgggcagtttcccccacgctgttctcctgatagtgagttctcgcaagatctgatggttttataagggggtctttccccttgcttagtatttctccttcctgataccttgtgaagaagatgccttgcttcccctccaccttctgctatgattgtaagtttcctgaagcctttcccagccatgctgaactgtgagtctattaaatctctttcctttataaattacctggtctcaggcagttctttatagcagtatgaaaatggactaatacaccagtgtacattttctttctttggaaactgcttaatgcttaaataagagaaggggaggccaaatgacggaaactaggaatttccaaggtcaatttattctttcaaaaataagaatcataattgttcacttatttgtaggatacttcttattcacggtacactagattgggatttatacagatgagttagactaatttaattcaagtactcaaggaatgtatagtctactaggggcaatatacaaagagatctagaaaagttgataattttatttatagtggaaacaagtgacataaaataatgatactaaaataacaggtagaatgtgtatgatttaaaatcaagggctcattttttataagatgatgatgatggatgccaaaaacaaacaaaaaacctttaagatttcaggttgagtagtagacagacatgaaaatatgaagggaatagcattccaagctatttcatatgggaaagtaatttggaggtaggagcttgctgtgttgaggaactatatgttcttgtggacactcaaatttttattctgttgccttacaaatatttatttccatcatcaatgtcattccttgcttgtcaaccatattacttgtgagttttttacctaaatcagctttggttccttatactccccttggacatggtgtgtattccgaaggaaaacctggtattcctgcagatctcactgacattttggcatggagacttttttactggaccctttttagattttaaattcacctgctataattctgattttgaatttaattatggaaacataagagcttttcctgtaagtgttcttctttccaggaaaactaaaataaataccaaaatttgtttttgaaaataaatttactcagttttcctgttcttctaacacagagtaattcacagagatatattattgaatcctaagaaagaaacctcattttgtggcttttatagttttctgtacacttgtacaaaagagcctcatttgataaagccaatagtaagagacatttattcataacttatcacatccaatgaactgttgaaaatactttgttttctcctgatctttatactgacttatgaggtataaggtagttactattcttattagcgttttacagatgaagaaaatgagcaacagctgggttaggttaacttattacacctggaacctttagaatagtggctagaacactagtttcgctttaagtctgctgattgggaggttcaggcatgtttcagtgagaggaagaagaaagaaggtaaggcatttattttctgtcttctgtgtgtggttgtcttaagctgactgtacctcaaacaaaattgatgtatctcttgatgcatcctgctctgtatcactctcttgaaattcactgtcttgtcctttatcctttgggcctggaactggtaccacctcactgctactagctctgggtttttgcactattcccctttcgttggctgcactccacccagacctgcgtaatttaacccattgaaaaagaagccctacctaaattatcctattttgagttgccattgttttctattggaattttaaccaacatcattatttaactcatatttgtctaatctaatcagaaagtgttacatctttgattgtattataaagtcaatctatgtatcacattacaaaacacagtaagggtgcctcacaaagatttctagcttctgtgcattgcaagataaaatctgtatgttcatggacactttaatgttgcagcaaaggtcgacatgatgttggagatactgagtggcagcaccccttccaaaaggcagtaagtctgagcagaaacacagctatctccaaattgccaatacacagcatagttgagtgtctgaacttactcatttatgcctggttgcaattttttgaatttttgcaatcagaccttggtaattaccttgagcagcaggatataaataactcccacatgcttagcgttccaataatggaacactaggcataagtgggtgaaggaaacatcactatttttaatttaaataatatgacaaatgaaataaacacgaatgttaatgctgaagttatatatttaaaatgtcttcttttaagcctctactttggttaaggaagttgatgaatcagttattcaaaaatttcttaatattttattttttgtgataagaatttttcagtgtttttcctttatttcattctttgtaggagcgttatactgtgtaaactagactcattattaagttactgggggtggggaagaaccgcaagttactggtgaacatttttcatagccaagattttcttttgcttggtaactttctgtcacctattacctagaataataatgagaaagtaacgagttacaacagacctgtttgcatctcatatctttttgtttcccagacttactcattaaataagtgctaatgaacagcaaatggccaaacaccaggcagtagagcaggcagaagagtaggaaaggtcttacaagatgtgatcagtataataaggttctcaactccatcactaattcaacattgttcagcctttcagcacaagacactgaggtagaattagcgaagaatgtagaggtaacttagaagcactctacctcttccaaagctttaaactatgaatgaagatgaaaaatgtgtgcgtaaacaataggataacaaggcaatatgtgtaagttctgtgaaggagaaacaaaatacaaagttcagtagaaaaagaggtgacttataactaaggatggcaagttgaggggggaaggaaaaaattaatgaaagggaaaagtagtaagctctgctttcctttctgaaaggagaaaaagtctaagcaacagaatcaggtatattcaaaaataaatccttgcgactgatagaaaaatgggaggtaggggctggaagatattgagaatgtaaacatcatgctgcaaggacagaaacagtaacttttctctcaagatctgtgtcctattcccaacttcaaggacacctctttcccaaactagtggtgcaatagtgaattcagcatggaaagactcatgattcagcaagtaaaattgaagactaataaagacattaataaagatatcaatcttcatataccaaagtcttattatttcttttaaaatgcagcaaaagtaatgaaaatggtttgagttcaaagatgccgcttcaaaggtacaatgcctccactgtgttttaagagcaagtgatattttaaaataattattctacatcttcaatggagtaattgcttttcacattaaagaaagagataagcgcccaagttttataatataaaaagtgctatgcatgtgtattaactaattctctcaaaggagttttactacacatttggcattgtgtgctataactcagagtgtcatggtgctgtgctcttacatgaaaacatggatggtttcctaactgagttagacagaagtagataaagaatatcaatatcatgtactgtggttcctttatatgcatagtttatggttactatttttttcattaagtgagataatgttttaacataagtatttttattggtctgattattacaagtggccattgaggtttgtttattctgaataaaacaagctcttcaatttgtaaaaattggccactttgttaatcgttcatttattctttcacccaaatatatattgagaacttataatttgcaaaatactgtaagtgctaaataccaaggtgcatcaatgtgctttctggcttcaaaaatttgttgtttagcaaataaaagacataaataacattaatatagatgtaaacagtcataatacaaagtacagtaagttataaagttttcattagtaaagatgaagtgttagaggattttgagaagcactgatgttggtatgcttactttctgttcttcacacacagcttgaaatacttgtttttccttacatgcttagtgtatccccaatatttggtaccaaatatataacagtctgctcgaggttatttaacattatttcagtcttgagagccttactatgtggttaagttttcattaatttaattaatgtaacaaatatttatcgagtgtctatgtgccaagtattagtctaggaattcatggtaccagtgtaaaacacaatatcttgctctctgggaatgtatattctagttgaagaaaaaaaataataaagacaattccagattgaagagttagtattaaaaaaaatgaagtagcatactaggcataatcatgatgatggtgaggtgccatttaaaataaagtggtcaggaaaatcgctttttgagaagatgacttttgagcagagacctgaatgatgaaagggcaaaagtgatgtggctctccagtggaaagcagagtgtacaacagttactggaaataatatatattatatatatataataatagtagatcactataatttttctttcttctcgtgaccacattagtaccttatttccatttatcatgtaactgtcatatctttgagaataccttcttcaattatctgaccactacttgcagtcacttatattttcacaccctgccttgttttgaaaattcatttttaaatcaaaattacacatactatagatgcagtttatctgcatatttgattttatttagaaactctgatcttgaaaagagagccagtgtatctgttaattaggcataatctctttactattgaaaatgtatgtggattatcactattatctgttaccataatttaataaacttttcatccacaatgttaaactattcaaaagagtcccttaccctcttctacagtagcagagttttagctgggtttatggtcccccaaataagattacatttcatacctttccttgatcctatacagagggccaatggaatgtgaacagaggtgtggacaacttccaagtcattccaacttaaacacaagctctttgccttagactgacaccccctttcaatgacctggaatatttacgttgctgggacccaggttttaccaggcagatggggacaatgcattaggggatgactgagcaacaagataggaggaacatgattctcctgtagagaagagttgccctggctggactgctatgagtaagagaaaggcatctctgtcttatttaatacccactttatgtgtgtgatattgttccacttttaaccctaaacataacgatcatacctgtctctaaatatttcactacatgtaacagaagtatcattctgcccaccttagtaaggatatccaattctgagaactcagatgctccacttctgttttttaccattttcttcttttcctttcccttccccctccttttccacttcctcgtccttcacgctgtactgagacatcatttagttcatcttattaaaatgtacaattaaactattaatagtaagtttacagagttatatggccatcaccaaaatccatttgtagaacttttccatcacccaacaagctctctcaagtccaatcaattgacagttccatactaccttcaagccaaccacgaattgtttctatagattagcctcttctgggcatttcattaaatggaattagataatacaaaatcttttgtgtctggcatcttagaatgagtttttgatgtttatctatgttgtagcaagtgacaagatttttttcttttaatgatgaatagtgttctattatagggatatatcattttgtttttccagtcaataattgaagaaacttagtttccagcttctcttaggaaaagtgctgtaatgaatatttattgaatagtctgtgtgtgtgtgtgtgtgtgtgtgtagctgtatatatatatgtgtgtgtgtatatatatatgtgtgtatatatatgtgtgtgtgtatatgtgtgtgtatgtgtgtgtgtgtgcatgtgtgtgtgtgcatgtgtgtgtgtgtgtgtgtgttttagcctgcttaggctgcataataaaatacaacagactgggtgtcttaaacaacagaaatttattttcttacagttctggagtctgagaagtccaagatcaaggtgccagccaggttgaagtctgttgaggactctccacttaggtttcagagggccaccctctttatatgtactcatatgatctcttctttgtgtgtgcatgaaaacagagtgtgctcaagccctctgatttctctgcatagaaagacactaatcctatcagataaggactccatccttatgccgtcatttaaccttaattacctccttagaggccctgtattaaaattaatccacactgagcattagtgttcaacatatgaacttttgaggggacacaaacattcagtcatagcatcttactagggtagatatttagggagaaattgctcagttttatgatacattaatgtttaccttcttatgtaactggacagctgtgtactatttcacattcccaccaatttcttcacatttttgccacttttgtaaaatacgtgaagtggtatctgattattgttttactttgtatttctctaatgattagtgacattgagtatctttttactgacatctgtgtattttctttgatgaagtgcttgttccaatcatgcatacatatttatttgaggttttttgacaatcttatttattttgaagtattcctttataatcttgataagagtttttttttaatcagatacatgtttgcaagtatcttctactagtccatgattttcccccctattttcttagtggagtattttaaaatgcaaattaaaaattttgctgcagttattttttaaacttatgtgtttagctttgatattgtatctaagaatatattccaaggtcattaagattttttttcatgtcttctagaaaatgcctatatttaacttttatatgtaagtctatccgttattttgtgtttgtgtttgagtatggtatgaggcactgttttggcatggggaaatccaatttaacctgaactatttcttagaaaggttatcctttcccctgttgaattattttggcacttttgttgatagtatgttgaccatgaatataggagtctatttcagaatactcgtgtcttccattgatctaaattcctgtctttatgctagtaccatattgtagctttatggcaagttttgaaatcttgaactgtaagttttccaacactttttttctttctaccgacttatttttggttattgagttctccttgttttcatataaatattggtgtcagcttgccagttgctgcaaaatagcatgctgggaaattagtaacaattctgttgaatgtataaatcaatttggggatgattaccatcttaacaatattgagtatttcaatttatgaatttagaatacatatccacctatttatatctgctttaatttctatgcagaaagatttttttggctttcattatacaaatcttgctcttctattaggttatcttaggattttattcattttgatattgtgaacggaatcatttcttgtagttatattgttcttgctaatgaataaactctattttttgtattttgatctgaaaacttatggccatgaggaactcaattgtttgttaaagtttttgtggatctgtcaggattttctgcaagtaggatcatgttatgcaaataaatacatttacagtccttccttttaaatctagatgccttttctttcttttatcattttttggttgcagtggcttgaacctccagaacaatggtgaatggaattttgaaagtaaaaaccatttcctgtttctaatattaggtagcaagcatttagccattgagctttaaatatgatgttagctgtatattttccaaagatgctatttatcatgttgaagaaatttcctaatactcatagtttgttgagggtttctaatcataattgatgctgagttttttgaaatactttacttgctcattgaggtgatcatgtggtttttatcctttattctgttgagatggtatgttgcattaattgattttcagatgttcagccaaatttgcattcctgggataagtctttaaaggttatggagtaaaatattttttacatattactgaatttagtttgccaatattttgttaaggactcatgaatctgtattcatgagatatattgatctgtgatattctcttcttgtgatgttttagtatttctttggtattttaataatgacttcaaaataacttgggaagtctgcctttcccttttgttttctagaaggctttgtgaaggattggtattattccttctttaaatgtttgatagaagttagcagtatgttctgaagactttttgcaataagattttgcattattcaattatttacttgctttgatctattcagatttttctcatcgctgagtgagtttgatactttgtgtctttctaggaatttgtctattttatctgctctgctaacatgaagttgttgataattttttttataatcctgtcttgttggtagagaggttctctttcattccagattttggcaatctgtaccttctttaaatttttgtcagtctagcaaatgaatcaacttttgattgtagtgatttttctcctttgtgtttcttttttatttcactgattttgctctttattatttccttacttctgtttaatttgtgttatttttgttttttaaacttttttacttggcacatgataattctgcatatttatgtgatacatagtgatgttgagatacatataatatatagtgattatatcagggttattatcatatccatcacttcaaacagttgtttttctgtgtttgttggtgcattccatatcctccttctagctatttgaaaccatatattattattaactatagtcatcctacagtgctatagaacactggaacttattcattttatctagctgtaattacgtgtgctttgacaaatttcttcctatcctgcctcctctctacacgttccagctgccagcatcctcagttctactttatgcttccatgagaccagttttcttttagcttccaaatatgaatgagaactatttgctttttttctgtcttaagttagcaacttaggttattgacttaggatatttttttcttttccaataaagtcgtttaaagccataattttgcggttaacactgctttacctgattgctataaatgtaaacatgttgtatttctgcttttattcagttcaacaattttttttccaattttgtcttgtaatttatttcaccaatgggtgcattgtttaatttctgaatatttgtggacttctcaaatttctgtatctttatttctgttttttccctatgtgaccagatagaatactgtatgatttcaatcattcttgattcattgacacttactctatagtccagtgtattctattctggagtatattcatgtgtgcttgatagaatgtgtatttgctattattgggtagagtgtactacagatgacaggtcaaatttgttgatagacttgttctggtattgtctttccttgctgatttcttacctattaataactgaaagcaagtattaaaatcaatagcattttattattgaattccctagtctatctttgattctgtcatctagatttgcctcgcatatttaggtctcagtttcaggtatttacatgtttagaattattatattttactgatgaatttagtcttttatactttgctatgttttttttttttcttttagtaacctcatttaccttaaaacttattttatctgctgttaattatcttagtctggtcaggctaccaaaaaccaaataccataaacagggtggcttaaacaatagtaatatatttcttaaaagtctggagactaaaagtccaagaacaatgtgccaacagttccagtgcctggtaagggctttctccttgggttgcaaatgcctgccttctcactgtatcctaacatggtctttctttgatacataccgaggtggggtggggcagggagaaacacaaagcatgaaaacccaaaggatcaagctctctgaggccttttcttctaaggacactaatcccatcatgagggctctgcctattgacctcatctaaatccaattacctctgaaagacaccatcttcaaaaacccatcacattgaagcttagggcttcaacatataaatttgagaggaaacaattcagttcataatatcagtgtagctacactaattcttttatggttaccattgcatgcagttcatcgttataccatccacctatttgtatttgtgttttaaagtgtttctcttacagacagcataagattagatcttttttcttaatccagtctcaaaatttatgccatttactataggtgtttaaattatttatattattgtaatatttcatatcattggatttttgcctgaattgtgctttttattgctatacctcatcatattattctggctattcttttttactgtgatctttttgttaaatatataaattgaaatgtgtcattttaattccttattagtttttgtactatatatttatgaattattttctatttgtgctaggtatacaatatgtgccttaatgtatcacagtctacttcaggttaatattaacttgattccagtaagatatacaatattgctcgaataacttctacccactgttgttatttctactcactgttattatgctgttattgtctttatatgttgtatgttcaacaacacagttttgtaattgtgatttatgcatttcttttaaatcagttaaagaaaagagaaaataaactatgtacactatcttcatatttgcccacataattatcttttccatttctttcatttgtttgagtggattcaaattagtgtctgatttcatttcctttcagaatgagtgctgctgtagtgtttattggaagaaaaatctgctagcaatagattctctcagtattttaaaatgtggtaatattgtgatttcaccttcaattttgaaggatagttttcctggatgtaggattcttggttgacagattttttttttatttgtttaagcagtgtctttccactgccttctggcctcctttgtttcttgtaaaacatcagctgctaatttattatggtttcattgtaactgatgagttacatttctcttgtttcctttaagtttttttctttggccctgtctgtcagtagtttgactatgatctgtctaggaatggatgccttcaggtttctgctaactagattcattgaacttattgaatatatgaatttaatactagcttcttgaaatttggggaaatttttacccataatttctttagatttttcccctctttcagagactcttattacatcattattacatatgtgtgtttttgttattatatatgttttgtttttgttctttgtttttttcctcaaagaaaaaaaccagttgttagacttagcatacagtgttcctgtatttgttgactacagggacattgaatttcttccttgtatttattgatatctgggagtatttagataatatattatagcatattaggtttgcaatcctttgatatttgttaatatttttgtttgcttttttgattgctgtttttttctagagaatcattctctgctaaatcttttgtgcatttttggcagtcttttaagatgcttaaacttggcccataataatggcatatatttatggggtacctagtagtgttgtgtgatacatataatgtatagtgattatatacactaatgtatagatcagggtgattagcatatccatcatttcaaaactttattatttgtttatgttgggaacattcaatatcctctctctcgttatttgaaactatataatatatagtttcaaactatatatatcctacagtgctatagtacacaagaatttgttcctatctagctctaattttgtgtctgtgtacccttactaccctctagtatcctcagttctacttttgttttttaaaggatctagcatgcaagtacagattgtgcaggtttgttacataggtatacatatgccatggtggtttgctgcacctatcaacccgtcatctagcttttaagccccgcatgtattaggtatttgtcctaatgctctccctccacttgtcccccatccccgacaggccctgctgtgtgatgctactttttacttccattatataaattatttttggctttcatatatgagtgagaacatgcagtgttttacttctgttcttggcttatttcacttaatgtcctctagtttcatccatgttgctataaatgacaggatatcattctttgttatgtctgcatggtaatgtattgtgtaccacattttttatccagtaatctgttgctagattccttggtttgtttcatttccttccttttctctacatcccggccagcattttttattttttgttattttgataatagccattaaaactacagtatgatacaacatcattatggttttcattttaatttccctgatgattagtgatagtgagcatttttttgtatacttgctagacatttatatgtcttctttgaagaaatgtctattgaggtcatttgcccttttcttaattagacgattttgtgttgttgttgttgttgttgagaaatttgagtttcttttatagtctagatattaatcccctgttgaatgagtagtgtgcaaatattttcttccattctataggttgtctttttatgctgttaattgtttcctttgcagtgtagaagcttttaggtttgacataatctcacttgtttatttttgtgttgttgccggcgttttgaagtcttcctcataaaatattttctcaaatcaatgtcctgaaatatttttcttatgttttcttctaaaaattatatattttctagtcttacatttagatctttgatctattttatttctgcatagtgtgaaaggtggaggatctagttttatttttctgcctatggatatccagttttcctagcaccatttattgaagagattgtctctgccttaatgtatgttctggatgcctttttcaaaaatcagttggctgtagatgtatggattaatttctgggttctcttttctgtttaattggtctatatttctgttcttacgaaagcaccctgctgttttggttactacagctttgtagcacattttgaagtttgatagtgtgacaccttcagctttgttcattttgcttaagattgctttggctatatagatccttttgtggtttcatacaaagtttagagatttttttccaattctgtgaagaatgtcatgaataagagttgcattgaatctataggttgctttgggaaatatggtcattttagcaatattaactcttcctatccataagtatgggatgcttttccatttgtttctgttattttgggtttctttcatcagcattttgttgttttctttgtagggatcattcatctccttggccaaatactatacacttcattgaataaatacttactattccgaggtaatttattacttttgtatctcctgttagtgggattatggtttttatttatttttcaggtaatttattgtctgtgtacagaaagactactgatttttgaatgttgatattctatcctgaaactttttgaatttgtttagcagttctgagagattttgtgtagtccttacatttttctagatcctgtcttctgagagtggggacaatatggcttcctcctttccaatttggatgccgtttattgctttctctctgatatctctgtttagtttttgtttgaatttgtctttgtttttttaagcctggatatctaggagttgcttttgagtcactatagcttaatggtcagccaaggattattcagagcttgtgtttacgtagtatgagtaaattttccactctttgctgataggtcagtggagaaacttatttaaagttcaggcactatgttggcatgccttggctttgcattttgataattctatttgtgtttcttctgtgacagtgcaaggtcttatgttggagaagcaatatgtaggcagctagagccctctccagtatttcctgagcatatgcataactttgctaatatatgcagcttcccagaccaggaggggcttatagagtttatcaaggaccactgtgttgctgtctcattcctcagatcttgtaaaatttctgactagtattctaatctgttgcttgaccaagcttgtattgcaacctcaggtttgttgagatgttggccttccttgatttttttaaataccaaaactgttatcatttttggcaattccctgagtattgttttctctacacaccattccaaatcaaatcagctcccctcccaaccccggcatggaagctgttggtttttatggctttcaatgccatgctaaaattcagtgtcatgctaaaatgacacagacacactcttcttatgtgatgttcagtattttcagtatttgctattaaataagtgatttccaatttgttgtatgtctttgtttttttgtttgtttttagaatccttaaatagtttcacacatgagttttatttagttttatcattgcctttaaggagatttgctgagctccttatttggccatttgcgaagttacacatgcctttttttttcccccacaggagggatagagaaatttagaccatgtgattcagtttttatggaataagtgtcattgtaggtgcatcatgaattataggcaatatatgaaatttacttttcatggtaattctgatgaaaagaagaatgtcagaaatgtggattatgggtagataacagccaatagtgtggttagtctggaatactatctattttgaggaccagataagactggcatgggagattgaaatgagctagtaaaagattttgaatgtgaaactaaggtttctaaattaatatctttaggtaatatcaaagagtggaatggtttgagtgatggaatgacatgatttatagatgtgcttcagggaaaagaaaatagctgcctacaatgtaagtgatggattaagggtcaaaaaactgaaataaaaccagtcagcagtcttgtaatagtccaaatggaaactaataaagtctcaggatagttattatcagaagggaaaaaagtaagctactatgaagctatgttacaggaggtcttgggaaggacttgaataacttattatatatctgggaccagtaaaagagagactcaaagaacgcttctagcatttggcatttggtaactggacaagtatacaattagcacaaataaagaacatagaaggaaagacagatatagggaaataattgtaaatggtagttcatatttattgaattgttactataattagatatagttatgagttttatgtaaattattagttactccttacataacactttgcatataataggaaacaaagggagccagattagtcaactgtaccaaaataaaatagctaatatatgacagtattaggacacaggaagtggaacatcacacaccggggactgttgtggggtggggggagtggggagggatagcattaggagatatacctaatgctaaatgatgagttaatgggtgcagcataccaacatgacacatgtatacatatgtaacaaacctgcatattgtgcacatgtaccctaaaacttaaagtataataataataataataatgaagacacattagctagaggaacaaaataaagaatgccaaaaaaaaaaaaaaaagaattttaacccaggcattctcagatcagagctgagatttttttctgacttttaagttgaggggtacatgtgcaagatgcacaggcttgttacataggtaaacatgtgtcatggtgaattgctgcacagaccatcccatcactcagattttaaacccagcatccattagctattcttcctgatgttagattagagctgagattttaacccctgtctgaatataggtctcaggacacatttagaaaaggaaagatgaagtgatggtttaagattttattgtctgagggtgaaaagttaaaattgtgatattggacaagattgtcaaagataaacatatgagagaagagaaactcattggcaactatttacattttgtgggaaaaaaagtttaaaattaaaagatgaaccagtgcaaaatattatctctaaggaaaaatgattattttggtgtggttattttaactgtgatgggatgttgcttggatcaggtgtataaaaactccatagatgaatagttggtgcatacctatagtcccagctataggaagctgaggtgggaggattgtatgaccccaagagttcaaggatgcagtaaactatattacatcactgcacttagcgcagggcaaaaagcgagacatcatctcttaaaaaaatccataaattccagagataaggaaccaagtaattaaattatggagagaattttcattatggtagtagtggttttaaaagaagagcagtaccagcagtaaggagtgagtggatggaaaggattaaatactgtaagtagaatttttcttcaaagtttgataatgatgaaggtaaatacataagaatagctagagtttggtgaaacatgaaacacacagaaattttctgaagaaagagaaaaaattcgaagagagagagattatgatgacagtttggtttagaaaggagctaaagaggagaaatttgttaaacattgaactattgagctaatagaacaatcatgtttgttattagtgaagaggaaaatggaaattcatgtggagtggttataataatctcagtaataattgaggcaatgtggaagtacagtgcagagtgaaaaagatttgaaaatgctactggggagagtcaattagagatgatggataatatttctgagtcatagtaagaattaacctgagatttcatagcaagaatctgtaagagattttataataaccatttcatattttcctgtaatattaggaatgccaatactaaaaaggtcacaattttagatatggatgttgctttactgttttcatggttaggcattattttctgaattttcttataactttaagaactcttgagtgaatgagtcttcagaaagaaaaaaattctcttggagtggatgctctttcccgactctcctaatatatgttaaggagattttaggaggatattttaagagatttggtaatatttctgtacaagagagtaataagaatgaggggaaaattaagtggtttaacatttttggaataatactattttttccccttgggatttcccaaaatacacttgttcaaagtgaacatcagtccctcatttttaaaaaagatttcctaaagatatttaagaggttttatttatcagatagcattgatagagtgtattatttaccacttggtctggatcagtcatcgtcatcatcttaatggtaaagtggagagtgcatcaaattttgagtctaaagcattagcttcattcctgcctctgactcttaggaaatttatctaagtacatattcctgagctgtaaaatggggataaaaatacctaaatgacttcacaggtttattgtaatatccaataggtgatagattggaaagtctatgtgaattattaagtcatggcatttgtttttaaatgccatatttatcaacaagcaggcccatgctaggctgaagctgaagcttctgtgtcttccaaaaacattttgttagtttaaataaggttcatcactattgggaatcttttgaagatgaaaaacttgttttctagaattaatatttaaatcaactttaaattggtctataaaaaactaataaaatttcaaagatttcaggctgattatctttcattataaaaatattttaaaatagttattttataaaaaacattcacctgcattagtttatgtacatcaaggcaatatgttcaattaatattgtattcaatagaataagtactttgtattcttcatatgattagaaagttctgtactagcatctgaactataaataaataaatcttaggatatatatatgacctgcttatcctcagtgtaaccctgcgacacaaggataagtaagtacaaaaaaaaaaagattaataccatcaaaaaaatcactctctggactggctaataaaagtgattcatccaagatacatgaaacaaagccataatatttacttaattattaactgaaaactatatgtaagcacagagctaagttctgaaaatatgaagttctccatctgtgatcatgtgtgcaataagaatttgagtggaataaaatgtgtgtatcttggtagtcagagacagtagtggcatgtgttcatggcaaaacagcttgaagaagaaatttattctgttaatgtaagcaagatttatttatttttatttctgctatgattatcctggagaaattaccacagtaaaagctgtggcaccgctaacacccacagtcatgttccttctgtttatgtgaaaggcagaaccattgagttggaactcaagtttttacttgaatgtattattcaaaaaaactttatgaatgtaactgatattttataccatattctataagattataatttttggcagttttttcaaaacatgctatataaaaggttagtctgcagtccctacacctaacacacatatacacacaatgacataaacatatccggtaaagctacttcctagaatttactatgttaagcatcattgattgtggtattatagactgcagaacatactgtagataattattcttttctactttcaattcaataaggtagcacagcagcaacatcatcacaatattcagcattaattaaataaattatgttccatgtcttattctacattcttcatatgtattaactcattcaatccttacagtcctatgacgtagtgttttaattatccaaagtatacacaagaaacttaaggcacacagaggtggagtaaagtggcacaaacaatcttattaagtataagagaggaactcgggcagtctggctccaaagctgcgctcacaacaacatgctatgagtgatttctcatagctttattatctacttttagttcatagcatttgcagttattgatccatggtgttttctcaaatgacaaaatagtataagattctgttttgatcactggatgtaaagtgattgtggttagcatgttgtgtcttttgattggacaagctataacagccaaatatctcttgatggaatgctcgtattgaatttctcatcaaaatatttttttccaaattagttttgaggtatagatttgctatcaggaagtcatatgagataacattacatttaaacttttcctttcagagtttctctcagtaaattcgaatgtttgaaaacaaggccactgtgaaccatttaagaatcttcaaccaaaggaaaaaaaaggttaaaatatccccatactcttgttttcagcaataatagagaatattttcacctttcaagtacagactaaatattgatttatacatacagaaacctactatgaatgagattattttattaaaaaggaaaaaaatttgaagagtataaatacaatctgaaaggttaaaaaagaggtaatactaagaagaattcagtttgataaagacatattgtgatttcctctggttactttatcgccttaatagttcagactaagaaagtcactaaatttttcaagttaacttaaatttttggtggtatacctttttagagtaattcattttctcactgtgataatatctttatatgctaaaaagcctgaaagtatatttttgtttaatgttcctgccatcatttaggagagaaatattcagtatttttatatactgaaagttatcttgattcctgagagcttacattattaaatcttagaatgcttgactatattaattttttctttaatttaaaagtttttcacattaatttttcaattaaatggttaatttgcaatttcatgatactcaagaaataattgtctaataggattgtgctatcacaaaatcttagagctagaagatcctcagagattaatctagcttaaatcactaattttacacttgaggaaaatgaggtctgagaaaatatgtgagtcactgaagatcaagtagataattagaggcaaaagtagaaagagagtcttcagactattgcctctaagtaagggatatttgaattggaaccagggaaatagtgtttcgatttatactatgagatagtaatacacagtggttagggcacaggctttatatcaagaaagcctgcatttaaaaaaacccaaccaatcacttattaactttatgaacttgacaaaatttttcagccctagattttttatctgtaaattgaaaataacaatattagttacctcaggagtctattgtgacaatcaagtgggctaataaatgtaaagcatttacaacgatgtctggtacaaagtgattcttatgctagcctatattattgtaaaattgcgactgtttctcatctccaatgcaatataaatctgttggaggaatgtttgaaaaatacaaaaaatcagaaataaaatagataattgataatacctaaaacgattagccatgtacttcaagatttttttatttgaatcttttattctgtgtacattttgctttttcacttacattttaaaattctgttttacaggattatacttagagatctgatttttggcatcagggaagtctagatatcctaattttcacttgctacaaaatacctaaaatactgcataaaatacaaaaataatatttttgatgcattgatgagctttcagcaaaataagtaactcaatcactcatttaagtccaacaccaagccatatgacaaatgaagatagtattaatcctgaagatgtcacttagcatgggggtatctataatcagaacctgagtggcctagagatttttaaatattgtggtaagagcatcacacaaaatgtaacctttaacaaggttttaatcattaagtataatattgttaatgtaaagcttttcatggacctttgcaatgcgtatggaaaagagatttgggcccatgggtggttggggttttctctcaggttgtgtaatcttgaatgcacaaaggactatcagtaggagtaagtttaaaacgaaaaacacaaaaacaccaaacaacatagcgattaaaggggaagtggggagtatgaaatttgtctcagccttgactttagatggagtgtggagaaaaatctcttctgagaatttattgtatgagaaggctgtcatgtggaagtggagccttagcacatgttatttgtatagtgcagaggaaataaacctagattaagtttaaaatggactcagggctttcccaagtattttacaaaaacatatgtaaaatcttccttgagtgttatatcttcaacccatgcattttatgattctcacagagaagataccacaacataagcaaaatcacaaaacaattatcaaatacacaagggatcaagggaccatgggtgagagacagcagacaaaaatgagaagcaaagtataaaataggtatggttaatttgtttaaacaaataagacagagtcaaatcattaataaaagcaaaatacattcacaaacaaccagccagaatcaggagaaaagggaaacataaaacaaaacacatgaagaaaacagagaacaactggaaataggaaatataataactaaggtaaaaactcactggaaagttagcagaataagcacagctgaagagaaccatagtgatcagaagactgatatgaagacattttgcagaatcaacaatagagcattaaacatactttaaaaattagatacaggttataagacatgagagattatcaaggacctagagatctatagtatacgtatggaatgggcaacaaacagtattttaggaggcagtggatgttagcatctggtagcagggagaatgaaggaagctaagggtccaatttcatagtagactttagcttacattctctatttttaacttaaatctctccgtttttacctacttgttcctgttttccagtgatgtgctaattaatgttggttcgctgaacaaaaacataacttaaaatgtaggtgtatatgttatatatatgtgtttattgtaaatttttctaatataaaagaagtgtaacaaataatattttactgttattagtaaattattagctgagtgtacattctctatagccaattgattctcacagaatgctttcactgatttttgctaacttcttatatccatagccaacatatttgtgcaatttaataataatttggccattggtgatgcatcccagcccactaattctttatacaataaaattatgaaaatttcttctgatatgttttctactgttaaactatttctcattcttctaaaagtatatttactaaactgaaatatcaccttgagcagcagatacaacacacttttaggtttgcctgcattatttatattttcactattactttattaaacctagacaaacaacaaaacaataaatcaagctctgatttgtagtgtttgctgatttccataagtgtgtaaatattgacactatggccaatttcatttgagctatcagtgtgattttactgagtgcagagttaaaagatgtgcagtgacacatcattatatagtattgtatagtatttccaccatactaatacagatacagacaaaatatgatcgagagcatagctaatagtaaaataattaggaagatgagaatttttattttatcatctttgtccttaatataattgagagtttatataatttaattattaataatgcctatgtttaacaattgcttaccacatttctaaggatacaacaatcagctctcattagccagcaggagaaggtgcctgtttccttctggtgtccatgatcacggagcagctcccacttattttctccagagagcattctcctcttatgtggcatgggagagggaaaaagatgacagcagtaaaagattaagaagggcactggaaattcctccctgttctttttgttttgtgttgttttgttttgttctgttctgtttgagactgagtctggactggagtgcagtggtgcgatctcggctcactacaacctccacctcccaggttcaagcaattctcctgcctcagcctcccgagtagctgggactacaggcacagccaccacacccagctaattttttgtattttagtagagacagggtttcaccgtgttgcccaggctggtctcgaactcctgaggaaaggcgatctgcccgcctcggcctcccaaagtgctaggattacaggcgtgagccatagcgccaggccccactgttctgtttacacactttcagcaaatacttttgttttcatccatgcctgcacccataacttccacagggactcatgcctccaatctgggcttctctgagggcaaattggatctattattattgttcctcccattgaaggcatttaatatgaaactgtccattctcctaaattggttgctatgattcctgtcgtctccaaatcacttgaaatcttttattttcttttaatcattttcctttcactttttctttgtgtgttagaattttattttgtgccagtaattgtggggtggcaggtggctgctggagaggtaaaagcaataattgctggtatcagtccttcaatatttaatcagaaatatcacttgatgtttcttatattcataatcccagggctcactagatacagttaatagtgaaaaaacgatacaaaatacggaatagtaaatattccatcatgtctttgtatatgttacctcagattaaacagtagaaataataatttgttgttttaaagtgtactttatcaacccattgaatttttttttctcgtatgtatgccaagaaaaaggtcagtcctatgtcctcagatatgcaacatttataggtgtcagagtctgagaatcttaataaggtctattattttggaatgttaataaatagtaccatggtatcaggtgctccatcttagtatggacaccatataagatcatttcaaacctcctcagtacatctgtcatcttatatattgctataaatcatccccattgaactacttcaaaatgtttcacaggcgactcccctaggtattcaattaagcactgaggtttgcagaaaggtgtcaaaagtgaaggggaaagaggtggaaaatggaattggatataacatgcttctttctgtcagacacaatttcttttcctcaaatagccagaaaacgtgttaagggtttgtaacaatatataaagaagtgatgaacagaaaaaggcataagcctgttagtgtgtatatgggaaaatgggttctacacatgtataaaaattagatttttaaaattttaatagctgaatgttagatcactaacataactgaagcacatattttaaaatatgttttttcttttttttttttcttgttctttactgggaagaacagggaagataaaattgtaggttttattcacaataacacaatgaaagtaattatataataaaatcagtaattatattatataatacatatttataaattatataattatattataaattatatattttatattattatataacaacatttataaaatttaaatgcaatgcttataggaatccatttggacagtagtgttagaataattcctgagctcagataattataacagtgtgataaaatgttgttttattcattttggaaacatttctgcactcaatattgtctatgttcccactgtgaaatctcgggtctagacatctgtcattttacaaaataggctataaggaaatcactgttgaacatggtgtagccgttatctactgctctgattatgtgttttgagggagcagaatataaaaaatggctaccctgatgcttgcatagcttatttctccatccttgtacttcatcacaaactccgtgtgtattctgtgttgcacatataatgagttagagtacttagattcaacttcttatatctcagttatttgtacttgtaagtggacttgtagttcccactgaaataacaagtctctccttttctgccccacgaaaaccttctcactctttagtaactgctcaagtgtcattttctttagggacttagcctttgctacatatgaaagctttccttaacctgatgtgttgtcctaaggattcctctctttagttcttccacagcatcctatgcttaatgcaggaactattttcctatactgtaatcagcctttttcttggttttagctcgctaaatcctaaacatctttagagcatggcttgtgtcttctttttattcttaaccgaaagtaggtatttgtaacattaatagtttgtcagtttcctctagtgaggcattttattgtgatggaattaggcattgataagagtgaagtaggaagaaaatacattacggaggctggaaagattagtaagttatactataaatgcttactaaattagatggttttaaactataatccaattgtagacaacatccatgtgtgggattaattaatgtattctatgcattgaaattgtgaactaaaataaataacaaagcttctgtataaagggttatcatattccaggaaggaactatttccttctttttttatagtgagtattaatgagtataatgagaaaaaaaaaaagaaaaaaacaagagatctatctctctgttcttctctttttttcctgtttctctttcagaagtaatgagttttgtaatgttccctaaagccccaaaattcagatatctgctaaaggctctcaaagtcaacataataaaaatcatgctttagataacaatatgtatcttccaaaaactatagaactcagatcagtgtccatacaacaccagaaggaagggtagaaagtaaactctgatttgagatgatggatagataagccttaatttagaatgtgacataaagcaaaggcccagggcttagtgctggtttactgagctctaggattatctatcgttagtcaggacttgaatgaaacccttgagttattttacctgtaaataacaggttaggttctattatgtgtttttaaaatttaaatctttttaaaatttaaaacatttatgtacaaatgatacttctcttacaatcacaggatttctaattaggaaaataattttaaatactttcaaatgttgttttcattttttaaattatttttttaaattagaaatcctgtaattgtgatagagaagtctcatttgtacataagagttttaactttttgttttaagtagagtttttatttaacttgggttgcagctgaacaaaacatgtttttaacattaaacaattttactttcatatctgtttgcctatcttcaactctgcatggaaagtatattgaatagatttttaggatattgtcaaatcttgtatcaaatccaaaactctgatatctacattgatataggatatttcatttagtcgcaagagaaactgttgataaaagaacactttccccaatgaacgttttaatagcttttcaagggtattggatatgcttgattttgtgttcaatttttttctgcccaagaaaacactttgtgttactgtaatcaactacaaataatgtcttcacatttaaaaggctgaaaggttctcagtttttaataataattagaaataatgaatgctttgttctgtctaaaatatatttcattgatgttcagaatttcaaacacttcatgtattcactatttcaaaggtcatttaaatttgaagactttgcgctttaaaatctgaacatggccttaaaatttatatcttttagcatccttgctaagtacaattagctgttttttggaattagactattatcacttttatcacatattaaaataattctttaaaagggcatcagtttacctatttttccactgaaatagtttttaattttgtattttcattcctttatatggtttttatgcacttagaaattcaaagaccagtccgggcacagtggcttacacctgtaatcccaagaatttggaggctgatgcaagcatgtcacttgaggcctggagtttcagaccagcctggtcaacaatgcaaaaccctgtctctactaaaatacaaaaatgagctggtcatagtggcacacacctataatcccagccactctggaggctgagacatgagaattacttgcacctgcagacggagtttgtagtgagccgagatcgcaccactgcactccagcctgagccacggagcgagattctgtctcgaaagaaagaaaagaaaggaaaggaagggaagaagtgaagaaaggaaaggaagggaagaagtgaagaaagggaaggaagggaaggagtgaagaaagggaaggaagggaagaagtgaaggaagggaaggaagaagtgaaggaagggaagaaatagccaaagaccatgactacaaattatacattgaaagtagattgggttaattaacaatttttacagtgttttctctttatggcatggcaaaataatttcggatttcattatttcatttcatattttaatttatcccctagtatctataagaatataaaatcatttactgccaagatacaatgggaaaaattaacagtaacttagaagggcacttgaattgatgagacagatgtagcaccaaatcccctacataagtaagccaattaaatctttgtcagtgaacatgcagcacccaagtcccacagacgtgaagtgacaggcttggactttgaacccagggccataagctctttctggtgcatgacacacattctgagcatataataagtgctaatgtatgttcaatttttcattgtatttttctgatttgatgtttgttgccaagaacacagtatattgagtatgcagacacatctcaataagtatttcccctataatgtgaaagggaaaaaaaaactttgtttctcagtagctttatgaaaatacaacttaaatttggaaaattagactgcctctaaaagagcaaatggtgcattttagaactcctgggagacacaacaaagggaacaaacaaaagagccagatggagaggttggaagggagaagaagattttcattttgttagatagcaacaaatttttcattcaactacatataacgaattcctagatcctaactacctggtttatatattcgtaccttctctctgtcttctgttttccactattcttgagtcaatcattatttgtgatgtcatggagaaaaaatgaggtaaggatttctgattatctcaggtttgaggttttgaagagattgaataatgattttggggtacagcttgtgtctaaatgtatttacattttcaaaggaccagaatatccatagattaaacttaagggcataatggccatatttgttaaaaagctaaaaacaaaattaccagtttatcctaaacttaactaaaggtgctctaaatacacagaaatcatcattttgccaagtcaactgcattctactatttttttttttttctgatgctggagaatttggcattttcactatatgaatcaccatcaagattattactttcacaaaagagaggaaatcggcagaactgaaatagataagcacaagtttacctctcttctctctgtttttaccatcgtctatagcaggggtgtccaatctttttgattctgtgggccacattggaagaagaattgtcttgggccacatataaaatatactaatgagctagaaaacaaaaattgcaaaaaaaaaaacaacaaaaaacaaaactcataatgttgtaagaaagtttacgagtttatgttgggccacattcaaagccgtcctgggccacatgtgattggtgggcctacagtattataaaaggacataggagtcttatgtcttatttattctctacaaatttaaaaatttgaacttctaatgttttccaaggtgatgtacaacagaatcatgtcagagctgaatattgtaactgtattgttcctagggcactcttaaaacttccacagctatggctgccacaaagtactgcatttgcttaacactcaaggttattggcacatgtgcccttttgcatttgaacaaaatctgtgttttattcacgtacaaccaagatgtcactttataatgctgcaaagacatagaggaaggtgtagaaacacacacttccagaaaaaaatactaagaggcaaattactgattaacatttaacattctaaatcattacttaaataaataccaatttttgaagatatggacagaaaatgaaagcagtcaaagcagtgtttggggcacatatgttaatgcattttaataagatggaagaaactaaatgacagggaaaatatattagaaacatttcttttttttttctttttttttttttttcagacattgcaggccatactgaaaagtcactgattttgtatttcagtgtaatatctaaaattgaattttaattcgcatgcattcgttgcagagagacagagagagagagagagagaaagagagagagagagagagaaattgagagatttaagttgattcactgggtcagacagaagtatttgcagctgcaataaagaagctttccccaaactgcattgccagatcttctcagctctgacccacagtcactgtgccaaaagctgccaggaatgccaagtgcatggtgattttgtgacgtagagaaatagggttctgggtgagaatacttaattgtcttgaactacaatatttgcttggtatccgagccaaagtttccagacataaaaaacagtggtaaaaatccacagacacaaaaatactttgtatctactgcctcaaagtaagcaggacctttgagcaagcagcactttgagtttgatttcggctgttgtttttaaattgtgatggctaaaggaaggcagtctagtttgtttatgtgtatccttgagactaaagatatgctctcagttgcccttagactcccgatatttgtaacttagatatatttgctgtatcttctcttctgaggttatatatgtctttattgtttcttaatcaaatttaagtataggaacatctctttgttatttctcataagtttcttgggattttaggtgttattcggaaagtttttttttccttaaatatttgaagtttggggttttaatctgcgttgtttgtattttaattgagctatgggaaattatggaattttttcaaattcttgtggaattcactctatacctttaggaaagaaaatacgttgaaaacttttatataatctccagggtaaaaatccttacaaaaatatatacaattttaagctaatttttattagggaacatttcaatacaactaacatttttgaaatacatttttagtgattgaaaatgatcttcagtatttcaatgatttcaggtacaccatgttgctaccaattaatccttagaaaagtcattttatttactagagtttattgcatctggttttgtcatgtaagtatccatttaacaatattatatttgcataagaactttttgagtacatcatagtagagtaagtgatgagcaccttctgttttctgaaaaaaatgggttgataagaatgaattcatgcttggagaattatgttaaaaattggtgcctgataaatcataaattggacaggctgcctgtcttgcataggtcttttatcaggtattatacaaacaactgattgtaggatgactgcatattttaaggactattgaaaattagtggatactgattttactgttagaaccctagagttggtgggcctgccgagtcctgcttgaattactatttcgttgaagattattaatcaccagctgccatcacacagtggcaggattccaaggcagcactctgaggactcctctgttcattcctctgtcgcagggtgacatagtatagaagcctttttggcttctctgcaaaagaacataactgcctctaaaatgtgtgcattatcaccaagtttaaagttagaggatgttcaggaaaaaaaaattctcagatattttattgagaccaactgagtacatatgctttttgttaagaatcatgttaattcaaaaataaaaaagttccaatatttttgctcacaatcctttgttctccctctatccatccatcacttggtgatacatttcacagtcacatggtggtaggggacagtgtgggaaagagaaagactttggcctttgagtcctgtaaattattcagttgtacattctagtggtttccatttcgtcagacttcaacatactgtgaaatggtgacatgtcaaaggttgcattattggttgataatgcagctctgtaaagtgtgtgagctcgggtcccagcgtcccctgccaacacacacagatcccaggacaggtgcaaatttgacttcacacatcacagttgaacaagccaagcctgaatataacctgactgggcttaacttttcacttcttttgcaatctgctttcttatcacttcttagattgttttttttaattttatttgtaagagtaagggaaatttggtagtttataagcctgagttcaaacttccatgatttctcagttgtcaaacgtattttctgagaaatgccctcatcaaagtaatcagcctaatattttttatttcttattaaaattacattatatttattcaaatttcaggtaaatttaaatataatgtaatttttcaaaataattctttaatattacacaaataaggaattattgcctttagtttgttctcataatgtttttgaataattgcctttcaaaatgcttgacttaagaagaggaagacatctacaataaaaatttactatgcagatttttttaaatttacatttgctactttttagtagcctttaaaatatcattttcatctaagaagcatgctgtgactgtgtttacagggttaatcacataaattaaaggaatgatgggaagaagttataagcagtatgtagagtaagttaactaaaagtggcatgttagctcaaaatagaatgtatatttttggcataatgaaacacaatgcttggtcttcttctaagttaactttttaaattaaatacttggagttgtattgtgaatatattcgtgtccttataaaggaccacataacttgtatctgagaacttttctttttgttgagatataagtttaaaggaatgtgaatttctaataagactaattcagttggatctcttaaatcttaatggattatggattagtgactgaagaaaaccaggtagagagagcaaggatattgaactcctatacatctttaaaactttaatcattgaacttatttgcgtgttctttggagggaaattagccctccagctggcttccaactgtgacagcagcttttattctaacattagtagaaagaattgtataatgatgctagttcagacttttttccttcctgatatatgttacaattatttgtcatggacaagagtccatgttttcaaaagagaatagtatctggtaatattatcattctattccagctagggtaatgtggggaatagaagttgttagaaacatgtgaatgcaaatttgcaatttaggaaactcaaaatagacattactgctcttcatttcaaagcaagttttagtgacattaaatcaaaactctccagttttatttttactataatctcctgacatgtatagctcacatcatgttttattgtaatgcttagtgtcagtcatttctagatttttttgcagtgactaattttatttttgctttaaaaatttatagaatagggggattatttatttaaaatctcttaaaataaatacatgagtgtaaaatctgagacccttgctgttgctcacattttaaatttgaccatgctaactcagtgtagaagagccagagaacaaactctgtaaccagaaacccagcttccattgccctctttagtatctacatgccatgttaccttgggcttactgtacaatcagcacctcagttccctcttgttaaataagactaatactagtacatacaagggacaaaattatatatataaaatattaaataatatataaaatacatatatgtataatatataatatataaaataaaattttatatatatagcacttaacagtaggtaaatgttagctattcttccaattgactcattaatgaatcatgagaatcttttatgtgataatgaaattcgagagtactaagtgaaataattgcacagtgcttataaatagggaaataagagtgaaagataatacaaattaattgaaatatgtaatataaggaaaaacagatgagaactcttgtaaataaaagattaatgaaatttagaatctattgaaagggatatttgttatttttaataacaaatttatttttaatattaaaaattttaatatttgtctttgaaaatttaatatttgtctttgaaatatctaatatccaaattctcaatatttcatatgatagtttttgttctatttgttcagtttttataaataggatatttcttacaaaatgtgtttgattttcaaatataactttatcattaaatttgtttagtatccttatgaggaaatttgcagtcatatttgataagtacgcataatttatttcactttccatgcttcagtattattttataatggtattttcaatttgtaaaccagactgtaatgaaactcttccctcataattgtttagaaataacgtatctttagaatgtgtcaataatttgtgctctctagaaagactttatttgttatactttaaaagtggaatctatttatatttctgttgcctaaccaaaatagcatatctaaaatatggatagagttactgcttttcaaagaacatatttaagatttctcttaatatcttaatttttatcttatatatagatcttatgtatgtctaaaagatacattaggtctcatatatctaatatttgctacagttaatataaaaacaaatgaagattaattgacttagtttaatatttctatgttcttgcttaaggaactgattggttttctcatagggcattgaaagagcctaatgaaaaaaatgctataaacgttagacttaaaaagatctagcttcaagttctgttctgccacttgtaacctgagaggttttgaataagcagtttagtatctgtgaagctttgttttctcctatacaaagtggagataatcacatagagttgtgataacaactatcacattaagatgttatgaaatgggggaatgaggggggcctggatgatgagaaatgacttcatggatacgacgtggattattgccatgatatatatactaaaagccctgacttcaccactatgtaatgtaacaaaattacacttgtaccttataaagttatacaaataaaaattttaaataaaatatcactctaacaaaatatgaaataaaatgagattacatatgtaaagcacttggaacagtatctgataacagtttttgcaataataattatataaatatctggcatttaactactaaagacatgttcgtatgtgtattatgtaaaattgaggccttcttgaatcttatgatttctaacacagacacttcggctgaaatgccataaaacacttagagatagacattttgcagagtacctggcaatggcatatataatataaaacacatatatttagtgcataatgtgcataatcctcaaataaaattagctacttttagaatattgtttttcttttaataccgttttacacaaaatgggctatcagaacagtagatcacatatttatttaaaaactaaaggagtgagttgagagagatacatgaaagaaaagaaagtgccacatgtggtatgccacctttatagagatttaatcttatataaaaagctctaagaattcctgttttaaagaaccttagacatttacttcaaacataaagctactaagattatttttgattgaatcatttttagatgtatttatcaacattctactgaagaaatgttccactgagcaaactattaaatggtaatgttagaatgcatgaaaaattaacgtaaaatcataggtcaaacagaaatgtaacactatagatctagtttggaaacaattaacagctaaagcccaggatatgactaaagagaaaggatctctgcttagattacagaatggaagaaaataaattctgataactaggtaattaagtttggcagctagggatgaaaaagacaactgaaaataaaatatggaagaagtaagaatgaaacacagcaagtactcttttgagaagaaaaagagttaagatttttctgtcccagcactttttgaatctaagtcccgtaatatatataaaatgagggattagactatattgcctctaccaggttattgcaagcacttaaacttgtaattctcatataaaataaaaaaaacaaaaagtatattcttccaatattttccttaaatatttacacattacatgatacattttatttgtgaataactttaatactcttaaattagaatgttataaatgctattaagttatctgttttaatataaggtgtgtgtgcatctagtaataggaagaaaagaaggaaggaagaataaggacgacaaaagaagagagggaaggaaagaaaaaacttgtcaaatatttcatagctgatctaattttgtgctctttttttctgtgccacatttattcccagaagtttctttggtggatcaagagatgtgaagccagtgcctggtatggaggagatgaacatacctgaatctctcaattttaatgacaatttatttttttactagacatatagacatcctaaatatatatattatgaaaatttcatattatattaaaaggaacattgttcctttttgttactttattaaatttaatttttttaggacaggatcttgcacttttgcacaggctggactcaatcatggcttactgaagcctcgaaatcctgggctcaagcaatcctctgtgtctctgggactacaggaacatacatgccaccgagcctggccaatatttttttttcttttttttttagaaatagactttatgtatttaaacataaaaactgtgaaaaagaaatcatcagaattcaggaggtagatgatgagaaggggaagatattgatcaaaaggtacaaaacttgcaggtataaaatgagtaagttctggaaatgtacaacatgatgacgtaacatagttaataatcatatatgcttgaagtgtcctaaaattattttaaaaatgccaacttttattttcaatacagggggtacatgtgcaggttttttacatgggtatattgcacccaggtagtgagtatagtacccaataggtagctttacgatgcatgccccctccttctccctcctccagtagtcttcagtgtctattcccattcttaggtctatgtatgttcaatgttttccttccacttataaatgagaacatgcagtatttagctttctgttcctgcattaatttgctttggaatgatgaaccctagctccatctagtttgccacaaatggcattatttcattcttttatgactgtgtagtattagatgttgtatatgtaccacattttctttatccaatctaccattgataggcgcctaggttgatttcattatctttgctcttgtgatgtttcatgttcagtgctatggcaatgaacatttgggtgcatgtatctttttgtataaggatctgttttcctttgagtatgtgcctagtaatgggaatgctaggtagaatggtggctctattttaagttctttgagaaatctccaaattgctatctacagtgtctgaactaattttcattcccaccaaaagtatgtaagcattcagctttctccacaccctcatcaacatctgttatagtttacttaatagtagccattctgactggtgtgagatggtatctcattgtggttttgattggcatttctctaattcgtgatgataagcattttttcatatgtttgtgggctacttgtatgtcttcttttgaaaagtgttgatgtccttttcccatttttaaatggagttatctgttttttacatgttgacttgagttcttcgttgattccggagatgagacctttgtcagatgcatagtttgcagatatgttctcttgttccgtaggttgtctgtttactctgtttatagtctttttgttgttgttgtttttgttgttttttttaaatgcagaagctctttagtttaactagctcccatttgtcaatttttggttttgttgcaattgcttttgggaacttggccaaaaattctttgtcaaggccaatgttgataaggaaatttcctaggttttcttctagggttttttatagtgtgaggtcttccacttaaatctttaatctacattgagttaatttttgtatatggtaaaatttaagggtccactttcattcttctgcatgcttgtttatctcagccttgttgaagatcagatggttatagggtgtggggctttatttctgtttcttattctgatctattgatctgtttgtttttgtaccaataccatgctatttggttactgtagccttatagtatagtttgacgttaagtaatgtgatgcatctagctttattcttcttgcttgggattgttttggttatttgtgctcttttttggttccatgtgaattttagaatagttttatttttttaattctgtgagaatgaccttggtagtttgataggtataacattgaatatgtacattgctttgggcgctgtggccatttcaatgatattgattcttctaatccatgaacatggaatgtttttccatgtatttttgttatgtctgatttatttcaccagtgttttatagttcttattgtggagatctttcaacatactactggaagtcttagccagagcaatcaggcaagagaaggaaataaagggatctaaatagaaaaagaataagtcaaactatctctcttctctatgattccatagttagaaaaccccaaagactctgccaaaaggctgctggaacttataaacaacttttgaaagttttcagaatataaaataaatgtacaaaaactcactagcatttttatatactaataacatttaggctgagagtcaaatcaagaacgcaatctcatttacaatagctacaaaaaaatgaaatatctatgaatacagttagccagctaattaaataaaaaatttctatatactgggtctccttatgttgttcaggttggtctcaaacccctggcctgaagtgataccttggcttcccaaagtgctaggaatcacaggtatgggcctctgcacctggccaaatttaaaaaaaaattgattgtttaactgtcatacatgccttgatttcagaagatattttacatttggtgaaaaatgagcaaatttgagctcttcatctgatgagaaattcaatctaatcagaattgtctttttcaattgcaaagtgtaattttctcaaggatcacatattataatatctatattagtaaattactatacacacatttatttaactcattgtcttatgaatgctttattaagattacatttacattgcaagtagagattagttatcctgagagacaaaaatctacaactagatctgactgacatgattaaaaaataacagattgtgttgcttataaaaaaagggtagtgttggcagaataacctgcaacaatgcttgatactttctaacatctttttcattgaaaaaagggatttaacattctataagtattgtagccatgatgtaaatggatacaacataaaattaaggaaattatattttattaaatgatacaacatataagtaaaatgtatttatagatttatgcatacatatttcaattaattttcctatttgatatcaatatgcttctccaaagtaataaattaagtctcactaaaataaacaagatgaagaatttggaacaaaacctcaaagcctctcaagaaattgtttctagattgtgaagtaaatagttgtcaggctgtagctctcatttttattcagctcttatatttgccagcttttgatgttatggctattaacttttatagatgtcatacatttttatgttaatcgttcagctttttgtctggtgagtagctagacttgtgttccttgaacaaattatatgagcaaattaccacatgccttcaacatctttaaaaggttttgtttcctgtttgtcattttagaattgatttttaaaattaagaatatttcaaatacttattgataatggacaaaatatgtttactctttttgtgaggtcatctttaagataatataagagttgtatagttcaaataaactttctcaaatttattagaagacaaataaatgtttatattcatataagtcaaaatactacatcaaattttacatagtaaaatatttatgatttatgtgcaacagatatgttatgtaattatttccctttatctcttttttttctcattatagaacagctgtcatccaaacattttgatggaaacttcacttttattaaggaatatttttaacatatattcttataaatattttagatctagcttctaacataaacataattgcaattatatctcaaacttaaacaaaaatattctagtatattcaaacatttcattagtatttaaactttcaatcttcctgtaagttctatattttataaaatatatattaaatttgaagcatttgttttaaaaggatccaaataaaattttcatattgttagaagttgataggcttaattccatgtgtgtcttttctttttccttggaatgtgtttgttactgaaactgaatagtttgtttttgtagttttctacagtatgtttcagtctgattgcatcactgcaatggtgtttaacatgttccccttttctccctatattacctatttatttgtagttgtagtcaagaaatgaaagaaggccaaatttaattgactttgttttggtttcattttgatacagttatgttataggaagaactggtttgtctctcaaattttcttaacagtactttattcatatgtactttacatattgagcataaacattaaatatacagtcccatgaactgtgatacatctatgtacctgagtaagtaatatccagatcaggatatagatttctattactccacaaagtttcttcatgctcctatccagacaagcccccatctccctgctcactacccccatgagcgaccactatgatttttatcaccatggactgctccttaacttgacatgtattcttttgcatctgacttctttcttccctcaggcttttgagactttcccatgttttaaaagtattgatagtattttttcatcaaattatttccccgtaagaattagatcacaggttgtttttcctgtctcctgttgatgaacattgatgggattttttattttgggctcttatgaataagctgccgcaaatatctttagagaagtcatcttatgtgaaaaacgcattcacttttcttgcagtcaaatgtcctaggagtagaattggtgggtcataggatgacaactgaaaaagaattttccatcttgattgcactgttttagactcctaccggcttcgtaggagagttctcgtcgtaccacactcttggcatcacttgttattgtctgttttcgtaatggaacgtttgggtgggtgggctatctcattgaagttttaacttgcagttcatctataattaataatgtgccatggagatactttcttattatgtgccactcagctatcttcttttataaagtgcctgttaaagtctttagcccaatttttaaaaattgagttattttctctcgcttgtaataatttgtgggtattttcaaaactattttctagatacaatttcttgttcagtttgtgtattgtcaaatatattacattattaacctgcctgtacagagcagtagtttctaatactgataaacttttacctattaatattttttcttgttcttaacacttaaatcttgactaaaaaaaaaaaacttgttcactctgaaatcatgaatatttatgttttcatctagaaatgctatagttttagcttttatagccttagcttttaaatttagatttataacccatccggaattattttttgtctatgatgactgctggggctaacagtttaatccttttgatttgttattatgactattaaaatgtaaacaaatgtaaaacaggttattgaggcaaaaactattttcatggtgtctattcaatatcttcatgaacataagtatccttgagggaattttaaaattgcacccattttgtgaaattatttcgtattctatttatgttttcatttatcattattatcactcctgaattagtaaatgctgttaataatcaacaaacttatacaatcacagtctttgaattctttttttttttttttttttttactttttcctcaagcctttatcctatatcaggtgttgtacttggatttagacattttggaaagtatccaactgtttttgtaatttcggtagtagcagtacaacttgttccctaaaaagctaaatagccacaacaaatgtacaatgatcggttagagtgggactgagaggcaatgtttcccaatatgtagaggagggattcagaaacatttaataatggtgtgatcctgtataacttactttatctccttgtgtatctccttgtttataagataaaatcatgatagtgtctgctgatagggttatggggattaaattaatgttaacatttgtaaagtgtttggaatggtgtcaaccacacagtaaaattatataattgctttactattactattgtaagattttttttgtaaggggacctgagataattttgttttttgaacaaagagaaaacaataaaaaattctaaccaataaatgatacagtgtgaagttcagtctaattagatatacaagtaaaccttatccaaccataggacaatgaattgttgcaaaatgatcatggcttgaattatggtttttttgtttgttttaaataaggaaactataaagccactctttataagcatttataaaactgtggctccataatggtttctcattatttaggtaaagtgacattgaagataaaatacatattttctgcagaatagttaaaaatttctatagcataccaacaattttagatcactttatatgttatgaaattttccttagttgattgaactttaagagaaaaatgtgactaaggaaaataaaaagaaatcttattttcttaaacaaatatgttacattccatatacaagtttggaaattcattatacttaacaaatttaacatgtatgtctgaacccagtttcactctggaaccaataatttgaaatgttccttatctataaatagaaattagttgaattagacagaatggcctagtttcacttatgtgaaaattctcttgtatgatatgttcgatttggaagataatattctgctcattttgttatacagattaaggaagtaaacagatcccctttactttgtaccctgttaaaaataatttcataaaatgaagtttcactcattggggacattttttatcctgaaatttttgatgaaatattcaagttttaccttgtataatgacaataaaattctttttgagatctgtagcattcagtgccttgattcaatagtaccagcaatgaaagttgaagcaatgtctaattcagtccctttatcttaaagagctagaaatatttatagatttgattttattttgaatacatttaaataaatgaggtaggtaattattagtgtgcatacgggtgcatccccaaatactgtaaatcaccaaaagttttcagcagtataagcctcctcatttttattatactattgatctcagtatcttatgtaaaagtagttacatttcttggaatattttgtcacctctccacattatttcacaatgggacacatatcagaagtagtttaatttaataaacaacatacatttatcaagcacttagcatgtatcgagcatggctgttaatgctgggggttgaaagaaacagccgtttctcccttcactgaagttacattctgtctgggtagaaaatttaaaaataataaaaatgccatgttaagagtaattaataagactgtatataaattgcaatggtcaaacaagcggttgataaaggagaagtgtgcccagtaaagcaagggcattgcttgaaatgagttatggaagtataccacaaccattttagtatgatttagagttaaaactttagttcccatttgattattgcacttgattcatttactatatcagttcacatttattccatattaataaatgatgattcatgatgcaaagataaaaattaagttgtcaaattgatttttaaaataaaatatatattatcagatacataaatatgataaatatatttcattatttctttagagacaattatttatgtgtagaactagctgatatagaatatgtagaaattatttcagtgtttacaagtctacaaacagtgttacaagtttacaaatatatatatatatatataatatatatataactaaccactttactaaaagttaactatagtaactacttaactacaaggtgtagctactacttactacttaactactatactaactatatatgtatatagttatatatgaggaagaggtaacgggagagagggaaagattatgaaaatttgccatatgactatggaggtagagaattcccaccagtttaccatctataagctataaaaccaagaaagctcatggtgaaattcaaagtttgaaggcttgagaaccagacgaggcaatgttgtaactccaagcctgagtgtgaaggcacaagaaccatgagctctgatgcctaataccaggagaaatgatagaatttgcccttcttctgccttttttttttcttttcagaccctcaactgattggatgatgcccacccacattggtgagggcagatctttaccccatctactgattcctatattaatctcttccagaaacattctcacaggcacacctacaagtaatgttttaccagctatctgggcattgcttggcccaatcaggttgacatgtaaaattaaccatcacaagtccatcactgggtacccataggtatttccttgaaccatacttaataaccaaataaagacaataacaagatcataattctgcttaacattatacaactatcctgcctgcaaccaaaatggaactaattctttcctctgaagtggaggtaaaatcctggagtaatttttactcttgatatctcgtaacttagaaactaggatgtgaaattaacaataactaagtagagatgctcttcgactggtgatcttatgtctctgtaaactcttcataagttataaatattattaagtcagaagttcacatttgacttaatacgttcaacttacaaagggtttatcagacataactccatcataagttgaggagcatattgaatgcatatcactttcacaccattgtacatttgaaaaatcataagttgaaccatcataagctggggactgtatgtaatgttatgaggtcaatatctattacatttcataatataggagaggggaaaaacaatagatttgcttaatatatgtatatatgcataccaacatatttataacaaaataaggaggaaatattcatgatactggcagttctcattactttagcaagtcattcggttatagctggtatttataacgaccttcttctactacccatttcatattccctttgccttcaacaatcacttccactggtcatggttctttatttggtagggtgacccagatcttcatatctgaatagcctggactattgttagtcctgcttagtttgggttgttgtagttttcaatcaccttaatcacagggcgtgatattactaagagaagttctaagatatcttctgtattccagacatattcattcgtatctacattgagaaatattagtccaatttccctttggtaataaggattaatcaccctagccagtgcaataattcccttctttgcctgttgattcagatacatgagaagtacaaggtatctgagtggcagccttgactcccagttcagtggaattatcattgtgtctcttggtggaagcactcttctttctggaaatgagacctgtaggccagcagagtataaagttatagaaacagggagcacaaatgtagatagtgagtcactagaggtaatgctgagtggtaccactcccatttcttttgcttggttcctggacccataaatcctggctatcagagaaacagaaccacatatagtggatgctgattcagagcctatacagtcttctgtaggaccctgacccaaccccacaaggtattatcaccttgctggaattggaacttgagtcttaaaaaggtcatttcactgttctgtcaaggcagctgcctcaggatgatgggaaacatagttgtaccagtgaattccatgagcatagcccatgactgcatttatttgtctgtcaaagtggttcattgatcagaaacaatgctgtgtagaatatcataacagcaatcaaggaattctataagtgcatagatggtagttttggcagaaacattgtatgccggaaaggaaaacctgtatccagaataaatgtctattgcaataaagataaaacactgccccttccatgatggaaacagtccgatgcaatcaacttgccaccaggtagctggctgatcactctggggaatggtgccacatcagggactcagtgtgggtctctgctgctggcagattgcgtatacaacagtggtcatagcctggtcagccttgatgagtggaagtctgtgttgctcataccatgcctaacttccatccctgcctccgtggccactttgttcataaacctattggatgacgataggagtgcctggggaaagagactgactggtatctatataataggtcatactatccacttgattattaaaattctccactagctaggtcaccctttgataagtattcacatgggactcaaatattattatttttcattctgagaggtcagtccacatacttcctccccaaatttctttgtcaccaattttccaatcatgttccttccaagtcccagaatagccagccaaatcattggctacagcccatgaattgatatataatcacacatctggccatttctccttccaagcaaattcaaaacaggtgcactgcctgaagttctgcccattgagaggatttcctgttacaactgtcattcagctatgtcccagagtggggttgtagtactgcagctgtccactttcaggtcatgtctgcatattgtgcagaaccctctgtaaacaaggccaaagttttctttttctctgtcaactttcatagaacactccccatgaggctagaggtgcaggctgggaaaaagaaggcatgtgtcaggagtggggaccatggctgtttggaccacttcttcatgtacttacttgtgcattcagggcctcctcaggatcaatcacatacgtaccatttccatttgaagatgcagtgcatgcacaactttatggtgtggtgagtcagataacactcagtttattatgggcagaacaagatggattttcccctgcctttttgttctattcagattgtcaatgtattggatgatgcctgcccacactggtgagggcagatcttctttactcggtctactgattcatatgttaatctatccagaaactcccatatattcacagacagaaataatgttttaccagccacctgggcatcctgtagcctagtcaagttgacacataaaattaaccatcacagtctttacttaaaaatcaaatatagccaagcacgatggctcatatataaatattcccagaactttgggaggataagtcaggaggaatgctagaggccaggagtttgaggcttgcctgggcaccattttatgaccctgtctctacaaaaaaaaaaattaaaagttagccaggcatggtgacacatgcctgtagtctcagctacccaggaggctgaagcaagaggattgcttgagcctggaaagttgaggctgcagtgagctgtcattccctccaaactgagtgacagagtggaacactgtcttaaaaatatgtaattttggccgggcgcggtggctcactcctgtaatcccagcactttgggaggctgggggggttggggggtggatcacaagatcaggagttcaagaccagcctggccaagatggtgaaaaaaaaaatatatatatatatataaatatatataaatttataaatatatatataatatataaatacatataaatatataaaaatatatttataaatacatataaatatatatttataaatacatataaatatatataaacatatatttataaatatatataaacatatttataaatacatataaatatatataaatatatataaatacatatatatacttttttttttctaagttggcgtctcactctgtcactccagtccagtggcacgatcactgcaacctccacctcccaggttcaagcaattctctgcctcagcctctcaagtagctgggattacaggcacttgccaccacacccggctaatttttttgtatttttagtagagatggggtgtcaccatcttggccaggctggtcttgaactcctgatctcgtgatccagccccgctcggcctcccaaagtgctaggattacaggtgtgagccatcgcgcctggccaaaattacacacacacacacacatgtgtctgtgtgtgtgtgtgtgtgtgtttgtgtgtttgtaattgttttcaggagctagagaaatttcggttacatacacacaaacattcacttatcttttttctgagtaactgcaatgaatttatcatgaaatatggtaaacttctgtaccactagtttctacttttgttcatcgtctggttttcccctattatcttgggcacatttcctttaagccccatgaaaatagagaatctgttattattgtgttaaactatgtcttacttttctatcaaatatattttggtaaaactaaaaaatgaatttaaatgttcattgattttaatgaggacctattgtatgctgtacttgctggatgttccacagctataaaacaatagtgagccagcagatttgggtgggaacaacatcttcactatttcagacaagtcactaggggcatagcttccattcttacagttcctaaaattatcagtgtgggctcatgcccaagcatattatgaaagctgccctttgtaatatatttgtgacatcttatgtggtcataaattcttgaatactttttggctattaggatggttaacctctgtagcttagatatcctatgtcacaaacatacatgagaactaattttaaggaatagtaaaatacacttcatatgtggaaagaggatggctgacattcttaggggcagaattatccagaaagtttatatagtttgtgatattgctggaccattactccaaagggtaaatgctgtatgttttagtgatcttgggtggctataacaaaacaccacagactgtgtggcttaagcaacaatttatttttcacagttctgcagacccagaaatccaaggttaaggaaatggcagattcagtcttggtgagggcccacttcctgactctcctatcctcacatggcagaaagaacaagctctgatgtctcttcctcccttaagaaggcactaatctcatcacaggacttcattctcatgaggtcatttaaccaaattacctccccaaagccacaccttctaataccatcacactagcagtcaggatatcaacatggatttcaaggagatacaaagattcaatccataacactgcccatacactgaagatttcaaactcatgagtggcattataaaaatttgaagaaggtgacaagtagttatgtagaggagcagtttgagccaatttgagtcaataagagtttccttttctctgcatccttgccagtatctgttattgtttgtttatttaataatagctattctgacttgggtgaagtgatatttcattgtggttttgatttgcatttccctgatgattaacaatgttaagcatttttttcatatctctgttggctacctgtatgtcttctattgctatttgtgtcttttgcctattttcaaatggaattttaaaaaaaaattgttgaagtgtttgaactccttatattctggatgttagtcccttgtcagatgaataatttccaagtattttctcccattgaagatgttgtctcttcattctgttgattgtttcttttgctttgaagaagctttttagttgaatatgtctcattaaaattttgcctgtgcttttgaggtcttagccataaaatctttgcttagcctgatgtcctgaagagtgtttgtttttttacggtttcttatagtaattttataaatttaggttttattggaagtctttaacccatctttagttgacattgtaagtggtgagaaataggggtccagtctcattcttctgcatgtggttatgcagttttccaagcaccatttattgaagaaggtgttctttttccaatgtttgttcttggtgactttgtcaaagacgagttggcgtaaatatgtgggtttatttctgggttctctattctgtcccatttgtcaaactttataccaatatgttctgttttggttactatagccttgtcttatatttcgcagttaggtagtatgatgtcccagctgtgtcctttttactcagagttgctttggctatttgagccttttgtgttgttctatactaatttttggattgctttcttctttgtttttatgaaaaataacttttgtgttttgacaaggattggattggatctgcagattactttgagtaatgtggtcattttaattattttgatctgtgagcatgggttgtctttccatttctatgtgtcctttttaatttctttcactggtgttttatagttttccttgcagagatctttcacttctttggttaaattcatttctaagtattctttttttttgtagccactctaaatgggattgacttcttgattttttttcatctacttcattattgatggctagaaatattactgagtttgtatgtgattttgtatcctgtaagttaccaaatgtatcagttctaagtcttcagattttccccatataagatcatgtcatctacaaagagggataatttgactccctcttttccagtttggacaccaattattgtgttttcttttttctttttttctttcctgattgcactggctaagatttccagtaccaagtttaataatagtgttgaaaatagacatccttgtcttgttcaaggtatttgaggaaaggctttcaacttttccccattcagtattatgttagctgtgggtttctcatatatagtctttattattttgagatgtggtccttctatgccgagtttgttgaacattttatcttgcagagtagtagttctatttttatttttttgaggaacttccatactattttttataattgctgtactaactggtttgcctagcaagagtatacaagggtttccttatctgtacatcctcacactgactagcttttgtattttttattttttgataatggaaatttgtaacaaggtatgaggtgatatcttattatggctttaatttgtaattctctgatgataataaacatctctttttgatgtcattaccagatagtgtttgaaattgctgaaaagctgctatccattgttctccatatactttttgcaagtgtaaaggtctaactcacaaagttaacaacaatgctgagaacagtacattctagcaagttccttacctagccaccatgaaagaaaaattaaaaaaaaaaacacttttctaatcatttcacacagtaacaggccatgaaaagtttgtgaaattggtctgtataatggcacatggttaacaattacagaaatgtttcaaaatgtactaaaactttaaaatcatcacaatctaatcatagaaagtagttctaataccacatatgactctaaacctacaattgctctgtcaccctctatggaaggcaatttcctgtgagctctcccatgcaatgaaaattaataaatctcatgctgaatccctgagaaatgtgctgcttcttgagagaatattaacatgaggaattaacttgtgttttaaagaacattttttagcaattagagtaattttataagatgtgacgtaattaaggtaggaaaacagaccaaagttggtatatacaaatttttagaaaggtaaacattatgtcaaaatatgttctgaagcaaaggaatatagaggatgctaaaacagaagtgcccatattgcatttatttttttttctataaaccattggtttgtcagcttacagtatggaatttccaatcataaaataaatgtcaggaaattagctgcagtatcttaatacttttactgttgctttcaaatagtacaataagaaaaggctttcttttaattaagatatatattttggggaagaaagagtgattattcaggggcatttgaaaagttggtggtgaaagaaggctccagggcatcacttactacttttatcaatataccatcacataatctgtgtgaatcatttacttggattcttattgtacttatttgtgacttcatagtgtctgaactgtcactttactttctttattatttgtcagcctctacacttatatttattcttgttgtttcttaaattcaagctgaatttgatggtatgttttcctaattaatatttttcattatttttctgttacaccaaatatgcgtatactcgtgctatgaaattattcaagcagatagcgtcctagatcattttaatgttttacaaatatgtatttttggttcacatggaaccagcttaaattataccactggatatttatttatttttatttttaaaagtaaaacatttagaattaagcgtgtgtcatttcgatgccagagttaactttatcagtatctgaaagaggaaaaacaaaaagcaaaaaacaaaattaaaaaaacactaataaatgctctatttgttttcctcagtttagttatgcaggattagtttattttaattttgtttttattttttattgaaaaaatccttagacatttccctttcataatacagcctttgataatggagtttcccttgtcattcagaacattgtccttctattcagaatataattagttgaaatctgtatctcaatatctgtgcatgctgtggcaaattgaaataacatgtagatgtgtatctttgttcagacatgtgaaatacagtggtaggagaaagaagacacaatttctgtaaattttatctcccaatgactatggactttgctaatatattgtgattgtttatgatatcattgagttattagggtaattatttactgttctccacttttttacatgaaatggagcttcagcccttataagtaagaaatattaaaacaattaaatatactttactatggtaaaaaatgttgtcaaatatatttataaggcatatcatgaccttatgggaatataataaatgatccattcaaagtagatttactcattatttcaaacagtttagatacggtactccttattccagttacactggtagctgaatagtgatgaattattctaatttctctattaaatacttctattaaaatatttcatctcattaaaatgtgaatccacagtatatataacttcagaaagaaatgttcagagaaagtgagtgtgtctactgagcaaacagtgaagcaagaaaaaaggattgcacagggaattagattagccacgctggtaaaggcatagctgaagccccattaggtctggcccagacagcatttgtgtttggaagagctaagcaaatcacattaattaatgcttacaattttctttggtgaaaggtcctgatgtcagagagaagacagacattttcttttttatctgtacattatacaagcccacccaggtcactgggccattggaaaggaagcaaaaggaactgaagcaaaaataatcacgattttagcctcaaagcaaaaagaatgcttactcatttacaccattccttttattagaatgcttaattttgaactacaatgaatgtgtttgcatgtatgtgtgtgtgtgtgtatatatatatatatatatatatatacacacacacaatcacattcattgtatgtgtatatgtatcacatttattatatgtgtatatatatatttatgtacacacatacacacatttgcatgtagacatatatgtgtgtatgtgcatttcctttccagaaaattccaccagaaaggactctttgaccaaagagaaaattaaaggagtactgtagtgttattttctacactctagttgtttctacaggactttctgtgccccaatagattacaatgtcatgtagatgcagaaataaagatggttatattataaggaacacagagtgcaaataaaatactaaagttatgtataaaacaaaattatatcttctaaaaataaagtaatatagcatctaaatcatataaagccaaatgagtgttagcaccttcaaagccactatgctaaagtagttttcatttagttattgccatttacatgttttttacaaacaacactttacagtaatgcttagagcctgcatttaaaggagaggaattagagaagggaaagctgggtaaatacacaggaaatccagttgattgcttagacagagcctcatgtagtagcaattacatcactttggtggggaatcaacacaaactgatctctcacttttcagatctcgactttagaatgtttcagatagagcactcaaagataattttatttaagtgcactcacttcaagattgttgcatgaaatgatatataaacaaaaatcataatacagtattcttatgcatttaccataatatttttgttttctaagatgtactcttcctgatcaatactttagaaaacataatgaaaaaatagaaaatattttgggacaaggatgtggggggaaagtaagttatacaaaataatagtccactgagattgaagtgtgaaagaataaatccattcctgtgctacatccaatgctctctggtaccccacattttccagattcattaacactcctggaaaatgctttctgatactgttgaattctcaacctttacatttccatttttgtaagcagcatgtggaaagactagtttttctttagttagtacattctttcctcggataacgtgcaataaaatctgttagatagatgcacatcctttcttataaacaattctaacactgaacgttaacgttcactgtgtacctcttctgttttccgaaattttgtaacagcatattttcatgaaaattattttgttattttttcagatggtagagaatatccacgaaaatatcattcttcccccattcatactgaaaattctaagatgccttaatgtagaaatcatgcatgcaatattcatttttaatggctaatcatgcaagtatatgtggaagaggccagagttgggccaagatttcaaaagtgatgtgttttattcataaagatgtgctaggactcagtaattacccattattataggaagatacaaagaataagaacagatttttcaagctgctatccctaatgtatttgtcttttattacttatgagtcttttagctgggtcagattataaaaggctggttccagtttacaaactgtccaaaacgatgactaagagaaggttcaagtttgctcttgcttggatttacataaacaggacaaaaagtgcaaagaaatgatacatgagtaaatgaacacagcttttccatgtttccttagttccttaccaagcgattagcaaaattcggtagtgtattacttagaagagtcttacgttttatacttctagaacagagaaggaaccatatgcacaatcaagagtttaccagctactttaaaaggtaattccttacttgctcatagacacctactccttcattccatttttttcttcaactttatatcacctcatacttatatataaatacattcatttcccttgcatatacccaataaaacctctttgccttcctatgaaaactgtgatttcttctattgaactagatttaaattaaaatatatgttgcataaaacaagggatgatttcattgtagcatttgtgccaagaaaaataatttgaatattttgttcattaagataaacctatgccttcaagttagtcattttatgattagaaataatagctattatcggaccattttggctaacctttttggaggctactaattattttcatttataacttctgagataaaaatatttctatttccactattgtaggactttgtcaagtggataaatctttaaaataaccgtgggcagagtgtatcattatcagctaacatgacagtatggaggcgttattcgcattgctaacaacacaagcagaaagggagaatggagaatttttttaaaaccattcttttaattttcttcatgatgaagttagaacatttaaaaactaataaagaggtgttctaagaaaattctgaaatgtgacaaaagttatatctaattataattatgacaaataacattaaaaagtcaccctgtttaaaagtatcaaaaaatctaacatctaatgtaagatttcattttcctaaatttaaaaatccttacatttatgagggcctaaatattttgtggccaatacattaaaaaatatctttaaatgaaacagctttaccataagttttagtgtggaatgattcctattaatgtcattcttggttgggtttcggggtgagaatgagctatgtgcctcatttcttaatgaacatttattgatgcaaatgaaaattatataaatattctgaaatgggaaaaggaatatttgttaaattcccaaatatatatttgctccttcaatttacaaatcatacctgattgattacccaactttggaatattttaaatttaatatcagccatttaaattttattgttattgataactagataatttttctgttgtcttaatgatgatgtatatgtttaatttctcaactgaaataatgtgggaaattacacaataaattgtgtcaattaaaaagagggaaatactggtaagtgtaagcattttaaatagagttatctttggctaatgtccaagggtaaatgcatatttctaattctttatagctttagtcaatgagcttaattttgaataactaaaaatgctagttactatggcatcatatttctttatatagtatctattttcatacaaagaaaagaaaaaagtttcaggttactttaagctgaggatgcccacagtttatgtcttagttgataatggatatgaattttcatattttattctgccacgtaaatctcaatgaagccctaagcccttctcatcctcacacaggtttcctttctgtgtatgaaaaagtaaatcattattaagtaatgcaatagatagccaaatcagacaggaactattacaaccaattttgttgttacatattttcaaaggaaacttctacaaggggtaaaaattgaatcttatacattgctattaacgggcctctaagtagaaggaagcatatatttactgcgtcataattttattatggtggcgctccaaaaatgaccaaaaggattcttaggataattgtagctatcaaatactgagctatgttatcttgtaacttgaggctgaagacaataagaaaaattcaggaaatgtatttttaacatatacatgcataaaattgttcaataaaaatggatatatgatgaatcatatccaagcaaaaaagttactttgaatcattgtctctactatatagtattcctaacttctccagacactactttgcaaaccagggataaagaataaaaaaaaaaggtaaactttgaagtgaattattgggatattattgtgaatcgtttttgctgcaggcagcatggcatgaaacagagcatacaaactgggaaaagtagaggagagatgaatttatggattatctggaacatatattccaaatcaattgttttctaagttatttcctgacatggttttgtaaatgcatttaaatcaatgaacaatattggagttttctggagtccttatatcaggtttctgattataaaagaatgtatactatattatttaataaaaagtatgtaattcatcaatatatttaaatacagaaattttaaactgtcctctaattgtgaagtcaaaactaagaagttacttgctattttaagtttgctagagaatgatactgtgcttttgagctcattaaaaataattaatatatatttatcagtcaaacacactgagattgattatcatcatgcaattcatatgctagaggctggagcctgtgtcttcaggccactacacatataaaaagccaaactgctcagccttgatacaagtgaagtgacttgatactctaaaaagaaacaccagcctcttgatggacaaaaatatgaaatgacaagagtaatttcaagtagctccaagtaaattaaccataatatttactaatagtatcatctttgctaataaggattagggcattaataaacactggaaaaataaaatgggcttcaaagttcacttgtgtaaattgatgaaggtcacaagaaatcaaaaaaggttagagataatattgttttaaaagcttaatatactagtcaggaagtaactgggaaattcattgaacatcttttggtttttagggtcattctttctgtaggaatatgcatatactataagtgaattatcacaattactaaaattagttgtctagtatacagacaaagttgttgcctaatattgtgtcattttttggaagcatcaatttcacaaacatatcttttttgtttgcttattttgtggtttacctttttttccaattcttattttggtaagtacaaatggtataaaatttgccatcttatctatttttaagtgtacagttcagtggtcttaaacacattaatgttgtgcatccatcaccaccatctgtctgcagaactcttttcatcttggaaaactgaaactctatcccattaaactaaatctctatcctcctgtccctgcagcacctggcaactggcattctcctttctgacattataattttggctacgctgagtacctcatataagtggaatcatgcatgatttgtcctgttgtgatctgtgtatttcacttcacttaatgtcatcaagattcgtccatgttgtagcatatgtcagaatatttcctctatttaagatggaatcgtatcctccattttacttatctttgctctaacgtttattatttccttccttcttctacctctgggttttgtctgtttgtcttgttacaggtccataagttgtatggagagactatcgatttgagatctttttttcttttaaattctaagtaaatgaaaatgaaatttcatttcagttattatacttcccagctccagattttccttttgattattttaaaatgtatctcaaaattttcttcttagcactgttttgctgcatcccataggttttggtttgttgcatttttgttttcttttgattctattttctagtttcccttatttctctttcgatcaattggttgtgtaagactatgtttttaaatttccattaatttgttcactttctagcttttcttctattatcgatttctaaattcatcctgttgtggttggagaagattttcttttatgacttccatttaaaaatatatatatattgggacttaggtctcatgtgcagttaagaagaatgggtattctattgttgttgggtatcatgttctttatatgtctgttagacctagttagcttattgtgtttcttctctttccttacttatcttctgtctggttgttctcttcattattaagaatgagatatcagtctctaactacttttatagaactgtctatcccttaaatactgttaatttttgcttcatgtatttgatgtctgttattaggtacatgaatgtttacatatcttcatgcagtgttgattctgttattaatacataatgtccttctttgtcacttgtaacctttttaaatttaatgtccatattttctgattttagtatagttactcctgatctcttttggttactatttgtatggaatatcttttttaaatctgtcattttcaacctatttctgtctttggatccaaagtgaatctttagtaaacagcatattgttggttgattttaaaagtccactctgccattcttttttttttttttaatttcagagcttaatctacttatgtttaaagtaattactgataaggaaaatcttctgtcattttgccatttttttctgcaagcattataaattttttgtcctgattttttgcattactgtcttctgtgtttaattgatttcttttgtagaaaaatatttgaattcccttcatatttccttttctgtgtatcctagagcttttttgtgtggttaccatggtaattacatttaacatcctcaagtcataacactctagtttgaatttaagccattttaacttcaataacaaaaaaaaaaaaaacctctgctccttggcagcttagtttccaccctgttcagtagttcagctgttgatgtaacaaaaacacattttatgtattatgtgtccaaaaatgtaaagtaataatttttcctaaagcattagtaccttaaattatgtggaaacaatatgtatagttataaaccaaagttacaataatgctaacattaaatttttcatgtatttatttttactgcagtctttattttttcatatacctttgagctaccatctagcatccttcattttaaactgcaagagtgttttttagcatttctttcagggccaatctagtggttataaactcagcttttgcttattttagaatttttttatttttctctaacttttgaaagataattttaccacatataggattcttggttgacatgttttttttttctagtagttatttaaatataatagtccattgccttctagactgcagtttctgatgagaaatctactgatagtctcattgaggttgcatattataaattacttttctatttatgatttccagattatttatttgcctttggcttcccacagtttgattaaaatgtgtctcagtgtgtgtatctttgagttcacaatatcgaattcattaaagttcttgaatgtttatattcctgtctttcctcaaattttggaaattttcagaaactatttaaatattttctctgcctctttcattttcttctccttcggagactactataatgtgtatattggtcttcatgattgtgttttatacctttagttttcactttcttcagtcattttttatttccatccctcagattcaataaattccattgtcctatatccaaatgcactgattctttttctgcctattcaaaactacctttcaaacagtataatgcatttttcatttcagttattatacttccctgttccagaccttccttttagttatttttaaaatactctatttatattttcattttgttcatacatatatatttcttacttcccctgtgccttccttcagttctttgagcatcttgaagacagttgttttaaagtcattttctagtagatctactatcaggactttctcaaggacaatttctgttggtttattaccttccactgaatggaacatactttactgtttcttcgtatgccttgtgatttttgtgttgaaaactgtatattttaatccaataatatggcaaatttggaactcatatttcactccttcacctggatatgctgcttttattttgatttggtttgttttgtttggaatgctgtaggctatctctatgccaaggattaggctgatgtgtaaacttaagggttgttttttttttttttttttttcagatcttttctgagcctgcatttctccctgggcattcctgaaaactttctaattttcccgtattttcaggtgctgtgaatgttttagtctttaatctctggttcacaaaaatgagaaaaagaaaaaattaagattaaaaaaaacctcacttgagctttatatactctggaagtcacttcagccaaagaaaatgctacttggaacaataagggggagatgtagcaagagtgggtgcctgcctttgtgtttgtccctccttgatcaaatacagcaattaatgatcagaacacacagccccaatgttagagaacagtgtccttactgcccaccctgcctcccatgagttgtatgaaaactgctctagtaacatgtgtacaactacctgccatagagtttgttagtgtgaaaggtggctgctgtcgagttaagaagtgatactaaccaaaatcttcttcagtttaccactaaagccttcccctagaagatacaagcctttatagcattctaaataagttacatgggaaagatttttgcttgtgtaattattgtctgagtgagaaaacttattattggtgcttcctactccactgtcttcccagaattctcttattttgagtttttaataatatttgaatttcaaagacttcctaataattccaaaggatataacactgggtaaaagtagaagtgggtcagcagactttttattgtaattatactttcatgagtcccataatataaaatttagacggtttaatccctcctctgaaatatatgtttcacttattattagaagatacacattatttttaatttaaagataatgactacatttactattttctgttcatttacaatccaagaacaaataaatatccatagcaacatagactctagaaaggtcctccatatgcgctactcaatgcatacttcttacttatttttgcctagactatatatattcataaagttttgttagctggacagtcacccaaacatatgagaattcatttaagacaaatctagaaaattaaaaaaaataccccctagagtgaaaaattgtatacagtgttggaataaaaatttttaattccttattaaagtaaatctcattctcttgcttggattgacatttgatcaattgatgttcaaattaaataagttgtttgcgtttctaaaacagacaacaagatatagttaaaatatatttagttccagttcctgcacttcaagaattaatgtagccctcttcaaagattatgaccttttctaaatgtactccttgtatcaccagaaattgagagctttcagcatgtggtactaccggtatcatcaaactgaaaaagcagaaatgctgtccttatcctttcctgatcattaaatgtcatcagtgataaagcttaagtgaagcagtttgttaagatggaggctgttggtactgctctgtagaatacaggaggtcagattccacagtgtcaaggaaaatcaagctaatggagcaatttaattaaaattaattgagtataattctgtctcttaagaatgagattgatgtagggttatttccagcttttttggcttaaggtgaaatgaatgtccatactttttaatgttatcttcctcaatcttttcctataatcatagttttaacaaataataatggtttatagaagttagaaatgtaaaagacctatgaggttatttaagctactatacactgtgattggatttttttattctctttatgtacctctcatacccatactgagtttagttcataatatagactctaagctgagaagtaatatatattgaggcatctattaatgcttcatttaaaacccatacccttaccttaaattttagtggaatcctgctgacaaacttgtgtgagccaactaggtagattttagttgagcaatctagattcctgcttctatcacaaaacagtttatacaagtcagcagaattggcatatatctgattaaatgtagtagagacagatgtagtacacctttagcatgacttacccatctgtcattgggatatgctgttctcttcataaaatcacttttactactccagaaagttaaatagctcacatttttgcttcctccactctgcttacttatgcataaatattatagtccccttgccaagtagtcagtatttataattaacatatttactagattgacaacattaagtataaacagatagacatggtggtgaccaaaagaggaatatattgggccttgttacttgggaaaagattttagcatggtagtatagcttgatagtatttggtcatcattaagagattaaaaatttctttcatgactttgtttcttcactcttgcgatgtcatttattgcatatattgatacggttttaaaaaattaaaatttacctctcctaaacattttctgcctttgaaaaagtcattgaaaaaatgttttgaatatatacaagaatgaaattaaagggcaaaaaaataagagttaaagttctattcatttttatattattagtctaggagagtggtacatttaattaaacatagaaacttaaagacattgaatacgacttctctgttgctactctatgccttataatactcactgccagacagggtaggtatgtaactactaacaaccctaaaatataacaaatacatcaactggaaagctttgtatattataaaattctgtcagcgtggtagggtacctgagcagcgatcctatggagagctgaaacagagtaactgcaggcagaagatatctttttaaaggaacttgctgataaaaagcttcaacagcatgacatatctctgacttgctgggaaacagcagctgacagagcaaaccaacatgtaacagttggtttcaggggtgaatatataggaccataaagcaaatgaaacttgtgaacagccgccagagttgcaaatcaaaagccattatacacctattccatgtggggccaactgttgaaactaatagcgccctttcctttagattttcttgaataaaggcagctatcaactagtgatcagaccataaggaatataattttacttatgatagagaaattatataccatttggaaattttatttaatctattatccctttcaattttgtattcaaaatcttatcgtaagccaagccaccttccaataacaattattaaatatctgagcttcaattgactatcatgatttcttgcattctaatcaactaaagagaacttccagatatattctgtactgtaggtaattgagctattcctcattatgccggccttgatttgcaaaggtgatgaaatatcttcacagttgatgaggaggctggttgcaccaaaacttgcaaaagtgttttcttcattctcgctactgtaaaataatgtgaataacataaaggactttactaggctgtatactgaaagaacaataaatcattagcaccacaggagagagttgtagtagcctttgattaatctataatctaccactattgcaatattctttgttaatggaattttcaattagaatattatttgaaacacaattcattttacatttattaaacgttccgcatactattatgttgtcattaggtagcatttagcaaactgatcattaaagcagcaaatttggaccacagatttgttatcatttttgggagcttgcagtggctttgggaacttttttttaaactgatttaatgataagattccatcatcttctttcacagttatttcatctcattattcctatttgtggatgaacacttggtaaggtatttactattttgagttcatttttatgcttatgaacattaggtaaacattggcttcatgatactacttactttataaggttttatgtaaattattaatacatatagagtaagatttcaattaacctcagctattttattattgctaacaataaatgtaaaatttcagtaaatgttaaaactactaatttaatatgtaacatatgtagagctacaaggtggcaggaaaagttctaaatgctttgcatatcttaattgtttgacttgcataatataagcattctttgaagtaggtagtattgttatttctacattacaaatgagaaaaccggggcttagagaggataagtagttggtccaaggtcagcttgaggtttggacctgagactgttcaacttcaaaatctgtcctgtcaattactgtactttaaaactctctgccagcagtattgaacaaaataggatattataaaatactcatttgtgacactgatgtttggaacccaaaatgtatatatcaaatataaaaaatgcatactaactgtattagtctgttctcacattgctataaagaactacctgaggctgcataatttatgaagaaaagagatttaattgactcatagttccacagactgtacaggaagcatggcttggaggcctcaggaaacttaaaatcatggtcgaaggtgaaagggaagcaaacatgtcttaccatggcagacaggagagaaagagctaagggggaagtgctatccacttaaacaatcagatctcatgaaaacttactcactatcatgagaacaacaagggggaaatcccatgatccaaacacctcccaccaagccccaccgccaacacttgggatcacaattcaacatgagattttggtggggacagagagccaaaccatatctctagccaatacccactctagattcaagccttgttagattcatattgtatcaaacatcatattatatgggaaactacattcaggcttccattttcagccttcattttttaaatcatgttactgaactggcagttgaaatagtgaccatctccaaatcctaccaagttccaaacagacagtttttcctcctttggcctttgacagaggattcaggagtcaagtataagaaataaggaatagatttttgtcagctgtggacccagaggagttaattgttggaagtgttgcgtaaaagtagtctagggaggcaaatgtacaatgtactggatagtgagaagcaaggagggttttgagagagaaaaagtgtccaaataggaagataatatattctttttccctttacctttgatctttataatgtagctctcctcccatgagtcatatcagttctcagatatttgaaaaataacttttgctaacaactgtaatatctttccagaacctttccttgaatgtatcaaatgctgtcagaccatatggtttcaggatactcttacatactgattgcttgaaactggttgttaaattgaggcttagaattagattaactattaaaaaatagcttaaccaacagtttgaaatacagtgagatttttattatttaaactttttaatattatatcataaaagattgaattcagttttttattgattttgtttttatcataggaaatttcaaacatattcaaatgagagagaatcgtatagtatatttccatgtgtccatcacccaccttcaaaaattatcattacatgtctgatcttgtttcacctatatccttattcatttctcacctgttcctttcttctgctcaagattattttgaagtaaactccagacatcttgttttcaacaaatatttaacatgtgtctctgacagtcatgaactttaaattttcagctctaataccattactacatctgaatttacaatcattccttaatatgaatacccaatgttaaaatacatgtaatagtctagtaatattttatgattaatatttttacagctttctccagtcttttactttcaacttatttgtacttctacatttaaagtgaatttctggtgtatagctaataatggggtcttgtcttttactcagtccaacagtttctaacttaataagagtgtttgctcagtccatttatatttaatgtacttattggcatggatgtatttagtctaacatattgccatttgttttccattttcccatctattcttcattacattttttcttcatttatttattcatacataatacatgtaaatatttagggggcacatgtttataatatgatacattgatataatcaagtcagggtaattaggatatctatcaccttaaatatttattgtttctttgtggcaggaatatttaattgttctctttgaactattttgaaatgtacaatgaaataatattaactatagtcatcctaccaatctatcaagcaccagttctcagttcttctactaagtgtgtatttaagcccattaaccacactttatcccccaattccccttactcttccaagtttctggaaccaccagtttactctcttatcttcgtaagatttacattttagctcccacaaataagtgagaacgtgcaatatgtgtctttgtgggattggcttatttaaattaatcaagtcttcttttttatttcttactgttttactatttgatttttaatgacatctagatagatgtgtgtatctttattttatatatatatatttgatggttactctagtgtttacaaaatttatctttcacttactatattcaatcttttggataaatataccacatcatctatgctataagactactgtagcagtgtattcccatttatgtctgtatgcactgttgtgcaattgtggacatccacttcatttctacatacgctattttttaaatacattgtgtgttttaaatattgagttgttgtttagataaatgaggaaacaacacttttaaaatttaataaaatatttaacatatcaaccatgctccttcatgaagatctgtgtttcttttaagttatttccctctacgcttaaggagtttttaaaatatttcttgtactgcatgtccgctaaggaaatattctgtttttttaggtgaaaccacttttattttcactgatttttttaaagatattttccctgcatatgaaattctaagacagatttactttatttctgtgttctttcagcatcttaaaattttgatctattgaattctggctggcattgttcctgataagaagacagttgacttttctgtccttgtgaaagtttgggaattgaacaatgagaacacttggacacagggtggggaacatcacacaccagggcctgtcatggggtggggaggaaggggggagggatagcattaggagatatacctaatgtgaatgacgagttaacgggtgcagcacaccaacatggcacatgtatacatttgtaacaaacctgcacattgtgcacatgtaccctagaacttaaagtataataaaaataaaaaataaataaaaaaagaaggcagttgacattccttttatttttcttctgtatataatacactgtttattacaagctactttatatttgatttttagtaatcttattgtgttgaattgagtgctttttcattggatttatcctgtttaaaatgaattgagtttcttaggccttcagttgatatttttcatcaaattaagtaaaaacaaaaatttagcattaactcttcaaatgtttttgaaccttattttctctctccttcctctaggacttcattacgagcatgtatgactgctttattgttccatggatctcaaagtctctgtttatttatgtatttatttttttcctttctatacttcagttcaatagattggtctgtcttcaagttcactcattctttattctctagtattcaatagctgttaagtccaccctatagctttcttaatttcagataatttatttttacagtttcaacttatatggtttttattttatctgatgaaattttcatctctttacccatttgtttatttattattactattttttattttagatggagtcttgctctgttgcccaggctggagtacagtggcacgatctcagctcactgcaacctccgcctcccaggttcaagcaattctctgcctcagcctcccaagtagctgggattacaggcacctaccaccatgcccagctaattttttgtatttttagtagagatggggtttcaccatcttggccaggctggtcttgaactcttgacctcgtgatccacccgcttcggcctcccaaagtccaaaagtgctaggattacaggcatgagccactgctcccggcctgtgtttattttttattgtaaattctcaaacatacatgtaatagctgttttattgatttttttcctattactttcaaaacctctggtcccctctgtatctgtttgtattgactattttctttttcttatggtcatatttttgcttcttcatatgtctagtatattttctttataatttatatcacacattgttggggccatgttggtgagcagccagacttatttcctccttttaaaatggttggattttgttctgacaagtagttaacttactggtccaacaacttgatcttttgaggcttggcttttactttgttagagcactattactatataactctgcttctaagtgtggcacttctagggtctgaatgcctggggtattcatcaaagattcctgactcaggttaatcagaactccactgttcctcagcactttggcttttggaatagctgtttggctcacagcctccagtagctcttgtctgtcatgcctatggtttctgactgaaattggccaacaattcaaaattcaaaaataatcactatccaaaaatttctcttcagaattttggagctttttctgtgactggttccctcctctctaatactctgtacattaaatttcagctgccacaggccacagggactccaaactccaatcactattcttcactattctctttgcccactaagaaacaccagtctctgtttgggctacaatttttttttttttttttgagacagagtcctgctctgtcacccaggctggagtgcagaggcacgatcttggctcactgcaagctccgcctcccagggtcatgcaattctcctgcttcagcctcccaagtagctgggactacaggggtccgccacgacgcctggctaattttgtttttgtatttttagtaaagacagggtttcaccatgttagctaggatggtttcgatctcctgaactcgtgatccacccgcctcagcctcccaaagtgctgggattacaggcgtgagctaccacgcctggcctgagctaccatttttttagtggtggtttggaagcgtccccaggtagaaagccaagctgaagtggaggtcacctaatatgtttaccttattgaaaaagaaaatacagccctacgctatatgttatttaatgcctgagaagagttttattttattgattatccattttcctaattattcatggaagaggggcgagttcgatactcaatattttgtcataaatataactagcactttttaaaatagttttttgtttgaatcagtatttaaatcagttcatatgttatgatgcattgtcgtgtcaagccccccccccccccttttttttttgtggttgtttttgttgttgagacagagtctcgctctgtcgcccaggctggagtgcagtggcgctatctcggctcactgcaagtccgcctcccgggttcatgcccttctcctgcctcagcctcccgagtagctgggactacaggtgcccaccacaacgcccggctaatttgttgtattttttagtaaagacggggtttcactgtgttagccaggatggtctcgatcttctgacctcatgatctgcctgcctcagcctcccaaagtgctgggattacaggcatgagccaccacgcccggctgagcctcttttaacctgtaaattctgtacgtttcttggcttttttatttgttggttttatttgtttctttgtatgtccttgaagttcactgttgattcatatggagcatggacttaatttaagctccaagacattgccatgtcctctgtaagataagatccccatattccctacatatttttcacaaaattttcattatacatttatgtataatgagatgttacattttcttaatagtaaagcaattcctcaaaaaaaaagtaccatgtgattcagcaatttcacttctggctatacagccaaaataagtgaaatcatggcctcaaatagatgcttatacacctgtgttcagagcagcactattctcaataaccaaaaggtggaagcaaccccagtgtcaatcagcagatgactggacaagcaaaatgtgctatatgcatataatgcaatattatccagcttaaaaagtgaggaaattctgacacatgctaaaatacgaattaatcttgaagacattatgctaaataaaaaaaaatcacagaaagacaaatattatatgtttctacttatatgaggtacctaaagtgtacaaattcatagagacaaaacagattggtggctgccaggggttgggaagagaggaggttggggaaataatgtttaatgtgtacagtttcagtaggggaagatggaacagttctgaagatggatggtggtgatgattacacacagtgtgaatgtacttaattccacaatgttgcacacttagaaatggattaaagagcaaattttaagttatatgtattttaccacataaaaaagagattaaaaaataatatagttcagtaggttcttggctagtaagttagacaaaagatcagaggaataagacaacttggcaggaaccttatgaaaaggattctgctactgaaatggttaaatttaataactcttaggtggtaagaaaatgaccctgtgtctatgtattaattcttattactggtatatccactggcctctttctcatttctccttgcatgtgaaaaaagtttttctaattcatgccccaaattgaactcttgatctcctttataaaacaccacaaaaagctgctcttgctgcattacattccgtctcagtgggtgacaactccatcattctgattgatcatgccaaaatgttggaggcattttccctttctctctcatgatatatccagtcgtacaagaaaatttacaggttctattttctattatccaggattagatcacttctaccctgttccaaagtgacttcctttctaggtggcaagcttttgtttgtttgtttaatagctttctacctgatttcattattttcttccttggtgaaaggctattttccctacatcatccagggaagttatgttacgtaaatcagatcatgctccttcactactgaaaattcatttgattccctttctacttttaatgaaatccagtcattccttagtcactccacccatgccacattgacctcattttattcaaataaaccaagtaccttaccaccttaggggctttgcactcattatgtcctgtcctataactgtttgccctcaaatatgagtttcatgactaatttgcttactttctactctctttagatctttattcaaattttacctttttaattaggtcttcactgaatattttttattgcgatttcctccccctgcgtatctatcagccttctctgctgtacttttcttagtaatatttatcagcatctcacatactatgttacttctgtgttttatttattggtattcccatattcaattataaattcgataagggcaggattttttctctgtttgatgtctaaaacaattcatagcatgtagtaaaccacccaacattttttaagttaaatgaataataacatacctttactttatgactaaggagtatgttaaaggcctaatgggtaaaattactatcgtagaagcaagaaatctcactcaaagtctgaagtaattcaatacgttagtcactggtgtctgctacttgggtatggaaagaagattagtgtgggtcatgtagcaccgtctattgcatttggaattagctctgcaagatcccatgtagttggtgttactttttttaaaataaattgatgagcaccttaaaaaaaaaaaccttagattcagggactaatactgataatgtatgctttgatgacagtattaaaaataaatgagttatcagagagtgtaagcatttatgaaacgtttgctatgtatcggatactctcctgggccctttagatatcattttcacatgctattttattcagttctaatcaatgcactacaaagtgtgtatttctattggcatattttcaaaagtgaaacttgaggattatagaataagaatcatttgtcaaatcccataaaatgagtaacttgtagagttggcataccttgtgacatctctccgactgcaaatagcttttttttttttttttaatcctcccagtatcttatagtagagaacatgtgtcccttggaaattaattaaatattagcagaaataaatgtgatcagttttaaatgtagcttcaattcctaaacatctattttcagaactcttctctgttaaaccatggaaggatctatttccttcttttcataagtctttggtcaagccttgaaaattaaaatcgttgtactgattcaaccagtatggtctttttaagttttattggatttttgtttgtctttagttcttttattttttgcagttttaatctgtgcacagagaacatctttctagcttgtaaatacacatcagacacaccctgctgtttcctagaagtctattccttgttgctgttaatagcagagcagcatttttttcttagtcaccatttcttcctgcatacagaaccattaccctctgtctacttctatcaccctgaaatcttccatcttacttttcagatgtttttcactatacctatttcaagaaatcaggtactaaaaataaataattattctctgatattcaacctatttttaacacctcaactatttatttttaatacctgatttcttgaaaaagcatattgttaaggaagtaaggtatcttcattaatatacatctttcacaactgaacaggttcatttttataaactagcacttgtttttcattttatactcaaatttatttagatctgttaattgcgtctgaatagtatgtgaaaactgtcatcattcagcttgggaaaaatattctcataatgaagttatttacagctatgtctgtcattagtgtcattagtaccactaatagaaaataagaaaattggaatggcaaaatttagacatataattgatttctttcttctgatacgtaattgcaagtgctaaaacttcctagatgttaaattgactgaaaaaaaaaaacatatcaaagaagcagatgtatgttgcagggatggagggttcactgtatttgatatttatatagctctgtgagtgactcaattcaactttcctggcttaggggaaaagggttaatgtttggcctgaccggtgagtcccaatgataagaggtcaggaagaactctttactggagttttagaaggtaatagaataatgaaggatgcagctatgagtctagcaaattgtgaatgtaaacagagggcattttagggaaatcatttagtgtaagtttttttaccatggtggatgcgatatgaaagaatagacacaagacaaattcgaatccaaaatttaccttaaatatatagctataacttacattaaagaacctaacaacttaattttaccattcacacatttaataagtgtacattcagaaatgtactcttcagtgaactgtaggaatacaaatgtgaatcaaattagtcaaggattaggccctgaaaattaaattgtgatcacatgttaagtgtgcacaaatatttaaacacaaagtagaaaatgatatatttttaaaagaggtctcccccaaaaacaagcagtaaaagaaagggggtaattttcatcagctgcggaagctttagggagaagtagcaactaaactgaatcttgaacagtttgataaaggcaactaagtagatgaacagcataaagaataatgaaaacaacagattcgttgttattttagaacaataatcacagggtcagagctgtagtcatggaagaatacatgacaagggagaacccttaggtaaagtcactaatgaaaatgcacagtttaatcccagacatgaggaatggcaagtgtacaaggcatatgcatttgcagcacaaagagaatcacaaaagaaaaatgagatttctgtcccagagatacttaggtggcaatttctgtgccagaattacttaggtgattggaaatgtaaagcatgaactcaaatctgaaggtaactgtccaagggtcaagagttactgattttgctaagaaaacaatatagaaagaaaaagaagattaaagtaattttcttaagaaatacctatatttaaagaataaaagaaatttgagaatgaagagaaattggaaacaatccaggagagaatagcaccacagaaacctttaaaaagaatttcaaataaaaggattattgatactgtacattaagattggttgcagcttacaaaagctacatattctatatatggatttatatgaggctatagaaaagataaaactacagggacagggaacacatcagtgattgccagcgactgtgggtgagggtaattgttgaagacaaagggaaagcataaggtgatttttgaattgatgaaactgttctttatcaatattgtgggtgtggatcatgaacctatgcactgttcaaaacccatagaactcattgttcaattcccacctatgagtgagaacatgtggtgtttggttttttgtccttgcgatagtttgctgagaatgatggtttctagcttcttccacgtccctacaaagggcatgaactcatcattttttatggctgcacaggaaggggaacattacacactggggcctattgtggggtggggagaagggggagggatagcattaagagatatacctaatgttaaatgatgagttaatgggtgcagcacaccaacatggcacatgtatacatatgtaacaaacctgcacattgtgcacatgtaccctagaacttaaagtataatttaaaaaaacccacggaattgtacacaagaaagagtgattttaccaattgtaaatttttctaaaaattaagtaacagaaaaagagaaaaacaatagagtcattggtttgttgatttaaaaatgtatattcagaatgtggaagatgaagggtatatggtaaagaaatggaagccatatgcattctgttttcaaaacgtttcccagttaagaagaaaaaaaaagaaggtagcttcaggacatacctcagttgattaaagaaaggttatttaaagagaggaaacttggagatgtcttttatagaggttaaaaaagaacatacatattcaaaggagagtaaataattaataaagaaaatctttgaggccattggaggtaacggaaagagagaaagagtctttttttttttaatatacttaaaagagggcaaaaggaatagagaatgaatatagatagaatcattttaagggatcatcacttcaacatgaatcttgttaaaagattgttcactggaatttgagatggaactatagcaaaatcttgtttagccaggtctaagacacctttcttattaatagagtccaaatattcaggtttcttaacctcccaaatgccctgccctcttatgagtcccaaagtgcaagtgttgattggtctaaaccaatggctctctgtatggtccgtagaccagcaacagcaccatcacctgggaatttggtaagcccagagatctgtgtttttaaaaagcctttgatgcgattttgatctacagtaagctttgagaactactggtctaagcctgaaagtatacttccatttcatatctttgtgattacacatgagtataccattcaaacccagccaaggaaaaaaactgggaagattgctgtttgttattggtgaacgatttctttctgagaagagacacccaggggcaatcagccttttctgcttttggattggtcatatgtggatgagatattaaaatcgcagggcacacacacacacacacacacacacacacacactcttcaccttggggaggaaacataaacataatagccgatatgttgcatatggtggaatgaaaacttggaaggcacctgggttattgaggacatccttatgtcactaaaatttagtaaacttaaaactgtctgtatctggtaaattactagtaagttaataaatgatctcattgattaggccactattaattgtggcatcttatgcttgtagccacaggcatcaaaactgatatgaaaaataacaaattggttctgttacattctccagcatcttccttcctttaaaaatattctagttaataggctaggtgcggtggctcacacctgtaatcccagcactttgggaggccaaggcgggcggatcacaaggtcaggggatcaagaccatcctggctaacacggtgaaaccttgcctctactaaaaataccaaaacttagctgggcgtggtggcgggcgcctgtagtcccagctactcgggaggctgaggcaggagaatctcgtgaatccagaaggcggagcttgcagtgagtggagatcgcgcccctgcactccagcctgggtgaaagagtgagactccatatcagaaaaaaaaaattgtagttaatagtataaattttgtatgcctttatcaataaatgttttaatcaacaaatatgagcatatcagcatcatctttgcctagacagaagtgcacaatctgaaaccagatatcaagatatttaccaagtcattattatcaagagaagtggtgtttttggcaaacttgagcagcctaattccacaaataccttaccattaggatttaatttgcctggaataaaaaagcaatataaaaagaaggaaaatgaggatgatgaagaaaatatacttacatttttataatccttgaataatgatgaatatgaatttcattatatagttatctttagtttttgtatatttaaattattttatattaaaaaaatacatcaaagcaaaacaaaaaagattaaaaataaaaggatagaaaaatacaaatgcatgaaaacaaatttagctattttattataagacaaatgtcatttaaagcaaaaataaattcagttacataataaaataatctttcttaatttttaaatatgtatacatatagaagcaatagttaaaacatatagaacaaatgttgatatgattataaggagaaatcaagaaatttgcatcactggaagatttttaacatatctctctttaaaaaatgatcaaaaacacaattaggctgtgattaacttagccaaaaatattacctcaaataaatagatttgtagagtataatgcaatcaatggataaaataaattcttttaaaataaatataaaaggtttagaaaatttgatgtactagcaagtaaataaagtagaataccattatgtaaattttaaaaatatgaaaaacaatcatatgtaatttatactatcatatataaaagtacaatattttgtgtgggaatgaaattttaatatctaatttcagaggtgggttatgtttgaagtgcttaaagtgcagagtgattatccttggttacacagggggccagtgggaaaaatagaggtaaaactcacatttgatttcttggatttttttttactattagttaaacataattttactataatggaaataaggttgtacagtgtaattttattacttcaatatacctacaattatttacagtaagtataaatttctgtaaatgagaatgtgacattctctttctcctctgcccctcatttcttgttctgtctttcctaacaagaacatcatgttaggattattttaaatttaatgggtctgtatttgtgaattacaatgatcaaattgtattacaaacaggcagatagtaattccaattatttgtatttagagaaaactttttcatgaacagagttaaaattatgagccaggatttaactactaatgtctgtgaacaagacatgtatattgccacacattacctgaaggtatttgtaaagcagttttatctactctaaagcaggtgacgtatataatgaagccaaggaaataaggataacataatgtttgtggttgtcagatgatttttagacttatgaaatatcccgaatcaagcattttatatttttaatacatatcagaagaaagttcttggatttatcttctgtgctaatttatattaagtcttgcagtattttatttagaatgatagtgtctgacatgaatgtcttcagctttctaattactactaatactctcaaagtgaatgtagttaaacccaattatatatctagttactgaaatatcaataataaaccatataatgcttacttatttcctttgttaactcgtaaatttattttactaaatcttactcgaggcagctattaaatagattaatgaataattgttaaaatttaatttttcaaatctaaatattttatcattatagaaatgttctacttacttttgtcatgtgtctactctgtgaaaacattgttctgaactgtatagtagctagagaggagagggattgagaaatcagttgtaaagatgcataagatagtcttgatgctcttaggaatttcccgtgcccaggtaagggagacaggtaaatacaagtgaaagatgctacaataaaaaatatagtagagaaatggggtttacttcctggaagaatcagggaaggatgaagtgacatttgtgctggaatcctgacagatgagtgagaactcatcaggaaaaagggaagtggcatattacagataagttaaaaaatagacaaaagttttagaaaacttaatctcatatgagttaacatgcctagaaatttaaatggatataatactttcatagtaatgaatttttaactatctgcacatattttcatagagttcactgattttattaaatgacagtacactcatatgatgtggataaatacaaatatatgaccatataattttaatatccaagatgttgccaaccctaaagaatgatgggagtgaggatgcagaattccctcagcttagaatctctcatctttatattctctacctgttctatcatcctgatttaggcagtccttggaactatagtctctattcaacacatttttgaaaatgctaatctattttcaaaacagtccaaccccttcagtaaagtgagtatgattttgtacaatatgccacaaaattttaagaaaatttgaatcacattttctttactctcagtttaacgttactttcagtgcttcttgctgcatcattggtatcttataattagaactaaataggtatgaaaaaaatcaatttacattctggagaaaaaagaagctgaatgactctctctgtaaagttttcctttcatcttgatgaagtcccttcattcattgcttaaagattaacagtaagattaacattgtaacccatttagttagctggagggaatttcattcctgcttaaattcaagcatttaaagcctcaaactacttaaaattaaattggccccatagagaaagcacatcaccatgagtattacttaaagatggtatcaaccttcaggaatatatcttaattggtaatgacaaaaaataaataataataaaattttaaatgctatttctgttatgtgggaattttctagttttttggatgttacaattaaatatccttgcttagtagacatttttatatatctccaatgttatcaaatgtcaggtctatcatgtatcaaaagcaatctcttgggttgtgttgccttgacaacaaatcttggtttcgttgttcttgttaagttgaattcttggattctgagaatttaataaaacgcttgctggattcaaatcagtgacctttctcagagctgtaaaaacaactgatcattcactaaaccattcatcaagttaagataaatatacctgttaatatttgtgttcctactcagtttggatacaagtcaaaataatttgataatattatttttattctttaaaattattttataagaattagtaatttatttaaaaaattagcaatgttatttctaagggatactaattgtgatatgaaagacaagtcctcttgtcaaagcattttgtattcagaaatgagtaaactactttaaattaaaaagtagatcacaggtttaatatctagagtttttcaaaaaatatgtgtttcagcaattttataaagtttgaacctgttaagctaggttttaaattatttgaatgttttttgaaatttccttctctgtcttgtcattataagttagattttgttccacttttatttatttcatgtaaggctgatatctcacaaacttcaaataagtcataaattaactacagcatcatttgcaaatcttccattttctggagttaccatgccttttgagatttaagcaaaattgaaccaaacattcattgatttttcacaagatacggatttttttgattttttttttttttcaggaaagaggcccgtgtacttgcaattgctcttctagtcatttcttgtgcaaacctgctctttttgaagcacaccaactcaatgaagatactgttgactataattcttaccagaaatatatatacacagataacctgtatatatatgtagatatatagattggaaatattgaagatttgattccataccaccacaataaagtaactattgcaataaagcaattcacacactgtttttagcttccaagtgaaaataacacttatgtttatgtgatactgtagtctattaagtgtgcactagcattgtgtccaaataaaatgtagatatattatttaaaaataccttattggggccgggcatggtggctcaagcctgtaatcccagcacttggggaggccgaggtgggcggatcatgaggtgaggagatcgagaccatcctggctaacacggtgaaaccccatctctactaaaaatacaaaaaattagctgggcgttgtggcccgcgcctataatcgcagctactcaggaggctgaggcagaagaatcacttgaacccaggaggcggagcttgcagtgagccaagattgcaccactgcactccagcctgggcgacaaagcaagactccctctcaaaaaaataaaacctttttgctaaaaaaaggctaatgatcatgtgaactttcagtaagtcagaatctttttgctgatggagggtcatgcctcgatgttgatggctgctgactgatcacagtggtggttgctgaaggttggggatgctgtggccatttttaaaaatgagatagccatgatgtttgccacattggttgacccttcttcttctttttttttttttttttttttttttttttgggatggagtttcgctctcgttgcccaggctggagcacagtggtgccatgttggctcactgcaacctccacctcctgggttcaagcgcttctcctgcctcagcctcctgagtagctgagatgacaggtgcctgccaccacgcccagctaattttgatttttttagtagtaacagggtttcactattttggccaggctggtctcgaactcccgacctcaggtgatctgccctcctcaacctcccaaagtgctgggattacaggtgtgagccaccacgcccggccaactcttctttcacaaaagatttctctgtagcgtataatgctgtctgatggaactttacccacagtaaacctttcaaaattacagtccttaaactctgcagctgctgtatcaactacatttatggaatattctaaattctttgttgtcatttaaacagtattcccaacatctttaccaaaaatagattccacatcaagaaaccattgtttcctttttttgtcactgaatgtagtggcaaaaatcacaattctgcaccaacctactcagtcacatctttagggttcacttctaattttacttctcttgctgtttccaccacatctgcagttacttcctacactgaagtcttaagcctcccaaagtcatccatgtggattggaataaacttcctccaaacttcttttaatgttgatattttgacctcttcccatgaactgttaacgttcttaatggtatctagaatggtgaaatctttctagaaggtttccagtgtattttgccaaggtctatcaaagaaatcaccatttatggcagttatagccttacaaagtgtatttattacataataagacttgaaagttgaaattactcttttgattcatgggctgcagaatgggtgttgtgttaaaaagtacacaaacaaggagatttacaaatcttgtacgtctctataagagttctagggtgatcaagaccagtatcaatgagcactaatattttgttgtatgagcactacatctcaacagtgggcctaaaatatttaataaaccattggtgaaaatagatgtgctgtcatccaggctttgttccatttataggcaaaatagatttagcataattcttaagagctaggattttcaaaatggtaaatgagctttgacaccaacttaaatttatgtttccccctaaaaaggaagtgagcctgtcctttgaagccaggcactgacttctcctctctagctatggaagtcctagatggcgtcttcttccaatataaggctgttttatctacatttagaatctgttatttaatgtagccaccttcatctatgatcttagctagctcttctaaatcaggggtccccaaccacggggccagttaggaactcgaccacacagcagaaggtgacttgcgagcaagcattaccatctgagcccagcctcctgtcacatcagcagcgtcattagattctcataaaagtttgaatcctgttgtgtgaactgcacatgcaaaggagctaggttaagcactccttatgagaatccaactaattcatgatgatcagaggtaaaacagtttcatttcgaaaccacccccacccccatctttagaaacattgtcttccaggaaaccagtccctggtgccaaaaatattgggggtggttgttctatacagataacttgctgcagcttctacaggagcatgtgctgtttcaccttgtaccttcattttatggagatagcttctttggctaaacttcatgaaccaacctctgttagcttccaacttttcttctgtagcttccttacctcactcagccttcacgtaattgaagagagttagggccttactctggattaggctttggcttaagggactgttgtaactggtttgatcttcagtgatgttccagatcactgaaactttctctacatcagccataaggcccttttactttcttactattcatatgtttactggagtcacccttaaaaaaatttttttaagcttttcctttgcattcacagcatgcttaatgggcacctgaggcctagttttggcctctctctgatttcaacatgacttcctttctaagctcaatcatttctagctttcaactgaaagtttaaaaaaaaaaaagaaaaaaagtatatgactcttcagttgaacacttagaggccgttgtaggcttatcaattggcctagtttccatactgttgtgtcctaagtgatagagaagtctgaggagagggagagagacatgggaacagttggtaagtggagctgtcaggacacaaacaacatttattgtctaagtttgctgtcttatatgagtgtcgtccaagttgccctaaaacaattacagtagtaacatcaagatcactgaacacagatcaccataacagatataaagcagtaaaaatttggaaatatctcaagagttaccaaaatgtgacacagtcatgaagtgatcacacactgttggaaaaatggtgccaatagatttgcttgacgcagggttgccaccacatttagtttgcaaaaaacaatatccgtggcatgcaataaagcaaagtgcaatcaaacaaattatacctgtatataaaaattcagtgatctatatcctgaaaactgaggcactttactgtattaagctatacaccccatgagaaattcaataaaaatgaatttatatttcttagtaccctcattttaacatgttcttaactggctttattcaattaaaaaaaaaaccaaccaaaaaccttagtttgttgatttagtcatattcttccaaatcatggagctaatacatagcttatttttatttttattgtgttttcagccttgtctggaaacaaaaatagttggaaggagagttagtttagaatgatgaaaagagagcaaaatacattccaaaaattttcaaataatttccaaatcattggactctaaattatcacctggccttattctcttctgcctgaaggaactagtcttcattatttcttcccattagggtggagataattagtgtcagcaaagtgaactatcaaccatatcccctccttattcttctaaggtctgattaattggtactgagaagaaatgatattttacttaaagtttttacaggatatttttattttatattttatatcgtatccaaaaattatggtactttgctgaaccttttcatacatttctttatatgtaactttgcaggcttttgctactttattatgaagagactccagaggaaacaaataacacaagcagataatcaatgagaattgaatgaagggactgtttacacattagtgggcaaggggaaccttagggccagcacagtgggagacttgactgtccctaaacttaaggagcaaaagccatgggatggaatctgaagggagcgatggcattggtcagatgtatgcaagcagagctaagtggttttgctcattgtgcggtatccagtaatcactgatactctctttgccctgtatcaatatatttcaaagaggatacactgacatattaaagtaaatgtaatatttcaaaatctctgggctggggcccaaaatcttactttaataatccacataaatgtgttttgcagaacaagaccatgtttggaaaacggcagtcatcctgggaaactttttattctaagctgtttttggttcccatcatcacacataccaatgccagagtcattattgctataaaagtatcactttccaaggttcctgagtttaccaccctcatgtacttatagggtttttataaccattatattttgaggcaaatagtatttgttcctcaacaaacacatttattatatagaattttatggaaatactgattctctgttttaatagtttaaaatcttttgtgagatgggaaaagaactgttgcttcattttattataatgaaaataacttagagacaaaaagccacccaaaatttcttttaacttgtaaatactggttactattccaattttaatatattagagccccctaccaacatttttgaagcaaaattaagctattgaaattaagattcctgtttctcccagtgaagttaaaaactaacaacatgtaagaaacaaattagacaaatgagtttcaaggatttgagtgtaaggaatgacttctgtttaagttctattttgttgggctttggaatatttctgctacaagtactacactgtagcaccttgtcattttaatatatgtcttactttgttatcaaaaaattaggcattataaaatatattttatcttttatatagtccatttcacagaatagccataatgttctttcaagtaaggattatgggaaattaaatgctcttatgtttaaaatagatatttatatcctctgtatcatttattaacttatcagaatcactttgcactttaagatccatctaagtatacttaataatatagctttttccatgcttttttaaagccttagtcaaaatatagtaacttagattttttaatatgttactacagttttaaaccagtattgggaatgctttgatattgtaatgtttacagtatatttggggtaaagtggtgagagaaattggaagatggaattttggtattttagaactagactgtgtggccaagcatatagaaatgcagaatgttgccagacacagtggctcacacctgtaatcccagcactttgggaggcagaggtgggtgaatcacttgaggtcaggagttccagaccagcctggccaacatggcgaaaccccatctctactaaaaatacaaaaattagccaggcatggtggtgcatgcctgtaatcctagctactcgggaggctggggcaagagaatatcttgagtcctgggggcagaggtggcagtgagctgagatcatgccattgtattccagcctgggcgatagagcgaaactgtctcaaaaaaaaaaaaagaaaagaaaagaaagaaatgcagaatgtggtgtagaaatatatacaatatattatatttaaaaatctatagtaatgcagttccttctttttctaaatttaaatctttccccctttatgcttatataatttttaatagacttcaaaatggaaacaacgttctagtaatctcaaatgtgaatgtagagaatttcatccagtgacctttcctgatttatatttctgtcgttcttgattttataaatcaacttgaaaataaaatttataaaatttcttaactgttaccccgaatcttagaactgtagtgatttctaaattaaaaatcctgtagacataaatattctcatgcactctatatatacatttcatttgtgcagttttgcatctgtttttccagttttccactttgttgggaaatggtttacatactaaaaataatgtttgaacaaaaatattttctcacgtaataacttgttactgctttgcagtttgtcacaaattttaccattcactcatttaatctttaacacagtactgtgagatgaacaggaaatgactatattcccatcttaagttagagaatactgagactcacagacatttagggactgaagttacaaattgagtggaattacatctaaaactcaggatttatagccgggccctgctggaccctaacagactcacaagaagagagaaaatggtgcttaacatatttttcaaatcaatttcatggaacttaaattatagttattaaatgcttactatgttaaaatactctgttaagtaaagcagttatataggatagattaaaatgtatgagaagataagaaaatatatgatattacacgttataaggacattgctaacctgtgtgaaaatatttttttaacagagagttgtgataataaccagaatttaggggttaagaaataagggagaggtaaggcctttgaagcagcagatgtggactatccttttgacagattgaggatttgtgtggggaggagatagtgaaggggatgaaagaatacaagcatacaaaacagcaacatacaaatgtgctatcttaaaactcgaaaagtgtaaaatgctaagctggacaaagctagactgaagaagaaaggccactttgcatttattatcggattgggaaaggagcaggaagcacctggttggaatccttgtgcttgtgaaaatggccttgttagaaaagggacatgacaagaggaaattaggaaagaaggtaaaggaacactgcagctcttccagggagctaattgaggtctcctgagcctgctccctaccaagctccaaaaggaagatgggagaaagccacctagagccacatccaccagaactatctggaagactaaagttttgtccttccatctgtgttcagcgctacagggctaaacaattagcagaactgagactggaccctggtgggctgcctctccagtctgtgtcctcaaccctataattttcatttctgttgagatcacatatattcagattataagtggagtattacttttgtaaattttttgaagggtggtttgataattagtttcattattttcaattttgctctgtgtatgtcttattaatctgactttttctcataaatgtaaacataagcacaagttgacatcttgctttggaactggtacagtcctgttcataaattcaaatagttaccaaaatatgtgaaacttgtgcatatcttattttaattggctactttcttaattcagaagtgaggttcctcagatgtatttcagtgatgctggaatttccagcaaagtctctcacgtctgtcaaacattcagtaaatcacctaatgtttataatttaccaaataatcagacctaatgcttaatatagctgactaaatgctttgatactctgcattctagtcattttatcagatttcattttgttttgttttttgggatggagtctcactctgtcacccaggctggagtgcagtggtgcaatctcggctcactgcaacccctacttcccggactcaagtgatcctcccaccttagccttcctagtagctgggaatacaggtgcacactaccacacctagctaatttttatatttttgtagagacagggtttcactatattgccccgtctggtctcgaactcctgggcttaagcgacacacctgcctcagcctcccaaagtgcttggattacaggtgtaagccaccgtgcctggccagatattttaaattttaaaatttaaaaataagatttagagaactcatttaattttagttttttttatatctcctctttttattcttcttattctttcttattgcagtaaaatagaaacacaacaaaaggaatacaatgataccgtaaaccgtaagaaaactattcattccttaccagaatgaaaatgaaagaaattcatattttatctgaataatttttacaatgcttgcaaatttaccagaacaactgtaaagagttccaaaatttaacttaactcaatgaactagttatgggagatttagtgtgtgataatgtgaaaaaaaaataaaagataaagtagcatctgaggaacaaatgctaatatcttagatttggatagcatactgccattgtctatactgtatctattactttttgttttgtaatctcctcttttcctatgttcattggaaatgaccagtgccactagcttacttttctttcacgtaaaatattacattaggggaactggcttgctattatcctgccatttacccagaaggacagatgtctcaaatagttcgtgaattaaaaaaatacgaatcaaaaaaatctgaaatcataccctgtaagtttgataagccttacttttcagatgatttagtgtacgatatattaaacaatttattttttatttgaaatctatatcttgcacagataaaaattcagacatgatggggcaggtcctagcctaaatgaaatacatatgcttcactaaataatactgtttttgttattagttctaagacttgttagttaatttatagtatatgttcaggaaaaagtacataaaatttaacatagattttaaagtggatttctttccgtcttttaaagaaatcaattttccttttcttctcttgatataaaccccattacagtctaagataaggacaccagatactgccctagtttcaacttatttcagagccttggagcataatatggggaataataagacacagagcattatttgtgctttctaatctgttcagactattttaaataagcataaatcagatattcacatgttaatatgttgaagggtaaaacgcgaatatatatcattgcttaaataggcttaatgctgtatacataaattttcatcaaatcttgctcccaaatatttctattttaattttgacaggagttaattttccttttatttgttaactcccagataatttactgtaattacatataattgacttagtaaatatatagttgcctgagtttttgaagaaagacaaaaatcttttatcccaaccaaactatattcatgctaaagtcacccaaatttgagccagaatcgtatatccatattgctgtgaacaaccgcagaacactaattacaataaatctaatctacccatttgcaatgacactttagattagaaaggctgtagagaggggtatgatttaagagtgaaaaaatatttccaaaattaagtaagagtttagacctgtaattgaaagagacattaatgtgtgtgtcataatagatgataggatattctactactgtgaagctgagcctcttgttaccttgcagcagggtacaacaataaaaaatctttgattttatttgacattcttctaatagactccacacttctaaacatgaacaaggaatttcatatagctgattcagcagcacatggaatattcattttctctaaagccttgtacctttctctcaatgacccttgtgaaatgaattttagtgtttgtgtgcacttcctacatttgaacgcttacagtggcatgagccttaaatgagcaagcttttaaatatttgtttataacacatatatcctccttgccagtttattttcagctttgtcttccactgaactttacttttcctgtttctgatcctggctgcttatatcttggctaagagtaaatgtcttgttgtcttaatgaccatggaaggctttttggagtaggtggagtttgcaaaaccccttacataacagaggaaatgaagcggaggctgttcctgatgataccttcatacaagcaaaagtccaatgtacaaaagtacaaggggttaacactaaacacctaacacatttattcaagctaagggtttgagtagaaaattgagtagggttataacaagaattggttttgattcttaattgcaaaagactctgcacagcaaactatgtagtttgaattttaccctttaggggccagggaaaattaagaagagataactggcatgaccaaagcaacagggtccaaatactaactgggagtcttttgtagtaatatcagcctatgttgtggtagtgcccgtgagataaagggatatatgtgagcttttttgacagaaaagtcaatacaaatagccataggtaaggatagtcttacaatttggaaaggcaaaaaaatagaaaaaaagactaagtaaaataatgcgaattgtgagtataggtatctgggaaacagcacactcttaattgatatagagaagtcagagacaggttgggttgaaggatgatgaggtcaggttgcaccatttgaaacaaaaccatcaatggagtgtatcaggaagaaattaaaatataaactgagatagcatgagagaagtctaaggtgaaaaaatattggaaaaattaaaacagaggtaggtagttgagtctttttttgttgtttgccattttaatttttgataaggagttgtacaacatcaattaaatacatcaactcattctgaaaaaagttactgtgtaaagaaatgcatagtaacaaacctcagcttcctgaagttggagctattgtgcacgacagagataacaactgtgtgactttgcttagtttggttgtctttctgtctaaatgctgcctaagatccttggcttggcatatgtgacaagcagagtaacgagtgccataataaatgaaattaatgttctgatttcagcaatggtttaggttctgttcataatcacatattatcattttcacagaaatggtaaagaagtaaagtccactaaagcagctctcttgatctgaatggaaaacttatttgttgtaaaagtgtttataatctctctctctttctgtctgccctacctaaaatgggggtaatgatgttacctgtttcagtcactgacatgtcactattaataacccactagaaaataagaaaaaaattaataaaaatagtaaataaactactggattataatatagctggagggtcatattatgacttaactgtatataatatatgctctttatggatttctaatctaatttttatacttttagaaatgtccatcttattttagtatttctgatatagaagctgatcttgcctttaaaaaaaaaagaatggaaaagtagaaatacaaagaagcttctttgaaataattcataaatatattattttaaaaataagacaattgcctattttaaaatgtctctgaagtggcaagtgaaaatgtagaaattgctaaaatatgattaaaaagagaagtgtttcttatattcatcataagccatgtgtatctattaaaagacaaaaagtgaatattgtcccgacgcaaaattgcattaacaaaaactacgtacagaatatagaaaaacttaatatcataaaattgctcattcagtactgacaacacatattttgtggttcattcggaccctgatatttttttcttctcaaccagttgttttcttattttgcacaactgaaattcactatttttcttttctattactgttttattatagcctcaaagcactttataaataagaaaaaaaacagtaatttcatggttattagacattccaaaatgttctatctaaaaaatagttatcagctacattaatactgccaaactgttgaaaccaatttctgtgtattctttgctctaagttatttagcttgaaggatgttgggtgagttgctggatcagactggccagttggattcatttctcactgggaaaggaaataaactgataatgctataatgatattaattttaaatattccagtacatttccctagtgagtgcaaaagggcagttaaaagctcaattttgaggacagataggcctattagtcttgcatctgccatttaaatagctgaatgatgtttggcatgcctgttgtaacctctctaagtctctactgctcagatgtgattaaatgaggtacatttgaaaaataggacagagtaatgatcattaaatggcagatatttctcaaagggaggctttatcactgaccacaattttttactatagagttagatgctttcattagtaaacttctcttgttttgaaaataattttcgttgctgttgtatagctgaataacatgagcacaaaatcaagcacaatttttatctattttatctgtagaagcatgcatggctaagaaacctctactcatctttatatatgttttataagacaatgacttctgtcttcagtgttctctttcttctgtaagtcctggaagaccctcattattatattgccatattatcttctcagatttataaaattctgttatttttggattaataaaagcccttttagatctgatttacaaaaatctgtgttatatgaatacacacatgattttgttaagtatacttgtaaatataatcaaacacaatgtaaatgtatctattaaaatatagatgtctttaatgtgtactttaagataaagcaaaattacttaatttttcaacaagttttctgttggtaataagccaggacctgaggtttttggtgactatcaggtcttttagtgtaaaaaataatacatggaaaaaaatacttgaagcatccacaaatcgaaactcagctgggttaggagttttcctctcaacagacaagtcttgggaaagtggtctgtctcaggaaatattctggtctgttattttctcacaatttttatacactctcctttgataacgatatattgaagcaacccaatgtatgcattcataggtctctccttgtcatttggctaggtcataggttgagaaacattggtatcattgattgctcacaattctcatctttaaccatgctgaaacttctactaccagacacctaaaatatctcatatattctaagactatcctaggggtacaatggacacaagagatttgtcttgagaagattgcctaaatcatagggggaaatgtgcatagtaggcattttaaaacctaattctcctttcccttagtttttccgttaatttatttccacttgttcacttattcattaatttactcaaaatgagtaagcacctactaggtacaaatatggaagtctagaccagggaagacacgggtttaaggaatattttatggatgcggatgaggcatcatttgaatttcatagtatagttaacaaaaacatacatttcaggctgggcgcggtggctcacgcctgtaatcccagcactttgggagaccgaggtgggtgaatcacgaggtcaggagatggagaccatccttgttaacacagtgaaaccccgtctctgctacaaatacaaaaaattagccgggcgaggtggcaggcgcctgtagtcccagctacgcgggaggctgagaggcaggagaatggcgtgaacccgggaggtggagcttgcagtgagcagagactgtgccactgcactccagcctgggcgacagagcgagactccatctcaaaaaaaaaaaaaaaaagacacatacattacagatagaagggttgaacaaaataaaatcagtagtgagcaaccttactgtgtgtaaatgctttaacatttaccagatttaaccttggggaggtgaattaaccttccttatcgtagactttctcatctatgaaatgaagataatctcatagggttgttgtgagaattaaatgagataattcgtagtactttttagctttgtgtctaatgcataataaaaacctaatattttttagcccttaaatcgttcctagaactctactaacccttggtatgattatccaagcactttcactccaaagttttcaattttaatcactgcaaatatgttaacttgtattgtgtatacaagtgacatgtttaagcaaaatgatgctaatataataaaaattttaaaatgagacaaagtactcatagtgttaagctctccaatattgtgtttgtattggcaatggttagaaatgaattatagaccacaggaaaatctaggtaactcaaagcagttgaataattcaaatgtttagccacgatgataaggaagaacttttatttgttttaaaagtgttctatctacgatgtgtgatgttaacatttccaccgacaaatgaaacaagtttgtcaataaatatattaggaaataccatataaagaataaaaaaagccctctttaataaagccaggacatattttcttgcctcaattatatagcactatcaaatcaaaaattagacttttggcatatgatttctgacaattccatgtttcctcctaggtaacactgcaatattgttaatctacatggaaaccctgcattaaaatttttggttagggcgacctcggggcataatctaacctctgagcaacctatgctaagactaaaccagtttaagcaaattattatacatatactgacccaataatttgatcaacagaataagttaccctaggataacagcgcaatcctattctagagtccatattgacaatagggtttacaacctcgatgttggatcaggacatcctaatggtgtagctgctatcaagggtttgtttgttcaatgattaaagtcctacatgatctgagttcagaccggagcaatccaggtcagtttctatctattttatttttctcccagtatgaaaggacgagagaaacagggcccacttcataaagcgccctcgccctatagatgatattatcttaagctaacaaatcacctcatatcttacccaaaagtagggtttgttaaggtggcagaagcccggtaattgcataaaatgtaaaactttataatcagaggttcaatgaatcttcttaacaacatgcctataatcaacctcctactacttatatctactctggctgccgtaacattccctacactcattgaatgaaaaattctaggctacatacaactatgcaaaggatccaatattttaggcccctatggactatttcaaccatttgctgatgcaataaaacttttcactaaagagaccctaaaaccctcatcatctactgttaccctttacactattgctccaaccctagccctttctattgcccttttcttatgaaccccactgcctaaaccaaatcccttaattttaatttcagcctcctatttattcatagtatactatactattatatagtttagcattattatatattaatattattgtataatggtatacaataatattcacagtatactgtgaatttatttttttaatgtatcaccataatacctttttgggtattataggtaggtcactagcttgtaattcccaagtacttttttatgtgccttctacaaattggtaagaaggagtcttttctagtcatctaaaattcaagtactctcccataagtgcttatctataaaatagtaatggctgtgaaagttcatctcccagttctttagcactctcaggtggatggtttttcaactgacctacaaccattaagcttgcttaagtagtccccaactatttggtctctgtttgaattgccatggctgtgcattcaccagtttgaaaaaattaccatatatgaatagaattaagcttagcaaggaagactgccttgtagaacaatcaaggtggaaataactattttatatatgaaagttcaatgacaaatgatacatagaagaaaaacatggtaataaataaatgtaatctgaatacgagaaagacatatatctattttgtgcttaacagtgcctgtgacaatgacatggagcctgcccctgcaaatcaaggcccagatttaggaccactgttgaaagcaaggttttggaaattggaaagagttcaaagggaaagaacataaaatagttattatttaaaaatactgactttaaagaaacctaagatatatgaactattagggctttagagaaggttcagtttatgatgaaggaactgcctttaaagaacttttttaatgtccttgtgacctcctagaagagaatgggctttggagacagtgaacctctttaaaatagcacttctgcatttattagctgtgtgatcctgtgtatatttccaagtctctaagactcttcattaataaaatgaggaaaaacattatatatatatatatatatatatatataaaatcatgagactcctgtaaaattaatgtatgtaaattactttgtatattgcctagcacatgatgcattccattaattgatagctattggtattaaataacaataattgagagctatttctacagaatatattaactggttacattcttctaattgcatcaaacaaataatttactcaaactgggcttctagcacttttacttttgtatatatctattggtagagaaatggaaacaaaaataaaagacaatgatactctgaccattcaccattcaatgcctgaaaattgagagcccaactctcattaaatacttcgtagatgtttgcagaattaaaaataagagaattggccgggcgcagttgctcacgcctgtgaatcccagcacttttggaggccaaggcggatagatcacgaggtcaggagatcgacaccatcctggctaacacggtaaaaccccgtctctacttaaaaaatacaaaaaattagctgggcgtcgcggcgggcgcctgtagtcccagctactcaggaggttgaggcaggagaatggcatgaatccgggaggcggagcttgcagtgagccgagatcgcgccactgcactccagcctgggcgacagagcaagactccatctcaaaatgataataatagaattatatgacttgtatgatctgagatagatgaatttaaggaagaatttggtattgagagatttaattcattacttccctagttgttatgggttgttttgagttattaccccacattaatcatttgtcattttgttttgttaaaatgagaacacattttctgtacatgttgcatgaaaaaaggcaagggaaccacatatctccattgactgcatactcaagtctatccattattttacataacagatagatgaaaggaaacattttttaaatatttgtctttaaaattatcatagaatggataacagtgattgtatagatgatggagacctttctttacgtgtagaattgcttgggcacagcacagtccacactggaagatttcttttctccccaatcaatcaatcaatctctctctctctctctctctttctctctctctctctctctctccctccctctctccctctctgcccctccctccctccctccctctctggggccctccccttccctcttttctccctgccttctttctccccacctcttcaactgcattggtaacgtgataagagcagaaatgacaagtggctattagattcacttgtatataaattctaagtgtcacctatttctatatcttaattattctataaaatgctatccagtttttgtaagcatttcaaggtaataagtgcaaagtaccttggacataggggatagtctttaatatttcctcttttttctttactttggatgaatgttaccagacagtaataacattttaagttcttcaggaaaacagcaaggcctatgcagttatatgaaagataagagaatatacctgtaataagagtattttctaataacattaactttttatatttaatattgctctgaatttattattctaaaccaaaagaaaaaaatccatcaaataatcttgaaaagaagcagctaatataatctatttctgacacttattctattcatttttatcaatacttgcatatcaccagacttacaataaagaacattcatgtaattattctttcgacatttatttattgagaacatactacacgccaggcattgttgaaagtgcttaagaaatatgagtggacaaaggagacctgcactgaagaaacatattcaggcagaaaaagttaccttttgacactctggggcatactcccttaactagtgtttgttggcttccttttgaagtttaaagtatcagaattgtactctgtagaagcttgttgaatgttagaaataaaaagaaaaccggactggactaggaaaagtcaatgccacttttattgtcctacctacactctggttgctcaggggaatttaatttgcctatttcataatgcctctttcttgcaactgccttcagctattacattttcaatcagcttatttctacccagcagaagcagtctggaagaggttgcctcaaagttggtttttctattgtatgtattagaatgctgtcagtaacttattatagtatcttattggatggtctttgtcctgctgtatcaccttcccagcagaggtacagataatgaaaatctatatggctaggaccttggatttgggcagttcaattagttgttcaggaagtctatcaaaaatgtgactccaggtccctgaactccagcattctcattattagagtgaaacgttagtgacaaatgaggtatgatggtctagacacctcatcagcctgctggcttgcagcctgaagtaaaggcgcagttttaaaaacatcaaggtcttgatgggttctgaacatgtgattccagaccaaaacctaagaaaaacgggggagcatcatacgttttaagacaataataaactcataggcctctgaaattctacagtcaagagtcaaagctacgtatgcacttgaagatgtggaaagatgttacagttcaagatgagatttcttattggctatagttgtaaatatcagggttattctaaaaaaagattgtcaacggtttaatgatactagaaaagctcacctatttttaaagttttttatttaagcagtgattaataaatactgatgtttgttattttaataaatgtcatgtgtatggagaggtatcatcaagtaaagtttgtactaatctatatgaaatccatatggatatccatatccaaatgtatgagtcacacatatattatctacagatgtggataaccactcaaatagtggttatccatgggaatgatgctgtcctctaggggtgttttggttatatgtggggtaaattttggttatcacaatgtggagggtgctattagtgtttagtgggcagagatagtagaatacatgcaaaataaagaattgttctgcctccaggaaaaattcctgtttcagagctcaataggaaaacctgtttgattatcagaacctagacccaaattctatcttacatgtaaatataaacccagcatacatttggtgtggtttaaatacagattaaattcagattaaattctctataattacaactactgtctaaagtgaaataaaatgatgctttattttgtctgaaagtttgccaacagtgttgtaccattttaaagaactatattactaattccagtcatcatttttagtcaccaattcgacatactatatcatttttatagccatcacattcatggtgattatacatttacaaacataggaccacttaattttacacagaattaaaaatctaaatacttacgctagaattactttcctcttaattcttctgtaaatgttagatagggagttatattgattttttaaaaaatcagctaagttacatgtctataagctgaatctcaaatagtaaaaggaaaataaaaagtacattataaaaagaatctgagtcttctgaaatttgaaattattgatttacatatatgggaggtctggctttttgactatagagccaagcacaaatgctgtatccaaacggtgggcacatttctttggtagaaatatatagattctgaaaacactcttgacacattcagacctataaatggatagcaaaattttgacataaagatctgaaaataaattctaaagttggcataatagattctcttcaagcagttcaaatacaaatatattaaatgcctcattatgcaagacaccttgataaatgcttggatgacaaagacaaatatgaaataattcactcctctagagagttgatattctagtgggagagacagaaaaatatctaaagaatgctaatgcaatgttaacgtggaaagatttattttatacagttctataaaagaatgaaagaggcatttgagaggaagcctggtatgagatgtagcttttgagctatgctatggcgtatgttgtagagtgcctaaaatattgtgcgaaaataacattgcaaggaaagagacaaaaataaaataccattttaaacaagaaaataacagcaagaaaacttttctcagatggttctgtgtttgaaggaagttcgactgtgttgtaacagaaaacatttgatggtccctgatgggtttcttggaagaatagagtgatgaattctgtgagagaaagaaaaatcagaattattctgcagaattaaaaaaccaacgaacaaacttaatttggagttccaagggaattcctagagagaatgaatgagggaatgagaaccaatggaggaaggtaggtagatgtgatcttggttttggcaatggtgagagacagagaaggctatggaagtaaaacagaggaaagttaagagataatggaattgggaagaaaggtgcccatgaaaatgtagtattctaggagtccacatagtccagggaagcactggacttcccacagtttaagcgaagggaatgaaggcagttttacttaaattttaaaggaaagaataattccaaaggtggagaattaaaaatatccagcaagtcagaatagttattaccttgcaaactccaaaccaattcaagtttctcccatcaatcagtcacagactaatgctttctaaaaataaaaaatcatgtacctcagtgtcacagcaatgcaactgcttcaatttctgtcgttatttcctgggggatggtaatactgtatttacagaccagtactggttcatgagttaaggttttggtagcaccgctctggaattgggcagcatgggtttgtatcttagctcccacacattattgtggacctgggaaaaacacttaacctctctgtcacttatttatctcatctgcaataaaaattgtgtctaatttttttggaaatgtgacagattatcaccatattggtattggttcttcatttttatttagtaataaaatttctgattttcagttgaatacttggaataatccctacttttctcagacatgtttgtagcgaatgtcttttaagaggaccagccagactaacatggtgaaatcccgtttctactaaacgcaaaaaattagccaggcatggtggtgcatgcctgtaatcgcagctacttggtaggctgacacaggagtatccaggcggcggaggttgcagtgagctgagatcacaccattgcagtctagcctcggcaacaagagtgaaactccgtctctaaataaataaataaagggggaaatattttgtgtatctgaattgtgccctccaggatagaatgtgatgtttggtgcttcttgggccaggaaatagaactcacaggctgagagttggtggatcagcaaaatagaaggagcctgagtcctgtacatcatgggccattataccagccctggagtgtccacttttacgtttcttataagctagagaaaaaacaaattatcttattaacattcttttgaattttctctcacatacagattaagcaatgcccaacttatcaatgaataagttagaaaatatgtgtaaaccaatacttgactcatagaagacattcactaaaatttaatagtaattattaaataagtaggttgaaaaagtcatctatttgttaagtaaatatttaataacaacattctgcctgccactgtgctttatactggtgatacgaagatgattaagataaatcagctgcatataaaaagttcttgtctcaaaattacagtgtaatgatacgctattcgcagtttgttgcaatttttcaaatgatctacaaagtggagagttaagagaaaaactaggaacgtttgtgtctggcaagtaatgtccttactgaaatttgccattgtgaggttcctcaaaatagtgtagagaaaaaaaaaaaaaaaaaatatatatatatatatatatgtaatttgatcattctccatatatttgcttctgaattagaggggaagtggcaaaatataagagttaaattttatggaaattgtattaagtcttttccttaagacataagcttagcaagatgccattttgtctgactgtagagtgataacgaatcaggttagagtgaacctgatctaacgttacaaaggtcaaatatatttcctttctcagattcagagttggatcaagactacagatgtatctattagatttcttgatgcctattctcaaacatctgagcaaaatttaaggtctccaaaaagtactattattctaatagaattttcagtatatgtaacaggttgtctttttccaactgcagtttggaaaaatacaaatttgattatctaaaatttgaaagtaaattaattttaatttaaattgctctaatatttttatatgtttgacatacagtttatattacttgttttattagttttaaatgaacatcattacttttattaaaatttgcctttgataggaaaaaaaactgttcttttcttgatgccataccaattatcaagtgtttattgttttgatagatttccagccacttcaatgtgcaactgatatggacaaaactttttgtgtatgttatttaatattttatttgtaattgctaaaagagaagaaaatagtaagtactaaataaacaatttttagataaatgaaataattaaaaacttgaatcttattttgattatttatagtttgtgggtgcatttaaagataaccaaagtcttataattcatttagcagcttgagttataagcagtggctccatcaggtatattttccaatgtgctatgtatgtaatttttcttctatcagataaactaaaagcaaacgtaagaggaatgctctcaacttttgccaggccctctcttagcttttgtgccatgtcctggtgacgactacacttgaaatccctgggctactgtacttctgtgctatccttattgagagaatggctttcgtatgtttgaagccaatgttttattactctttatttccttgatacacccttgatatcttttgttcttctagactcacattccaaggttacctctaggttttcaatatgatattcatttgagaagacagaaagcatacagactgtaagtaaataagagtaaccttattatggacataatatttactctcacacccaaacacaataatttgtaaacttccataataaacttatattactattaataataaattgcttgcaacttaaataaccatgatgaaaaaactagcattcagattcagtgttttttttttaattattaatctaaagtattaaggataaagaataaaccttataggaccggttatttattatttataaatcttatctataaattttaattttccctggaggttaaaaaatcagaatactatttagtggtaatcccactattaaagtatttatttctaagttaatgtaacttatactttgtactatttttttaaaaaatgctatttggggttgattgcataggtacaaattattccaaaagtaaaattttaaaatgaagtatgtattcagaccctttagagacatgctaatggcaattcattccttactgcttattaaagtaagcctgctaagcagacctacttattagttgaatgtgttttaactgggtcctctccccagagtttcataggctgaaatcaacatctcatctcactgcagtccgacctgggggcttgactaagaaaatatttactttaggatattagcagaatccatttctttgtgaaagtagaactgaagtccccagtttttgttggttgtcaaccaagagctactgtctgcttctaaaggccactctcaggctttgccttgtggtcccatccatttctgcaatagagtaactgtttcctcaaatccttctcacacttcaaacatctgtattctgctaccagctggagaaaactatgcttttaaagagttcatgtaggcctgatggggtgactcacgcctgtaatccaagcactttgggaagtcaagacaggaggatcacttgagcccaggagtttgagaacagcctgggcaacatagtaaaactctgtctttacaaaaaatacaaaaattagccaggcctggtggcagacacctgtagtctcagctactcaggaagcttaggcaggaggatcacttgaacccagaaggttgaggctgcagtgagctatgatcctgccactgcattccagtttgggtaacagagagaaaccctgtctttgaaaaaataaaaatgaaataaagagttcatgtggttttgttaagtcaatccagatgatgtctttatcttaagttcaactgattcatagtccatctgcaaatactcttttcttataaggtaacatagttatagaagtaacattgagaggagagtgatcatgacggccgtattagaatttagtctaccatactaatctgatcaacacgaaaaattaattcataaagtatataagagtttctctgagtaaattgtattttacaaaattcctttcttttaaatatgctaaaaaaatgagttattcatattgctaattggtatatgtattttgtatttacaatcggttattttttatgttaatctttgaaggtatttcatttagctatgttctacattattatttttaatattaaggtatttatactttagtgaacaattttttaaaaaattagttttatttttccaataaattaaactgggatgctgtgttggtattattatttctaagagtttgcacttgtatcacattagcacttttaccagttgatgccatagcaacactccaagttgctatttattatgctgtatattaacaattatggtttctaattatagcgaaattccagtagatcagcattcccctacttccatatatagtatatagaatattaaatcttgaaatatacttatggctatattaggaagaatgggtgttttttatttaccaatacatctttcaaataatacattacagaatttgctaatattgctatagtttgcaggattctcttatttaatatgttaatatgttaaatgaaatatgcaaatgtcataatggattgaatttaggtaatcattaatatttctgtgttacacatttctttaggtaaatgtatacaaatagattatttagcttcacatgaattaccatcaataattcccttgaatattaaaaataaatgttaatatttgagatctagctactgtatgtaactcaggggtaactcagggatagaggaatgttgaaagttcaaacccagagtcaaattattgatgatattttggatttgcatttgacttgactttttcttttttcttttttttttttattatactttaagttttagggtacatgtgcacaacgtgcagattagttacatatgtatacatgtgccatgttggtgtgctgcacccactaactcatcatttaacattaggtatatctccaaatgctatccctccccgctccccccaccccacaacaggccccggtatgtgatgttcataggtgggaattgaacaatgacttgactttttctaacaagatttggtagtgttttcacatctttcttttgtgtactttttaacacataaaatgacaaaataagagctaaaatattctaacttaccggaatatagtaaacttatgttagtaataggaaaaaataagagaatggccaatatttcagtacttttttagacttgttctctctctgagtgggttatataaccaagaataaaatttaaaaaaattagttaacatagacagtttacatatatttacatatacatatacatatatatatatatatatatatatatatatatatatatatattaccaaaattaggtcttggatagtgttttcatgctggattagtctgttttcatgctgctgataaagacatacttgacactgggcaatttgcaaaagaaagaggtttaatggacctacagctccatgtggctggggaggcctcacaattatggcagaaggtgaaaggcacatttcatgtgatggcagacaagtgaagaaagtttgtgctaaaaattccccttttataaaaccatcagatctcatgagacttattcactatcatgaaattagcacaggaaagacctgcccccatgatacaattacctcccaccaggtccctcccataacacttaggaattatgggagttacaattcaagatgagatttgggtggggacacagccaaaccatatcattctaccccttgcccctcccaaatctcatgtcttcacatttcaaaaccaatcatgccttcccaacagtcccccaaagtcttaacacattataatattaactcaaaagtccacagtccaacatctcatctgagacaaagcaagtcccttccacctatcagcctgtaatatcaaaagtaaattagttacttcctagatacaatggaggtacaggcattgggtaaatagagccatttgaaatgggagaaatgggccaaaacaaaggggctagaggccccatgtacgtccaaaatccagtgaggcagtcaacttttaaagctccaaaattatctcctttgactccatgtctcacatccaggtcacgctgatgcaagaagtgggttcccacagtcttgggggctgccacctctgtgtcttcacatggtacagcctccctctcaggtgttttcacaggctggcgtttagtgactgcagcttttccaggcacattatgcaagctgtcagtggtctaccattctggggtctggagaatggtagccctcttctcacagctccactaggcagtgccccagtggggactctgtgtgggggcttcaaccccacatttcccttccccactgccctagtagaggttctctatgagagccttatgcctgccacaaacttctgcctagacatctaggcatttccatacatcctctgaaatctaggcaaaggttcccaaacctcagttcttgacttctatgcacccacaggctcaatgccacatggaggctgccaaggcttggggcttgcaccctctaaagccacaagccacagcttgagctggaccttggtcccttttaatcacagctggagtggctaggacacagggcaccaagtccctagagcacacagcagagggatcctgggcccagcccgtgaaaccatttttttctcctagctctccctgcctgtgatgggaggagctgctgcaaaggtctctgacatgccctggaggcattttccccattgtcttggcgattaacatttggctcctagttacttatgcacacttctgcagccaacttgaatttctcctcagaaaatgggattttcttttctatcatattgtcaggttgcgaattttccaaacttttatgctctctttcccttatgacattgaatgcctttaatagcacccaagtcgcctcttttgctgtgctgcttagaaatttcttccaccagataccctaaatcatctctctcaaagttccacacatttctaggacaggggcaaaatgccatcagtctgtctgcttaaaacataacaagagccaccttttctccattttccaacaagttcttcatgtctgtctgagaccaccttagcctggatttcattgtccatatcattatcagcattttggtcaaagccattcaacacgactttagggaattccaaacactcccacattttcctgccttcttctgagccctccaaacggttctaacttctgcctgtcacccagttccaaagtcgcttccacattttcaggtgtcttttcagcagcaccccacccctgctatcaatttactgtattattcctttttacactgctgataaagacatacccaagactgggcaatttacaaaaaaaaagaggtttaatggacttacagttccacatggctgaggaggccttacaatcatggtggaagaagatgaaaggtacatctcacgtggtggcagacgagtgaagagagcgagtgcagggaaactacccttttataaaaccatcagatctgagatttattcactatcacaagaatagcatggaaaaaaactggcccagtgattcacatacgtatcactaggtccctcccacaacacgtggaaattgtaggagtaagatgagatttgtatggggacacagccaaaccatatcagatagcctactaaaatatcagtaagttgaattttaactataatcaaacaattgacttttactgatatggagtggatattgagaaagaaatgcatttatgaagaaactgctatagaatgaaaaaatttaatggttttctacttgagatgttttctgtcattagacatctgagcagaatcaaatgactcctttataaaaatcttcatttattccctattaatgtggcaaacacatgtaaatgacatagtcattagcaaggatgagtaggtcataaatctgcattttcacattagtgggttgagtcacatttgaattcactaaatgaatacaacacattttctttcacgagtcaaaattccaataatagattttaagattgtttcatgaaagttagatccttccattgctttcttctatcttgccctttgactttctgcaaagactttcattttttagccaatttcctcagtgaaaagaacaaaacagaggaagttttgagctttgacatgctcatgatatcattagcaggaatactgtgcattaatgcaaagctgtctggccctgtagtggtcatgtcccctgccttaaaaggctttgagatgttgtaattatgaattaaggcatagaacagtaaatttggatagtacgttgtaaaggaaaactgaaggctttggtgatataagaccctcacttcccctaatctcttgttattcaatgaagaatgatcattttgatggtcttttattactacaatctaatataaatgaaggcttgttcagctgtctgtgttttatgtactgcttcccacagcactgggacccttccatattatttgacattacagcatcacatagggagttgccttagtggtttgctctcctgaggaaatcctattatacgctttgagtcagttcatccatgattgcctgggagaaaatcatttgtgttgttgaaatgtattcacttaaatgtttaaaatctgggagtcctggagatttttcattgaggaaaaataattttacatcttgtgttatattttgattttcgattctgacctgatatcagcaaagcaatctaaatatctccagagcaaaagtggaagtgaggagatgacaagaatcataaatattctactatttttgtggtaaatagctccatgacttagttcctaaattcaaaactcctcaaaggatgctgccccattgcagcattggtacccagcacaatgtctggagtgcaatgaccacttaatacgcagttgttgaatgcatggcaatgtgaatgaggggagggtaaagagaggcagaggcagaacaacaacctatctccattcttctttatggacacttgaaaatgccctgagaaaatcttacgtacttttctgacctgagactatcataaggcaatacttccaaggtatatgtaaagctagaaggaaaacagcctcttcatgctcccaagggccacttgtatttcaaaggcaagaataaaccttaatagccagaaattcttggcaacagtgccaaagaaatgttaagcaataatgacagaaaattagttatcttacattctacaggtaggtttgtagagtacaacaggctgacaggtgcctgtcaagaaaatgatgtttgacgagctataaagcatatttaatatgctaacccatttagttaaagcaccatatggaccttgatgatttgtttaactttgttcagttaatatatgttaaagtaaacacagtatgtctatacttaaatgaagcacacattttttgagtaatgtaataaatgtattttggatcaaatgtgttcacttaaagtcacagatgtaactgcattaaaaagaatatgcagttgtcattaaaacaaaatgtattttcttgttcaatgaattgaactacaagaaaatagtgttttattgaataaccactaatcaagcaaattgacttctaatatggcacaattcattcattcacatacttccagagtgttgctgccatgctccagaattacacttgttttccaaaaagcaaaatatcccaatgtttctatgtgacaaatgacatagataatttacaaaatattaaatacaatgaatgattgttttaacattaaatttttatagagaaatataaggatcccatttttcatacaaaattatagtatatttactaaatttatgtttgtctaaaaatatatattactcatttgtagaaaacctgtgagaaaatttgttacagtatgcatggcagtataaattgaaaagattttaatcacatgtgtaatcaaccttaaatgtgcccacaaatacaatctcataaggaaaaatttgagactattttgcaagaaaatattccccaaatcaggaaaaaattatatagtttagataactctataatagcaaatgtgaagaaacataggaaaaagctgagaaatgacctaaatatccaaaaatattggaaaatttgaagaaattatgaactgtgtacttgtttacatggtgttttgccagtaaaagggtaattatggaaatacagaaaactccttttgcttcagctgtaaattttaaaagatacaaaattttaaatatagtttatttatagatgcacacatttattatataaaagtatatatttttaaaaatttcaggccaggaatggtggctaatgcctataatcccaatttgggaggctgaggcaggacgattatttgaggccaggagctcaagaccagcttaggcaacatagagagaccccgtctctgcaatttttttttaaacagctagacatgatgttgcatgcctgtagccatagatgatcaggaggctcaggcaggaagattgcttgaacccaggtgattgaggctgcaatgagccatgatagcaccactgcccttcagcctaggcaacagagtaagaccctgtccaaaaaaaaaaaaaaaaaaaaaagccagaatactcttaagtgataagatagtggaaacaggaataatcttttactctctttattatttattatcttctgaacttaaagaatttttattaaagattaaaatctacaaaacaaacaatttattgcaatcttacttttttaaatctctttcacttaggataaattttgtgacccagtttcttgatgaaaatatcaaaagacagatttttttttttttaagatggagtctcgctctgtcacccaggttgcagtacagaggcacaatctcagctcacttcaacctctgccttcggggttcaaactattctcctgtctcagccacccaagtatctgggattgcaggtgcccaccaccatgcctagctaattttttgtattttagtagagacaggatttcatcatgttgggtaagttggtctcgaactcctgaactgagatgatccactcgcctcagtctcccaaagtgctgggattacaggcatgagtcactgtgcctggccaaaagacaggttcttaacaggactacttatgaagttataaaacacttttaacaaatgctataaccatatgtttatagaaagcatatttgtccatttatctctaatggttccttgtacggtgattttcttgtaaatattaaatgctacaatggtttaattaatgatcgttactctttcatcctcatctttatttgaaggtacattatgtttagaccaaaacattaaaaaacaacattgcttaatagcaactatttcaaaatttcaaaagaacagaaagttgacaaatgctactaaaaggtagagaaatgctactaaaaggtagaaaaatgtggttggatctatgaacttgcatgagccagaggagtaatgcagataaggtttctaaacaaagaggacgtcaaagatgttgatctagagaaatggtacaaatgagaactacaggggggagaatagggggaagaaaagatgacgaagtaaaataggacatgtaattcaagaagtgaaggctcttaatgtatgtttgtagagaactttcagtcttttgatcagagaatgagccaattcttgaagtagcatattttcctctaaggatgttctaagtcaaggatactagcaatagataggtgttctgcttcttctcctagtaagataatacggttttattatttaaggattttccaccttagaataattttcttagctataaaaaatggcaagtattatgatgaattaagtgataacataaatacatatattaagaattgattcttcagctttcaaattcatattactaaggttttgcatgtactgtctccagaacatttcataggatgttcatatttctttttaagtcaaattatattttactgtacattaattttcagcattttttttaagaacaaaagatgttctggacatctttccaagcatcctaataggataaaagaaaattacacaggtaaaattgagaaaaattatttgaattttcacttcactatgtgtgcaatttatccttagtctaaattgatgaggtggtctacagttttcttttaaaatatgtgattgttacagtaattctttaaaatacgtttggtagactatttaaaacattaagaaattcatactcagatgagttaaatggattcagaaattcagccaaatactacctttgggaataaagctcagggatttcagaatcctggtattgtacactaattaaaaaaagctctttgcgagactccatctcaaataaataaataaataaataataaaactcttgtcctataagcaaatatattgatttgtctataccatgtgattattaacaaagttgtgtatctttaaatatgcagaaacattacaatttaggatcaatataaaaggaactgaaaaaatatctctttataataacctaatatatatggaaaatatatgatatgtactacttttttcagaaccatcttctgagtacaagccatcactattcaaaaattgatgatggcaactaccctctgggtatatacccataaacattggcagcagggacttgaacagatatttgtacacttgtgttcatagcagcattatttacaatagacaaaacatgtaaatagcccaaatgttaattgacacaaaaatgaacaaacaaaatgtggtataaatataatggaatattcttgagccttaagaaggaagaccattctgacacatcatactgcagtataaatgaatcttacagttattatgctaagtgaaataagtcagtgacaaaaggacaaatattgtatgattctactatatgagacacctagactagtcaaatttatagagacacgaggtaaaatggtagttgccaagggttcagggtgggacaaatgggaagttagtgttcaatggacagagaatttcagtttggaaagatgaaggaataagctctggagaaagaggctgttataaaatgtgaatatgcttaatgtcactaagctgtacacctaaaagtggttaaaatgggaaattttatgtatattttattttaccacaataaaaagttggtgaaaacatcaatgtgattagtacatgaatccaaataaatcattggtggtattaactacatgaaatttcagttttctgaatttattctctaaatttgttgtaatttataaataaagcatagtgaaacaatagggaaaataatatattattctaaataagaaataactgaatgaaatttagcaaatactatctagaaagtatcataagatagcaagagaaaagtactaaaaagacagtacttttcaaaccatctaaatcaactatataaggagtagacagaattatagcattaaaaaatgccaataaaaggatcttatccaattgaaaattatagcatgtcctctgtaagaatacctttttctgtaaatattttgtggctgcctcttctttcctaaaataaactcttagaaattttcagaaggaacatctttgtggaagtagaaaagttaagctttaacatcaagagcagaaggctaaagaactggatgacatttatgccctaaactatatggtgaacacatttaatgccacaagtcatctttgttcctaaaatgaaataaacatatcattgaccagcaggatagagtcaagaatttgaaggtctaatacaaactgggttgaatccttgtatctctatcacctgcaggtcagaacctaagaaaattatttaaacctgagaggactcccagaatgaaaggtggtagcctgagtgatcaaaagattcatagagatactcagcaaccaaaatggtttctggacagtggactggcaatggctaaatcagatgcagtgtagtccgtgagagacatcagagggggactggtggatgagtagaagctggtagtgaatgaagaaggcatctctggatttgggaagaatgccactgaaagcatggatactgatggccagccatcatggagtgcatgctacaaacactttagaagagtatgaggcaaggagaaaagctcatactggaacgtgaggcagcaccaatcatttcagcagagcccagagaaaagcagagtgggagccttacctcatgttctttctctgaaccaagaaaaaaaataaaatgccctagaatttatcttactcctgagaatgaggaaaaggggaacgggtggggtggcaatccagaatataactgaacatttaaccaaaagaaactattgtgtactggaggtaattaaagaaacatgacaaggggaaagagaaaaagaagatattaactaagtgtggcccagttaacaagaaataaggaaagtttcaatttagtataccagagacttatgactgtttacatattaaatctgctatacccatctgggaaccactcctttagatgacgccaagtgactctattaatttggaaaaataacaccctagaatttagtgtctgctggggttagagaagtgggatgatttgctcaaagaaacataagattatttagagaaaagtccctagcttccagatccaataccctttcccaattgtaacataatgacctgttgatgattatgattagttcttattgaacatttataataataatagaaaaggatctcaaactttaggctgtatattcaaatcctaaatcttttgtgaattgttaaagtaactattaaaaacaatcattaaagacaaagatgtttgttgccccagtgagaaagactttcagaaataagtcaaacaacttgtagctctgcatgtgtacttttttttttgaggttgattttataatatgaataatggataaggccttagtgattgacccccaaatatcttcatttattaaaacatgaaacaaaaggaaagcttagtggacaaccacattgttgtaattattttagaaacatggcctttgaacaatcagagtatgacatgagtattgattaaattggaatttaagatgttgtcttaaagtagtgctgatttgaagtgcttttactttcagaaaaatttcaataaattactttgtatagcttgcaccagccacactttaagacgttggtaatgaacagttaaaatttgtccatctgtcaaactgtgtttgatgacagtatatgttgtaagagttgtgtaatgtatcagcatttgaacaagaataatgaacaaaaaaaggtagttttctttgaatcattacttaaatatctatcttgcctacagctcagaaacttgacagaaatatgtcttttttcatgaaacttaaaatcacctttcctgtctttaatatctaatcaatctgtactttgaggcattaggtagttacttctttattttaaaaagaagcattagcctttcagaattgctgtttcttgcagaattacagtctattatgataaaattgttcatataatgaagaatggccaggatgtagccactttccctggttctgctaatataagaaataggagagatggctcaaagccttctacagactttgatttaggactaatcccttaaaaatcattatggcctcatgcctctcacattacaacaaagtcggctacttctcttcctattacctcttgtttgtaaatatgattaaatgagcatattcaaaatagctattaaaatcataattattcaaaatgatttttttcgtattaaatgttcatagggactttttcttttttccactgtgaattagatatattattaattccaaactaagctcactgcattttagtcagatagcaaaaatctgtatcaatatacaggagggtttatcaattaaaattaatttgacaccctaatggtacatggtactataagacattctttttaaagtagtcttacaaatcatgagaagatggcctcaatgatattcaaaaaggcggtaccttctgctgccaacataagataaattcatgcagtcatacagtgtctatgtgttaagagcagcctggtctgagaataaaatatttccatgccacaaatctctttcaccaccactttcccatccttcagcgtccactccccactcaccaccatagttagaagcatcactgttacaactctgcagatcctgaatacgcctaggttagcatactgcagctctatcatgttcatctcactcttattctaggactgagtaacattttaaaactatttttaaaaaaagttgcacttggagtctgaaatcaaaatctatgctccttaaatgcacatggggactagatttatagcatccaccacgtgaactaaccaaatgtaaaattgtatgactattgtactttttctgtgcaggtatttctttgactatagtcatgtaatagacaaaagcacaaatgtggtgtctacttctaccactattaactgtaacaccttgaacaagttacttaacctcatgtgcctcaattttcttatttctaaaataagggtaataatgatacctgaaatcaaggaatgctgtgaagaatacataaactaatatgcacgaagtatttagagtaattaaaacaataagtaccatggaaatactagctctcattaagaattcatgattctagaatgaaattttaaaataagttatagaatttgaagaacaaagttttaaattccaatttgctttgttaaaattgcacataactctatatatcctaggtagacatgattgacagtagccaagagtgaaccacaactattaccaccgtttattaagaataaggagttagggggctgggcgcggtggttcatgtctgtaatcccagcattttaggaggccgagaggggtggatcacttgaggctgggagttcgagacaactctgggcaacatggcgaaaccccgtctctaccaaaaatatgaaaattagcccagtgtgttggcacatgcctgtaatcctagctacttgggaggctgagacacaagaatcacttgaactgggaggtggagggaggttgcagtgagctgagattgcgccactatactccagccttggtgacagagcaacactgtctcagaataagggaataaggagttagaagtctaagtaagttggataaattggagagtctaacatccttattatttcagttttcacaaaggggctatggagaatagttgcacataattctaaatttacaatggaacaagttggattaaactgtaaatattaactactatatctaggtatctacttgaagtctcattcagttaaaagcagaacatctgataatttttaccttactgaaaactctgcttttcagaaagttgagtaagggcttcattttagatcttattttgtcaaggaagcgtcagtttgtaaaatggaagtgacaggaatcttgggagatgttcgtatcgtctaaggtgccataaagccaaggaaataaatgctttgtagagtctaatatattccctagattttaagaaaatcttctgaacaaagtgagttcatgacaaagatagctgtgctcaaatgctgaaagctttaaaaaatgaaagttttattatagcctcacagatttcctaatgagaaagcaaacatacatctaataaattaatgcagttatatagagataaagctttctgttgggcttagcttttatagcagaacatataaaaagcggaagtaagcacaaaatgaagaataaattgtaagaaaactgagagaaactctaaaacatggaaaaaggcataggtgaaaatattgagtacaacataaattgtgctttatattatgcatgttctagaaaaacaaggcaaagttaagtttattgcttgaatcatagatgagagagaaaagagatctactcatcttgtattttacttccattttgcctgtttaccaggaactaagaaatggaataaatatggataagagttgaaattaaaatttaagataggagagggacaaatgggatttaaattaaacaacctttagtttcttctctcaaatatattctcttctacagattataaaatcctatgtgcaggcattaagtttattacaccagccttaccacaaacacataagtaatgcattgtactgtagtgttgccgcagctgcaacgtcactcagactataggaatttttcagcttcattataatcttttgggacttctgtcatatatatagtcttttgttaactgaaactttgttatgtggtgcaccactatacatgaaagtagctgcttttttaattggtataaaagaaatgcaaccttaaaaattcttttgttatgcattgtaatatacagaaagtagtgatgaaatatttgaaaattatcttaccataaaatatttcttattttgaagctgtagtgaaaaaatatatatgctggtttcagttaaacaaaattaatttttataatcacaaagcagtttgtgaaaacaagcagattgagtcagatagcccatcttttgataaagttactaaagcagttaatccatatcgattaagctgaaaggactcaggttaaaaatcaattctatgtaccagaacattggttcggctccagcgaaataatttggtgctcctgtctagaatcactgagtattgattcttcagaatcagactatgaagttgcaactttgattccccagagattttacaggaaaaaaaatggtcatcataaattagacttgagagttgttctgatgcattgagggaaaaaatgaaagaaattagcatcacctttggtaactaagggtttctttcctttctgtaggaaaacataggcttcaaatctcaaataacattctcagttatctagttatctaataacatatcttagttatcaaatatttatctgaatttctctccaattaaagcttattccctatgtatttgtatatacagacattcagtcaactaatgtttatcatgtacttactaaatgtgaagtcatagcccttttaaacaaaagtaaaaaaagttcgtatacaataaaaagacttaatttacaaaatggtgttttaaagtgtttctgggtttctttgctaacagaataaatctcaatataaatttataaatttatgcaaaaacattttctgttaagaaaacaaatcaaaccaaaagaattctctaggaatagaaaggctactactttatgcaagttgtaacactcacttcaagtcaaccaaattttgaccctcaaatcataagtatattactattttggttaagggcctgccaggattttcttcatcccagtttgctgatatcctttgggttggttatcctctagtaagtatgtgttatatacttatatgcacatcaataatgtatataccatatatttgtgttgtatatgttacagtagtgacacattaatgatattgtgatgtgtgtacttggcaattataacaatttatacaaattgctatgtgaacatagatgaaaacacaatatagattacaacttggactggagcaggtaattgatggaggagagaagagaagctatcatttataaaatgcaccaagcacagttctttgcattcattctcctgttgatttgacaaagcaatttatgattactagtatctccattttatggatgaaaaaaactgatactcactgatccatatgaacccagagctatatggttctaagtccccttccaatatacggctttgcaaatttggggtttagcgtttaaatttaattaagcttatgagcaaagcatgcagaagtagggaaatttagaacatgttcaagaaatagaattttcttggtttaatttgtgattaagagacaggggagggaatggagtggtgagaccaggaagacaagttggaacagatcatgtaaatccttagatggaaaactgagaaaggaatgtattttactggtagtgagagtcattgaatattttgcttgagggtataatgtgattgaacctcttataattttctacttccctacataactcatttccttctcttttactcttctgttgctagtaacaaattaccccaaatgttacagctgaaaacaacaaatatttattatatcacaattgctgtgggtcagaaacccagaaacaacttatctgggtaagtctgattcaaagtcttttaagaaggtgcagtcaagtggtttcatctgaaggtttcacagggcatgtgggaaattggagatctacttgtaagctcgctcaagtgattgttgacaatcctcagtccttcaccacgtgggtcttccatggggctgtctcagacccaggtagctgacttagtataaggaatataaaagagaatgagaccaagtcaaagagcacatgaagacaaaatccacagtctttcagtaaactactcttggaagtaacactccatctctttgctgtattctgtttgtaagaagtgaatcaataagtccagcccaaactcaagtggaaggcactgcacagacttgtgaacacccatagctgtatgattccaagtccaagaaaacaaagcaagcagagaaatagcctcttactctttggagcttatcataatgttgaaacagaaatatgaggaatgataatatgggttatcatttatgccacgtgaagatgagcatacaaagatatttgttagctctactgttgctaaactcaccttaagtcctttgagacaaaaaagaattacatagaactctagtttatatttcctattaaaggtttttatttttatttttgtttttattccatagtgcttaggataatatacacctcaactaggtattcattctataatgcaacaggcagtgattgttggggggttttcttaggggctgcctaccatgctacctctggccttgcttatattattcacctagagttattcaaattcagtaaaaatatttcagtgactacctttctcaatgatctatctctgacatgttaaactatatttttttgacctccagaaataaaagcaaaaagaaaaacaataaaccattggcttcaccatgcacttggacacatcattttgtttctttggtaagatctaggacatctactccacttgtgtcctcagaacactgagcaaagtgctaaatataatatatacccaatataactatattggcaatagaaaattaattgaaatcatttttggagtattacctgtgtatgttcaccacccttacttttagtttttatttttgattttgattgataattttttgaatactgcttgagtggctcaaataacatttcaaagtcacttctatgggataagaagcatgttttgctttgttttggcatttcctgaagcatttcttgtactgtttaatgcgctaaagcgtaaggattttagaagttcagaattttcagaaattctatgcaattttttgcatttttaaaactcatttgaccagcagaccctttgggaaaatgttagctgacttcatacatcatggggaaaaaatgtaagctagtttacctgctaatcagtatgagaccaaaacagtgattcaccttcaaatgtgatctgagttttttgtagccagagagtccttgaagtattgcaaaaatttaacaaaacagtaaaaaaaaatcctctttatagtagaatttcatgccattgttttgggtttcccatgtactaaaacctcaaaattggtaacaacaacaacaagaaaacaaagcaagcaaagagaaagcctcttactcttaagagcttatattgctgaaatgtagaaatataatgaggaattataatatgtgttatcatttatgccacatgaagatgaacataaaaagatatttcttagctcttgtattagttgctaaactctctttgagtcctttaagacaaaataattatatcacatagaactccagtttatatttcttattaaagatttttctttttatttatttttcctttctttccatagcacttgggataatatactcctcaacaatgtttgcattctataataccccatattgtctattgattataagcataaaccactacatagaaaaggtagaaagcaaaactgtcacagcaatggtgatctcagctatttttaaaggaagcttcgtttttttctctccacaggaaaagttgttttgacacccacccactgaacagtaaaataaagctgcattgattttgttttccccaccaggaatggcatgttactggattcatcttccacttagattaggcacacaaaaattaatgaattttaacagagctaaattcagcttcattttgtagccattttctttatgtatttacaatatgatctcaaacttgtataaatcatttgctttgaaatatatttaaagccatttttactcagtccatgctaagtgagtaaaggtttgcatctagaagagatgtcaggatattttagtgattagactaaaacaagcccaaagtaataataacatggcatctttcaccagaacagaagaaaatgttccccgattctttattgatgtttgtataatactgaggtgccaatagagataagccttggttttggctggtgcaagcgaataagcaatcagttaaatcagagcacaaagctgttaattcaaatctttgcagaagatagtaaattattcagaaatctaactcatctatctatcaaaaattgcactgagtaaaaaggtgggtttgaatactaatatattatacaaaaatagaattacagcatttaaatcattgaatgcagtgaaaattggatgagatgtggcatgcaagtaaataaaatactaatttccaactttaggaattataatttatgtggtggtttaagctttcaggtgatgtgtaattggatgtcttagctttactctgagaaaaagttccaattaaaaggaaaaccatctattgtttacatttaatacaactttgagggtttaaaagctcttcatcattatagaatttagagactaaataatgtacttagactctagctaattttagacaataagtgatttttttttttctttctttctttcttttcttttcaaaagcaagaccagcaactttgggaaaacctactgtcgggtaattgccatatggcaaaaaccatgattacttttgtaccaaggcaacctaataccaatacctaataccaattaccaattacttttgcaacaacctagtaaagtagcaggattctgactactctgaaccttggcaatctaagaaaattctgaaatacagtgtattcagaagaagcttataaatttgataaaaaagatgaacaatacctttattttaaagtatatttctacacaatgtatatttgcacttatcttcaaactgattttgtaatttgttatagtattgtttggtgttagcctaagtagtaatctatgatattttatctattaaatgtgaataattaaagagggtgaatttgggtaaactgatttactaatatttattaattaaattgagtaactttaggaaaactacattttcttatcacatttgttctcttgtaaaaagcatgtcaatacctaggagacaatagatgagtgctttcattcccaataaggcaatcattttcagaatgagctttataaagaaactaatagtcatatttcaacttgattatttgaccatcacaattttataaattgaaaggagtgtttgaaatcatagggcatgggtagtagtggaattgcattttttaaattacctataatttttttaaatgtcactgccttagaaattcttagggtatgtagtcttatcactgttaataagaaaagaaaaattatttaaaaatggggaagataaaagaagttgaaatgcttttttggaaggaccaacagaatccactttacagtgacatacatgaaatgagcaatgtttagtatattgtagtcaacaccccatcccattcatttaaattttgcaaataatttcatcaggagtaaatgtgaaaatggacctagagaattgtgagtataatttttttagtgttctgtcattgtgtgtatgtttgtatatatttaattttaaagaataattttaattgcatatatgaacagactttaaattgtatggttactgattcagtatcatctaaaatatatgtattcattaatttctctacaaatcttttactgagtgtatactatatgtgaacatagtatgtgctagagttaaaatgataatatatgacaagcacctgcattcaaagaactcccaggtaaatcagcacttgtcatgaaaacaaagtttcattacagagtgataaatgttaatagagtagggctctattgtcttagcttggacatgattagactccacttattgtggtaagtgactctagttcccttgtttattccagccattattacagagttacatatgactgctcagtctgcagccttttaaccaagatttcaaatggttgttatcattccttcttagaattaacatagacatagtgatactcctttcatctatctgtctatctttctatctatctacctatctaacagaaacaggagaacatacagctttttcatatatgtatgcttgtctttcccaaaattataagtttatagattaagcctttattttggagttgacgttgttttgtgtgcttttgcatttgtcgttgtacatttttctcccaattttgtggctgtaaggcctagtacagtgactgacatatatcaagagctaatttttaatgtgaaacactaagaaactttatgattaattatatgtatgagattggttttaaaacagaaacagatacccacaaagagacttgaaagatttgcttttaaatcaggaaacccacactctgctccctcttcatgtcttcctctctctctctctctccagtgtgtttattttagtaagataagtaagattcctgataggtgtaaagagacaagagaaaacattgctactgtatcacagcacattcattttaaattcaattaagttttctgatttctatccaaatggaaaaccctgcaaaccttcccattctgctaatctttgggccatactaactttctgattctaacctgtaactgattaactggacctttaaagctttttctgttacctttatacttggccttggtctagaagagtctcacagactctgtctctgcccaagctaattccaggaaatgctgtctattctattcagtgacctctcccgaggagtcagagctagttggtgttgatgacagggttggggaggtagtcaggggacaggactgaaaagaagtgtggagttaaataagtagatagccattttaggaagcctctgttttcctctggtttgcatggggattcatgcaaattagtgtaaactagacatctcactggcaaggctgcagggactcagctagaatctgtttggcatctgttcctcttgctcaacaatttctaagagaccaagaacaattccatagcacttatcaatcaaggggttgaaaatgacattgctatcactgagttaaatcaagtgtaagatcctgggggctgtgatcctggctctgtccctttaaaactggtgtgattactggtgtagctaccaccaagcctgagaatgccaaatctgaacgttgatggaggaacagcaaggatcctccaggcaaacagattgttctactccctcaaaaattcttcagaggagcagggagcccagagggggatcaaaatttctccaactcttcctcacttccaattatgtgtgaaagggaagatctatccaccacatccaaggagaagctccatcctaaacttgcagctcttatttctgagccagtcttgttgcagtgttgttttgatttttttcaaaggaacatgaaataaacagttgctttgtaatttatttttacatgtttctatcagcccttagaagttcaaagtattcaaaattttaaattatgttaattttacacttaaaaataaatgaactgaatttaaattacttaactttcttaagataatatttataaatttaaatgtgcatcactctatttttttctttttattttctttgctttactttactttttttttaagatagggtcttgctctatcacccaggctgaatgaagtgcagtgttgctcactgtggcctcaaactcctggattcaagtgatccttccacctcagcctcctgagaatctgagactacaggtgcatgccaccacacctcactattttattttccttttttataaagataggttcttgctatgttgcccaagttggtcttgaactcttggcctcaagtgaccctccagccacaggcttccaaagttctgggattacaggcatgaaccacctcgcccagccttacttttttttacttggtgaaatttctaaagaggaaacttgacattcatgaatactggaattaagaatatgagtaatatatgtgtgattaaatttagaacattttttctcttcatcttcatcttttacaatatatgtattttaactatgaattattgtacattgatggttatatttcttttttttagttttttttttcttttttttttttctggagacatgtcttgttctgtcactcagcctggagtgctgtgatgcaatcatggctcagtgcagccttgtcctcccaagggtcatgtgaccctctcaactcagcctccaagtagctgggagtacaggcatgtacgatcacatccaattaatttttgtattttttgtagaaaaggagttttgccatgttgcccaggctggtcttggactcttgggctcaagcaatccaccttccttggcctcccaaaatgctgggattacaggcatgactcattgcacctaacctgatggttatatttcatttacctatttagaatgttagtattgaacattttaacatataattatccaatttaatattaatcctttttgatattaatctcatattaatgttccatggaataatacagtggtcctttccttatatgccagaaatatgttctgagacctctagtggatgcctgaagctatggatgctaccgaatcctacatacattatatttttcttatacatagaagcctaagataaagtttaatttataaattaaacacagtaaaagataaccatacaactaataagatacaacaattataacaatatactgtaataaaaggtatgtgaatgtggtttctcaaagtatcttattgtcctgtaaccatctattttggaaccatggttgacagcaggtgactgaaactgtgaaaaacaaaactgcagatgggatggggactactgtgtttattgtcttacaaaaggaaataaaagtataatcttctttacgtaaagatttaagttttatttaggaactttaattaactacactctttgaacttaaaatttatattgtttccagctgatgtaagtgctactcagactctcttgaacttctttttcaattgtatgaatgtttcctagaaaattttatttgcatgaaactcactagcttcttttttttattttatatcataagatctctttcaggtggattgaatgtctgttccttaggtcacttgatagtacttgttctcaactaataatcaatgaagccatataagtttggatcttgaggtcacatgaaaacataacagtatttataaatttaaaaattagaaagaaatatttcttaaagaaaaagttctagcttaagaccagttccaaatgactgaagaaaggttcacgtggtagacagaaaaagcccccccaaagatacccactttctaatctctggaacctgcaaatatgttaacttacatgacaaaaggatttagcaaatataatcaaattaaggatatcaaaatggagagattgccccagattgtctgagagggctcattgtaatcacagggatctttataaggaaaatagaaaggtaagagcatcagaatcatagaaggaggtataacactgagaacagattttggagtgatttgattgttgatgttggaggtggaggaggcctgtggatgacagaagaagcatttaaaagttggaaaagacaagaaacaaatttgatctagaacctccagaagaaatacagccctaaagacatttgattttagccacatgaaatgaatttggaattctgatttgagatatagcataataaatttttatcgttttaagatgctaactttataaaatttgttatagcacagtagcagtaggaaaatcgtacagttctaaaaaagataaagagcagcaattcccaaaaggatatactcatgaattcttacctatttattcctttaacctatcgaatgtcctaaccaaatacaaaaatatgccattaccaaatacaacaacatgcctcattagcaacaaacacgtacttaggcttttgtccatttaggagttctaaatatttactcttctctccatcttagacaacaaatcctggggaatgtaattataatttactattaacctaaacactgccccagtttatgggccctaaacatttcaacgtttttcttctaacagtcccaagtgggccacctcttacaaagagagtaaagtgacaagtgttgaattatatatggtaaagtttatagaaggaagagatcactgtggacaggaatactcagaaagaattctaaaatacatcagccttagcaaaacaaggtatgtgctgagagatggttgcttggagagggacagagaggatgtggggagagaacattccagacagacatagaacaatatgtttggttgagatactcatatactcatatttttaattaaaaacatttttgtactaagaattatgcattttagttggcagaaagcaaacattcaggacatctagctcttcaataatgataaatgcagcttccacgtgactattggcatgtacagtttgccctatagaatcataaagctaaaagtaattttttgatacaaatcctcattgtaaaagggtctcaagattaaaataattcaatgtcttaggtaaaagctactttttaagtatgatcaggaatactgaagtgaatactaacatttttaaagtacatctcaatacaatcatagaagaaaggaatcttatgattatgtgtatgcgattttgtcagatagaagagtctgcccatttcaatttttttaagcggttcctaagctcagatcttaataccaaaacaagctactaagaatactcatttatagagtgaacaacaactaacaatttatttaagtacaattctgtgactttagctatatgtgtcatttagttctccttcataagtccttattcagctatggctaagctacgtctaataggaatactatggtttatatcaccttctatttaccaaccttcctctgttgcatattcaattagtcattgcaataacaggtaactattagagtaaaatgacaaatgttgaattatatatgccaaaatttatagaataaacagatacctcttacagatctataagatcttcaacaaaatagggtattctcaatattttgtttatgtaaaattcagagaaatgagtatttttcttcatttaatgcatttcaatatttttggggcttttgtttctaaactaatactatagaaatctattcagagctggaatgtaggaagtttcttctctttcagtgtattgcctccaaaataccagctacaactgttaatttcccggtaattgtttcctctctaatctctacaatgtttctctcattgtttcatttttactctgatgacatgatttgaggaaaggtttttgcacatttttggccaagttttttgcacatattgcacatttttcacattttaaaagttaattaaaagtttcctgactttttaatgatcgcccttctaactggtgtgagatggtatctcattgtggttttgatttgcatttttctgatggccagtgatggtgagaattttttcatgtcttttggctgcataaatgtcttcttttgagaaaagttaacttgtatatcataagctctctttcagatggattgaatgtctgttccttaggtcacttgatagtacttgttctatggagatgatagtacttgtttctgaggtgaataagctaacttttagcttattcgccccagaaaaagtcttagatattcagaaatcacaaaaatttaggctgtttccttggttgttgcagtccttccatttgttttaatatctcatctattatgtgttggctaggtaacgaatacatatttaatctaaaaatggatgtagtctgaatgtattttctaagttacattttaattttggaaaacaataaaaaattaatgtttttaaattttgatttcagtttacttgaacagactttttgcttataaaaagtagaacttgttgacattaccctctgattttccctttttattttttatttttagagacaggatctcactctgttgctcatgctggagtacagtatcatgatcatagctcactgcagcactgaactcctaggcttaagtgattctcctacctcagcctcctcagtagctaagactaatggcatgcaccaccatgtcagctaatttcttaaaaattaatttttaatatccctattattaattgttaacatctctatgttgcccaggttggtctagaaccctggctctaagcagttctcccatgttggcctcccaaagtgctgggattacaggcaggcgccgtaacacacagtatgattttctttaataattcaacatcatccattgctgaacagaagatgatattttgaagaaaaacaggaaaacagatattcgaagaacaaaagagtagcaaatactcactcctatctagctgtctctctccagactatttatagtcagtatcattttgttatctctgtcatagtacatttccaaattttttatctccactggccttgagaagtcaagttaccctagaacatgacaactttagatcattacagagtgtaatgggaatattagctcttttgtgtcatttaaataatttaacttaattaacaaacttaaattattctaaggattcttcaaattatgtcagacttttaaaaagttttccatgtttagccttttgacaaataaaattatacacaatgtgagttttatatcagcggcagtgatgtctttaaacacactttaaacatatgagtaacattttttttttctagtttgggcattttacagaccccttctttaaatctggctgtctttgaaaacttttaccattcattaacacctatattggaaagtggacaaaataaataaatgggtgtttgattctcaaaccagtccgtcctgtgatttcagtgaagtgttttggtggaagagcagttatacgagattcttataaaatctatgaatttcagtttaccatgatttccttttaccccactctaggtcaggaaaaggaagaaatagtttaatggtatgtgtaataacattgaaaataagataatcacaaaggagaaaagaagttataggagaagaggaagaaaggaaaaagtgtttctgattcttcctctcatgtaacatttcgacataattaagtcttattcattggtactgtatttataaatatttcaaacttaataagtatgctgaaactgatattaccagtataagaataatcaatccaattaagtataaaattaccttccataatattttttctgatcttgaaagggaatccataatctcattatagaaggatattactatccttatattcttttaaaagttgaaggaaatttcaatatagaataatatatcaaatccatcttctttcaactcagtttcaatagcattttcctaaaaggccttttcttcctttgagattttcttttctctgctttggatcgtgttttagtcaatgcccatttaaaggcaaaggagagatacctagtaaggccagctcaagtaaaaagaggtttctagaaaagacactggtcaactgtgtgtaactcaaggaaagcaaattgtcctgtgtgtcacaaggactgaagatgaaaaatagaaatgtgttaattacacagccatgcctttctgcatttttctttatgggtcaacatgagtgctaatctctgtttcttcatgcatgtcagtgttcatctctgtatcttcaagcacatcctacatttcaattccagggctgtcacatcactgaaatgtctgaatctctaaatcaaagcttcaaaacagagagggattatgccacttgagtaactgagtacaactcaatccatgtaagaatgaaattccttatccctccaatcactgtaaactggcttttactccagagtttccaatctcaagttgacaattttataattaatctcagatttctctttattttctactaaattttctcactcataatggtagcacatcatgtttattctgcatagatagatagatagatgatagatagatagatagatagatagatagatagatagatagatagatagatggatagatagatagacagatagatagatagagtttcactctgtcaccctggctagagtgcagtggagcgatcccggctcactgcaacctccgcctcctgggttcaagccattctcatgcctcagctttctgactacctgggactacaggtgcctgccaccatgcctgacttattcttgtagttttattagttttattagaaggggtttcaccatgttgggcaggctggtcttgaacttctgacctcaggtgatccacctcccaaaatactgggattataggcatgagtcaccatgcccagcctataattcttttcatatgtgatctgcaaattttcagtcttatacaggagttaaagatgaagattctggttaggacacctaagttcaaattacgtctcttactttggatatagtaaatatcctaagtcccatgaatttccggtgcctcagttcctttcactgtaaaatggggaaagtgattattcctatctcatagatggttgtgtggatttaatgaactagtatttataaggcacaagaaacactgtcagtcacattgcaccatataagattcagataatcgtaataatttccattctaactacaattgccataaatgtagtccccctaaactactgtaatcaattccttataggtccctattttagatcagttttcctaaatcactggtaggtcatataattttcacactatgaaattcttacttgtatatgaaatcctacatgccatccaaactaaacccatgtttgctccatcattgaaagtcttcctcaatctactctaatttatgttcccagattcatacttttatttcatccctttaaaatcactctgcttctcatgtgggatttcacctactttcatgtctgcaagcctttgctcagctgtctatgtcccccaactctagccttaaaagcacttcaactcttgtctgtccgttcaaatgttttcaaacaaaaacttttgaaatcttttttcccctcagaatagaaggtgttgagttacttggcttatttttgtttaaagattcattataagcaaagaacaggaacatttaattcagaattggtgtcttaagtaacttatttttctgccattttatccactaccagcccttacacttttataagcggttttacctattaaatgagaaaaatgctattttacaaataaaaaccaataacaactctggctcgaaatgtttgtgtgtacagataatatttcactgatgttactgtagggtgtttcataatttttatgaaagtaattcaagaaatgtcattcttttttaaataaataatgaattatactctgatataatataggaaaattgtctaaaatatttggtttaaaaatatcttttcaaaacattgaaaagctggcagtatttatttatagtgacttctttcttaatgtcagcagatagtacaatttctgtaagtgagaattttaaaattaattgaaaactctcctgttagtaaattaaagcatttataatatttcattattatcattcagtctgttgaaacccattaaaacattatattctacataatgctcatttctctggactatagttaacttattttttctttttcccccttttcccttctgtcctgcctctcctgtcatctgcacccctccagcctaccccaggatttttcttcttcatttctgtgttatatttttggaaatttcccttacccccttgacacattctcttaatctctatgcatttttctttaatctttcagaggtttcttggggcagagaaatgctgttctttaagttcaaggatgagcattttggtcctgcatacatctctgtctgtgtacagcagaaagtccattatgtttgatttttggtcttcactgaactgtgaataacctttgacttctttacaagaccaacacttcaaacagaaaaagggctcatctttgtttttggatataactgaatactcagccacctgaggaactttcatcctcacagcaacctttctttttcattaagaaaatattatgcaacagtactacaagcatcaggaacctctctctaggaaataaaataaaaagaagaaaataaaaggagaattaagaccctagttgtgtcacagagcaaagggctatgtgtagtgagatcttgttttatcttttattccactagttctttactgataattattccattacagactagtcttatatgtatttaataatctaaaaaataagggccaggagcagtggctcatgcctgtaattccaacagtttgggaggttgaggcaggaagatcacttgagtccaggagtttgagaccagcttggacaacatggtgaaaccctattcctacaaaacatacaaaaattaccctggtatgatagtgttttcatgtagtcccagctgttagggaatttcaggtaggaggatcgcttcagcccaggaggtcaaggctgcattgagctgtgatcctgccactgcactgcagcctgggcaacagaatgagaccctgtctcaacaaatcgtcatcatcatcatcatctaaaaaatagaatgatcatttctctgttgttataggccattatatttttgtgcttttttctttcatttctgttgtatatgagcagtcatatagatttctgatttgtagaaactctcactttgaataatgataactagaaaatagattctattaaatttagaaagacagagttgacagccaatgctatgtaagtacatgaggaagaggacaagaaatagcttttcttcactacatatttttatttatatttatttttattgttttgacttcattttatgtaaaattttgggggcatgttatagctgaatactaaagaaactgctcatcaaattattggatcttcctctctcaaagaaatggactggaataaatcagtgtccatgttgtacaaatggagggctgcattttacataaggttgtatgggcctctttgataattatatctgtttgatgattcaggggctacttgtatctcatctgctattctcctgctagttcactttgttactggaaattaaaccttctctttaaaaaagtctcaacgaaattgagtgtagacagaagatctgtaaatagaagttgaatttttatgtttgacatatatgttgtaaaacagaggaattcaggtttcttaagtctatttgaccgcttgatatgatgctccttagttctctattcaaattgtccttcacttattttttttctttgttttccttatctcatgcttgtttttatttttcctactcaacctaatatcacatttgttatgttataaaagagggaaatgtgattatcaatggtattttaaatgcatgtttaccctgtgtatttccagtctgcatgagaaagcagaacaaggagaaaagaaaatgaaaaggagataataaatgcttttaagatattcagaggggccaggcacggtggctgacatctgtaatccactttgggaggccaaggtgggcagatcatgaggtcaagagttcaagaccagcctggccaacatggtgaaaccccgtctctactaaaagtacaaaaattagccgggtgtggtggcacacgcctgtaatcctagctactcgggagactgaggcaggagaattccttgaacccgggaggcggaggttgcagtgagctgagatcacgctactgcactccagtctgggcgacagagcaatcctccatctcaaaaaaaaaaaaaaaaaaattttttttcagaggtttggtacatgaaaatgtgtgactccatcataaaccttactccaactcttttcaacctcctccactactttttacccacattatgtctttcccaatgaatctggtacacccactgccctagaaagtgccttgcacttttctagtgtttctcatcctttagtttttttccttaatttgaaaatctattacctgaggctcaaggcaaatgctccagttccatgaaaccttttctgaatacaaagcaaatatttacctactcattatgttctactgtataatgttttgtaaatcgttatttatctcttatgtaattatgctccatttccctaactggattatgaattctttaagatttctggcgttctgtctgggtacagtgctttgtagcaaagggaagggctaatttagcactgttgagaaatccatctttgggggtgaaatttatgtcaaaatcacagtttgaggtctgtaggatcaacagaaatttataaagtaaatgagaagattctagcactcagtcctcttgttcctttctctgaagtgtcacatgagagattaatctaaactccacagaggagaataaaacagaaacataacatgagtggaaacttgtagtgtccaaatgtcctagtctgacagcacagatatattaaattacttatgatcattgttttggtaaacatttccaagatcagaaatgacaaagttaagtgatacttcttatttctgcttttaaggtatgtctttaaaaaattacttacattgagaatatttaaaaaacataatatgctcatttgatttagagtatttccctttgttgaattgatcataaattataaagctatttagtgtctaatgtactatttttcattttcattctctcttctttgcctaggcatattgtatagacacacacacatacctataggtccatgtttatactgtttaacatgctacttactaaatattagggagcaggacagttgttctactcctgacagctttgataatgtctaaatatttaagaagagatattttaatactagatgagaattttaaatgtgaggtcattgtattcttgttatgaaacaactagatatttaaatttagtttaatttttttcagtagtggtacttgctattgagttctccaatatatttgagcatattctaagttgaatgagagcaataatttggtgtgtggtggtggtgaggtctcacttttgttctttggtttcagtttagatatattgggcttggaagtttataatatatttaaatacaaaaagaccatgtagcaaattcaatgctataaagtaaaaagaaaagcaaaaataagtgatataaaagaaaaagaagcatgatcagcatataaatttgtgaagtcataggatttggctgaaaatcatcgggtttctttctttctcacatgttttcatgatttgactgctgaacaaagcttcccaaagcgctgcattttctcagtttttccttacataaacatgagagaataaaatgcagtacgtctgcatccagccactttttaactcctgtagatctagtgtttaggtagtaacctacaatgatttcactttacttcaaaatatttgtgctgtctctgtatatcttcctaaaatatcatcaccttgcacatattttgcgctatggtacctgattaaatagtctgttgtatgctgtgaataaactcatgattgaataaactcaagggtaacttcaagtatctgaattgaaatttagggaatttatgtcacactacacatagcatataacttttaaaatatatttattgtgacagtttttatttttaaaatgcaaagatttagaaagaaaatttatatgtagttttatcctatgattagtggccaagaacaatattaaagccagaccatctagaggttcctttatagagatgtttagtggctattgtgtaggctttataggagtatgtattaaactgctgtcaatttaccagttattagatgtgtttacctgaaagcaacatgaccattttgttttgctctggaatgctaaattagtggagttatgggatagtttatctctgtttatcagctacaactcattttacttcatgtcatctctttacgtacttacagaatgtttcactggtatgcatgctgggattctgaagagtctttttttcttaccttctgtatttctagtctgtcactaacttgctgtgtcactttgagcaaattatttttttccactgagtcctaaatctttatactcccttaagatatacttttcttgaacactaagggcctgaaattacatgtcactctctctatagaaaggtaactttttcctttaacccatcgggcctatgcacacacttcttcccagaaatcttcaccaattaggtaagttatttgtagagcagatgcattatttctaacacgtcaatgttggaaagtgtactgccttttcattaagaatttactaaacatatagagaattgatggaataaaaatcccccaatccttgaaagtttatcatataggagttggataaatattaatttagtttattatgaaaagcttaagttatctaactatagataaatccaaacatagaattagaggtaaaataccctaaaatgatatctattgccgttttataatggcaaaacaataagacaggttacttttattgtaattatttataaaaaaagatatataaatttgagtaagttctgatctttaaaaaattctcatatctaattttttatatatgcttgaatgctttgtaagaatgaattgtggttcttttagaaattgtttttattcagggaatgttgaatatactagaaaaaataaattcccctaaaagctaaaagcttaaggcatttgccttaaatttcagaagtaaaagtaaaagatgcattattcagcgtatgtttcttaggactctcctacgctcaaggcagggtaaagtttctgttctgtaatgagtatgttatcagggagggagggggaaatgatatcctgctacaactcttatccatagctattgccattatcttctttctcatccaactatctttactttttcaattacactttctaaatatggtattcttttatattatacaagaaaagagactattacaagcttcctgacctttcctttttcctcaagaaatgccagcttaatcctaccctgatcctattaagaatcaaaagcatttactaataaacattcaataatatttattattaagccatacttccaggtaagaccttgatgttaagtcttcagatgcagctactttaacccttaactgttgtaatttccctctcctctgatcatacatggactcctgagacatagctgttttccaaacttcactgatgcaatttcttcttaatgaagtccctatactagaagtttctgacttaagaattactaggactgcattatttcctttctcagtaatgggtagtcttgtttctctgtttctttctaggactaagacaatgttatgtttttgcctgactcctttacttgctttcatcttttctggtcctgctcagcctgaggaatgggaccctgataccagtagtcaaatcttgatgacaactactagcctgcttagatttctgaatacattttttctatgtttcccatctcaatatttaaggcatgtattagaaaaatataacagctaaggtaatttgtttgggaagtgccaaaaaactcaacttaaactgactaacacaaataaatgaaaaaacaagcaaggaatgtgttgacttcaaaaaagaaaattcagattcaggtttgacatggaggaccagcgacaccaccatctctggtttctctagtttcccgctactttcccagggtgttgacttcatcctgaaaaactacatgatgatctccatcccaccagcaactctaccctcttcctatgtggtagtaaatgttttgcagccaaggagcattctagccctcatactttcacagtatattgtccaagagtagagaaaatctcctttggtaggctctgcacaagtcttgaggttcacctcctctctggtctcaatcgatttgtaccatttaattaaattgtattattattattattattattattattattattattattattatttgagatggagtttcactctgttgcccaggctggagtgcagtggtgtgatctcacctcactgtaacctccacctcctgggttcaaacgattctcctgcctcagcctcctgagtagctgggattacaggcacacaccaccaagccctgctaatttttttgtatttttactaaagaaggggttttgccatgttggccaggcaggtctcgaactcctgagctcaggtgatctgcctaccgcagcctcccacagtgagattacaggcatgaaccaccagccacctcacccagcagattctgatttgtaccatttctatttatttatttatttatttttggaggcggagtcttgctctgtcaccaggctggagtgcagtggcgcgatcttggctcactgcaacctccacctcccaggtgcaagcgattctcctgcctaagccgcctgagtagctgggactataggcgcgcaccaccatgcaccatcaggcctagctgatttttgtatttttagtagagacggggcttcaccatgttggccaggatggtctcgatctcttgacctcgtgatctgcccgcctcccaaagtactgggattacagcaggcatgagacgccgcgcccggccttgatttgtagcttttttttttttttttttttttgagacggagtctcgctctgtcgcccaggctggagtgcagtggcgcgatctcagctcactgcaacctccgcctcccgggctcaagcaattcttctgcctcagcctctcaagtagctgagactacaggcgccagccaccacacctggctaatttttatatttttagtagagaccgggtttcactatgttggccaagatggtctccatctcttgacctcgtgatccgcccgcctcggcctcccaagatttgtaccatttttaaatgattttttgtttccaagacagtagatgcgctggtattttaagccaattgaagttctctgctgaagctgagggtaagattagttccacataatggcaaggtttccttttaaggaaaaccagaggagagaagatggataatgctgaagaggggttgtttaatgggtacaaacatacaggtagatggaaggaatatattctttaggatcaacagtggagcagtgtgtattccttacagacatctccaggcacctcacattttattgattgattgattgattgattgattgagacaatttcgctcttgttgcccaggctggagtgcaatggtgagatctcggctgactgcaacctctgcctccctagttccagcaattctcctgcctcagcctcccgagtagctgggattacaggcatacgccaccaagcccagctaatttggtatttttagtagagacagggtttctccatattgctcagaccggtcttgaactcccgaccttagctgatctgcccacctcggcctaccaaagtgctgggattacagatatgagccaccgcacctggcccgggcgcctcacattctaacactttgcaccaaccaactatagaatgtgatgaagtcaccacttccccttgggaactctagcttatccgctgaacccagtatctgttactatctcattcagctagaaatacttcctccaaacaggtcctgccatagagggaaaatctttaccagctttttaccctcttttgcctcctgcctattctactttcgctaagcccttaggatcgataattaatatgaaaattcaacatttgtgaatgaaaatattagttcaattcaaaataacaaggttatctagttaaagaacatgtccatattcacatagaccaaagaaagaatttaagagaatgtgtgctagaatggtgctagaaatgatacacttgccctcaacaagtatttgtgattccagaccctggctgttgaggcgacactatggggaatagcacctgaacatttcttatgtcagtagcctccagcctgtataatacattttgaaaagttccatgcttgttctgtaaccttaatatcttctatgttacaaaaagtgtttgaaggagtgtctgccttatcaactattagttgattttgagtctcagtacttcaacagtgttgcagaagagcatgcttcatttttgaatagcagcaataatttacacagatattcaaatatatacttgaaaatatatacatacatatttattggtaacaataattttagagataagtaattttttaatttatcaagctgagcttcatattgtatcaatcaaatataaataatgagatgatttctaatgattgtgtgttcacaaaatattaattataagaaaatcgtatttcactagaaaaattggaatggtatttgttaattcttggcaaacacacctttttataagaatgggcaaagcaaacatagagaccatgggtacattttatttatacagatacccaattaagaaaaaagcgtaaataatcaaatgcagtagaaaatgtattaagataataaaatattgttgacattttatcaggttttaaaataagttaggtggtaacgatttttaaactaactttaagaaaatgcaaaaagatacgtagattaaaaataatatagttttaagcatttaaaatatgaaaatgcagctaagagaaaactagtaaataaataaaaaatagccatctttcaattatttgtcagctataaggcaataatcaaaacacatttaaaatgaaagtatttgtttacctattctaaatatacatcaaaataatttattgacttttaatacagttaaagaaattagtccaaaaaggctgtttgatttacaaaatataaaacttccaagttgagtaactgcaaagagatagttcttagaaatagacaagcttaaatcaatgttctcttttccacagagctttcttttcaatgttgttaaataaagtatatatgtgctataactcagttttgtggcttttttaacacttgttctgaccttcctttgccttcaatgtcagacaggatgggtaggcactaacagtttctagacttttaaatactaacttatactatactgtaatgatttttgacattcatagtcatttcaacattctagtaactaagcaatctaaagctagttggcaaaaaatatgcacaactctttgattagtaactatgttttgatgtttacatcaaggagtctaatctgaaatatccttcataataacctatgtagacaagggcaaagtaagacttcaatagccacctagacagtttggatgatggccagatgagccagtgttctaagggctgtcggtgaccttgtagtgaattttgcaaaagtgcgaatttctctgtctcaggcagttgtatgattaatgaaacacacccacgaagctacagtgcttggtaaacacatgttggctgtaaacaatattcgttctctgaaggattctgagagaagtggtgaatacagagccagatttacagagcagtattctgtacctcaaatgtaagcagtgctggagtggattcatgaaacttcaattcagtagtgagaaagtcaagccttatagctttccaatcctttgaagcaagatgtaattctttcacttttccatagtatttcttgtttcaaacaacattctctcttaatcatatagaaaaaaatacaagagatgaacacagtaaaccaatgaatttgttcatgtattcctctaagaagagcccacatttcttagtctgtgacaagaataacacctttgagtggaatactaaacaaaggtatgaatggattcttagcaaaataagagtgtacaaaagtcaaattatcagatagctatataataatttctgtagtgtttaaaatgttcatgggcgtagagagatatgaagggatattttaggatatctgtgaaaaagtaatacatttaatatattttgatttcagtggattttttatttagttcattttgatattcctctgataaatagtacagatcgtaatatgatacagactagactttttaaactgctagtagctaataggatacttgtgatttgaaaaacttttactgaaacatacaccaaatatatatattgtggcaagtgaatatgtaaatgacttattaatagaggtccagtaggtaaatgtctgtgtctgtaactttgtgtgtgtacatatattgttgcagaaattggaacaagtatgcttaaaaaggagagaaagcaaatttacgactttcaaaggcaacagtgtgtgtttcatttataccaattcttttttgaacaaatacattttaaaattgtattttaatctttatggtaatcaacataggagaaggtacatattaagtgaagagaggacaaatgaatgaatattcatagcactcagatttctatattttactgtttctgattgttatataaaactgatttattacaaatgtaagtaatacacacatttttagacaatgattagttaggtaactgctcaaagaataattgaaaccaataaatatcaccatctgtggacatatcaggtattgtcctttaaagataagtccttggcctggttttattagattatgttatcagaatatttttagtgatctatagaatgataccactttggatgagattgccaagatctggagagagaggtaggatttcttgtgactttgaaacactggaggaatgatgcgtaataaatgacattgtattcaaaggggatgagtgtaatagaaaatagctggctaggcaaaaaccaggttgtctgaaaccagttaatgtgcataagcaatgtgatcttactaaaagcatccttatgcatcctgttttcatagagtggcgtttgttcagttaaaaacaaagcataataacgaacaaaaacttgaatgtcctcagagcaggatggctgcaagtattagaaaacaattctcagtctgagtcagaacaagtgtgcagtttaatttctatacttcaaaactgatgggatgaacatgtgtaagacttggagatggcaactaaaatgagtaatgggctggaaaccaggacctctaaagaagggttcacggagttactgtcagtttgaggaaagaaggcaattcaagtacatgaaagactgtggtaaaaatgactccccaatgaacaaatgtgtgaaaaccaaaatatgtaagattaagtaaaaataagactataagaatttcatgatactatagtttttaaaaggagggtttttccattgttaaataattatcaaattagaattagaaagtctcttaactgtatagataccagtaatagctatatatgacaatatagaaactccttcagtatttgttctccatcatttccaaaacaacaacataaacacaaacacatcgtttacatatttgctaatgcataacctgtcactgataattgtaggaaagttaacgtgcaaaccatttaatgcattaacacagatcccttaattacttgccttaggaagggcatgtaatgggtgtctgaaaagactaatgtaaactacagtgcccagacatttcatagtcctgtgaatactgagggcttaggctgttgttgcactatctgtggaagaacagttcaggagtcagtatgcttatgagttggggaaagattaagatctttacatacaccaaaaagctcgtgaaatctgccccatgagaagcatgataccaagaaacagcatgatggtagtaggagatagacgatcccaggtaataggggctttccaagagagtgtgaggagcctataaactataggatcaaaactatctaggttcaaacccaaatctttcagtaacttacatgctttatgctttaatttcctcatttgtgaaatggcagtgatgatcatgataccgatctcaccgtggtgttgtggggattaaatgaattattataattaaaccccttaaatcagcgcctgacacagtacaaaacactgtatagggttagtattatttagaatgatttatatagctttgatgtgtttaaatacccttcttgaaccagtgtattttgaaatggtatttcaatatccagacttaaaatgaccatttgggaaagggtccaactttccggacaaattcagatgagcaaaattctttgaattggagattcaaaagagaaaagagaattttattggctatgattattttccaattgtcgctctttttactgctatgtatattttatatctcattttcatttacatctattgtaaaccaaataacagatttaatattcctgttagcatcacttctactatttccttttctgtgcgtgtgcatacatgtgtgatattctttacatgacctggtgtgtgcttcatattgcaactgcaattcccctacaaagagggaaacatgatgtgacaggaggctgtgtctaaagacagtccatgagctgcaggcagagctggtaccatttgtgctggccttttcccaggggtctacacgtcaaatatgggcatcagactggctttctggcttttgactgaactccagtagacataatatgaaaatgaatgttaaactttgtttctgccatttttgagatatttaatctatacctattgttattcttctaaaaaaataacttttttggcaggtactgctcttagcactggggatacagtgagaaatcagacagaggtttctgcttgtaagaagctatcattgtatagataagtaaataagcaattcatgaagataatttcctatcttcaagtactattaccaaagaataaaatagataagcagataaagcaatgcagagtaacaggatggagtgtcctattttaagtggagttgtaaggaaacatctctttgaataactgaattaggaacgcaaagtgagttaagcgagggagcccaccatgtaaagacctggatgatgagtgatgaacgttacaggcaatgttaagaaaatgtgcaaaaagcttgagtcaggaaagaatgtaatgtattaatgaaacaaaaaggaggcagtatggataaaacagagttgttaaagggaaaagcctttcaagatactatcatagaagtaagtaccctagagctatttgtataggaatcttgcatttaattttattctgagtgtatatcattgcaagaatttaagcagtgaaatgacattgttatatttacatgtttttattgatacataaaatttgttcatatctgtgggatacattttgttacatgcatgcactgtgtaatgatcaagtcagggtagctaagatggtcatcaccatgagcatttatcttttccgtctgctgagtacatttcaagtccacgcttctagctatttgaaatgtacagtacattgttattaactatagtcaccctactctatgatcaaacattagaacttattccttgttccttccaaactctcttcacacgcgtccccacccctgcatccttcccaggctctggtaactattattctcctctctacctccatgagatcaactttttagctcccatatatgagtgagcacatgggatatttgtctttctgtatctggcttatttcacttaacataataactcctatttccatcaatgttgctgtaaatggcataattttgttctttttttagctaaatagtatttcattgtgtatacataccacattttccttatcttttcatctcttgacggacacttagtttgatttcacatctttgctattgcgtagtgccgcaataaacataggggtgcatgtatgcctttgatacattgattctctgtttgattttaagataaatatgtagtagtgagattattcaatcaaatagtagttctaattttagttttttgagaaatatctatattgttttctataatggcttctactaacttgtattcccaccaacaatgtataacaattcccttttctctgcatctttgccagtattaatgtctttttgataaaagtcattctaagtggggtaagatgatattttattttggttttgatgagattttattttgggtctgattttcatttccctgactcttactgatgttgaacattttttcatatacctgttggtggtttgcatgccttcttttgagtagtgtgtatttagatcttttgcgcactttttaatgtttggggtttttttatgttgagttgtttaagttctttgtatattctgtgtattagtttcttgtcagataaagattttgcaaatacttcattcaacagtttgtctctttattatgttgattgtttccttgctgtgcagaaggtttttggtttaatatagtcccatttgtctgtcttcgttttgtttcctgtgattttgaattcttacccataaaatcttggcctagaccaatattctggagtgtttctcttatgctttcttctagtagttttatagtttcaggtcttatgtttatgtttttaagtcattttagtggattattgtatttgctgagggataagcatctagttttattcttctgtatatggacatccagttttcccaaaaccatttattatgttttcaaaattattaagattttgcatggagaatacattgtggaggccacttgttttcacacagatcaatgaacagaatctatgtactcagtggagattgtatacctagtccatagataattatggggtgaaaacgatgctatctgtgatgaggtaaaaagggattcaaaattttctttggaaatagacaccttgatggactggttgtgaatgttgacaaaaatatttattcacaaacatttattcacaacatctcagatgtcaggggctgcttttctccttgtcttatcaaagggaagttgacaagaaatcatatgtatgtacaaatttggagctcagggagattttatttctgagtatataaaaacagatgtcatccacatacagattatgtttcaagtcatgagaacagataagatcatctatgaaaagagtatgatagagaagaataaagggccataaattcagctcaagagccactaacatacagagttaatttgaggaggaagagtaaggaaatatcactagtgaggaacagccattgaagcagaatgaaaagcagatgttttctataggctaaaaagctgtgtttttggaagcagggagccgtctacataatactgccgagaagttacttaaaacgatgttaaaaaaaaaaaaggtttatacattggatttagtaagatacacgtcagtagtaatcttcctaagaaaggttttaaacagagtagtggggcaaattccaaaaaaggaggagatcaaaaagaacatgggggtgagatggggaggagtcaaatagaattcacaagtagtaacaattcctttggagatgtttttctgtgaaaggaagcagagaagaagtgcatgtggacacttactaatttcaataaggagaacagattaaacatttaaacatggaggtagattggtagatctggtattggaaaaaagagtctgttctcttttgcttgtttgcctttttttctttcaaagtggtatataagtcacaattatcagctgagaataggagaagtggtattggaggtttgaggaccaaaatgtgataaaattgtctcaaggaatgaaaatgaataataatgaattagtgagatgcaaaatttatcagtacattttgtttttctttcactcaggattttgttctatgactatttggaaaccaacaagaaccctttttttgttacgacaactatattttaagtcttgtttaatatatttttatgtgggtcctcatagtctagtgattagaagtatgaacttttgagtcaaataggcctgactacaacaggttaaattccttaattgtataagcctcaactttaagtactcaatggggataatatatttggggtaaacagcttgagtttgaacctgaactccgctgctgattagctgtgaggattcaggcaattcacttatcaggaaaattagaataaaaatacttctaacaataataatgttagcagtaattacaccactcagaatctggtgcttgataaatagcatcttcatggctatgggggtttgtttgtttgttttacattttaattaaagtatttcctcttatttcagtatcagttgagtccatgcaggacagacttaacctattctatatagatgtaaagattggtcctatacttagctaaagtataaagtttaggaaattatttcaaaattatgcatggagagcagcaaaggtttgggaaaattttgtaacttctttctgcaaacaaatatggaatatttaggctaaattactctcctaggagaatcaatttttaaaaagtttaacttttaaaacttagttcatttgaaaaacagtcagtcaagatgtccacaaataaaagtaaacattttgattgtctactctagggacgggattctagaaaaaccatggaatttttgggaaaggtcatttggctatactagtagagagaaggtcacatctcaaaatgtcattccttccatctattcataaacaaacaggtagtgatcttttggtagagatccataatatctccaataaagtctgggtttttaaatgtgcaccaacttctattttgacaatatcaacataaacttttaaaatataacctatatttctgtcaagttggccttgttgcttgggtcctattttatattgactcacatactttctaatttttttttactttatctccccatgttaaaatcccattcatatttaaggcctaattcaaatgaaaaggaacttccccccaatacttttcattcactgatgagcgctccactttgtaaatatcttgtgcttgacttttacctcttacatgtctctaaatatttgttaacttacagagtaatatcaaatatatgttatgtgtgtatatgtgtatcatctatgctctcagctcttttttattcttttcagatggagtttcgcttttgttgcccaggctggagtgcaatggcgtgatcttggctcactgcaacctccacctcccaggtacaaggattctcctgtctcagtttcccaagtagctcggattacagacatgcgccaccatgccgggcttttttttcttcttcttcttcttttttttttttgtatttagtagagacggggtttcaccatgttagtcaggctggtcatgaactcctgacctcaggtgatcacctgcctcagcctcccaaagtgctgggactgcaggtgtgcacgacagtgctcagcctgctctcaagctcttggaggaaggaattggtcatataagttttgaacgccttcgataatggtagtttatacggcacatagctgaggcgggtggatcacgaggtcaggagttcgagaccagcctgtccaatatggtgaaacctcatctctactaaaaacacaaaaattagccaggtgtggtggcatatgcctgtctactcagctactcaggaggtgaggcaggagaaccacttgaacctgggaggcagaggctgcagtgaccaagattgggccactgcactccagcctgggtgacatagcgagactctgtctcaaaaaaaaaaaaaaaaaaaaaaaagaaaagaaatatttgaagaagtcagttagtgtcagagatgctgtgctgttccacccagatctcctttcagtactaaaggattccttcctctggctgctgggaagattgtaagcagaaggctctcgatccttttggggaaatgctttggttgaagataccaacaccctttcactgagcaggtcacagccagtgcttgtgacatgggagtatgaaggcacaatgccctcaccatacccagaactactctccacagccaatccagcttcagggttgcttcagggttgcccaaggtcttactgtgactatatcacagcctaatctatagctctcccaattcctactccttcctctcacacactgccaaattggtgttgaccctgagacagcatgtcctgataaatctcctgcattcacatctctatacagagtctgtttcctgggagacctcaatccatggcattcaggaaaaaatgctgcaaactaaaaagcacatttttatgatatgctatttttcaagctttttgaatcacatctgctattggcaatggcatgttgggctttatttgttctttaaaaatatacagatagctatgaatacacttcatcttgaggctctaaatgatcacattttgttgtgactaatattcattaaaaagacaggttaccacagtaatatgatgtaatagcctttaagtactcaccctgctagtcaattattaactaatatctttattagttaaatccatatatggcaactacataaacctctatttcatgtgtttgatttactgcctattttaactacattgtatcctggatcaattgttttttatccaaactttgatcattgcaaaccttagtaagaaaaaggttttctgggattgactttctgtctgctttgcactagaacatatccatgcttaaaaaaaaaaatcacattattcaaattcctgcttttttctagttctatattatatattacatatatttctctagtttgttttagaagttgtgattaagtccttttgcataggttgttacaacagggaactattgattaaattagtataggaaagtaatgaccagctatttgtactctttcactgtgttaccaaatttcagttctgtgctctggtttctttacagctctatttagtcagatataagaaatagtaattgagattttcaaaagacaggattcatgatgatgttagacaattcatatgtggtttagcccatggcctcatgggttatttgaggtcaaaagtgaccaaatattttgtgtctaagtgccaccaaaatgcagacttcaaagaatctgtcatgctgcatatcctgaccctggttctgtgtcagtggtccttgggctgtgagggacactgcatgtgggcctgtgctctgatgacaactgcagggctcacaaggaaaggcttataaaatatgaatagacaacctccactccatccacctgtccctccctttcctctttctatcaataatgcacagctggtgaggagagatcaaatacaactcaaatcagccacttcctcagccaagggttctaagcaaaggtatgtcagaaatgaagaaaatgccaagttcctgacttcgatttgaaaatataaaatataatatttctatataatatgtgttaagttgttttttatttttgtttgtttgtttgttttgagagagtctcgctctgtctccaggctggagtgcagtggcacaatcttggctcactgcaacctccaactccctgattcaagtgattctcctgcctcagcctcctgagggcatgtaccaccacacccagctattttttgtatttttagtggagacagggtctcaccattttggccaggatggtctccatctcctgaactcatgatccacccccctcagcctcccaaagtgctgagattacaggcgtgagccaccgcgcccagcctatgctaggttttaactgtacttttatgatactgtccaggctgagattaagagcaatttcttactgattaaatatattaaaatatattaaaatcatataatagtgaatgtgtatgaatgtaatgcatttcttccaagtagactaagctttagtgtagagtcaaatgaatactcctttaaatgaaatagactcttttatctgtcactttatcctaattcaatttccttgctaaaattaaaaaaaaaaaacattttattgtatctttttatctgagaaattcagtttatcaaaatttacctcattaatattttacataaacctcttaacctagtcagagtatatatttctataactcagcttcagaaggaatgaaatatgataccataaaccctaggatgtagtgatgccccacttgttcgattttccctcaaaaagttgtatgcagagtctgtggtttttgttcgttgtacccctaatgccttaagctcaagtcatatttgttgagtgaataaagactttccaaaggaatagacaggaagaggatatttaaattgtggtgcatttagatctgcattactttttatcctgtgatgttgtggcatctttcccagccacactgacgtaggggattctttccagtctccaggatgctactcttctctgttttctcctttttctgacctatgctttactctgatgttttccatgtcttcttcagacacagtttcttccccatctaaccagtgttactgagtttactacatagttattgagggggttgtgttatataagtctggggattgggaagtggttaagtagcttttaaaaagagtatcagccgactttgggagtatacacactgccaagacttttttttaccctctcagctaggtaggctacagggaaacatcagcttttacttttgctattgtaacaatctataatgagctagagtgaacttaataaagatcttttatttctgtgttcaacaaatatttataaattaacttctaggctttagtcacttttatcctaagtgctgggtatacattgaaaaactatgcacaaagcccttatcctgatggagcttacaactgaatgataggacaagggaaaaatgcacatatatgtattttcccataaatatacataatatttatacagtctgtcctccatatccccaggttctgcatcccaggattcaaccaaatgtggctcaaacatatttttgaaaaacaataaaaaataatacaacaatttaaaacaatacacatttaaaaatatagtttggcaactattacacaacattaggtattgcaagtaatctaaagatgatttaaagtgaacagccatatgtgcataggttatatgcaaatactatgatattttgtacccatataagtgacttgagcactgctggacagagtaatatgtggagcgtaattttttgtaggatgatcatagaatgcactttatgctttaaatgagtggggatacgaattaagtgacagagttagctatagggttatttgaggttaatagtatttcaagagaacacagtgaaagagggagagagttagtagatgaggctaaatcacaaagggccttgaagggccagaagactttgtattttactctgagtgagactagaaatcatttaggggtctaaacaaagaacagatataatctcatttaaattttgaaagcatcactttggttgctgggtggagaatggaatataactgctaaagaaaaatttatttatgttaaaaaaaacgttaaaggcaggaagtccagcacaggaagagtagactcatcaggaaccagcctacttccatctggttccctctttattctccacctcatggtctaagatggttgtctgtgctctagcgattccatccataatctaaccttttctttgaagactttctggaatgtatgaccgttcagcagcacaccactggcgagaattcagttcagtgaccttgcatggttggagggaggctggcaaacacattctttaacctagccatttgtttgcctggtcaaaaagaaaaaaaaagtcaaagattttgaagcagtcctcttactgaacatttagggaagcatcccaaaatagtacaaggaaggaggcatgtaaattgaggaactctatttaaacaactgaagctcaagcccaaggacttacaattgggtcttttgagagtgagcatgtggacaacccattgctcagagtacccaatcctctcccctgccagctcacagttggctgcccaccctactcacccacacacattgtttttgtaaactttgtagcttcgtgcacttcttcacaggagccctctcaaatcacagattaaattatcccactccgtattaccctgtcattaacatctataccccttttttatagaacttaacacaatttgtaattcatgcatgtataattattttattaatgtttatctctcttctaaggctttaaaagacatgagcaggatccatgtcttcttttcccatcattgcattttcagtgctaacacaatgcctgatgcatagctgttgactggaaatatctattgagtaaataaacatcgaggaattcacttagtattgtatagtagaaagcaagacatggggttgaatgtaaaggtcttagtgctgaactctaggagactagaaatttcctggaaacattaaaataaacacatcaaatctattaaatatttttcataatatatgttgctcatgtatgtataatgaccaccataataactcattccctctttataacacttttaaaaaattcaagagtttggaaagctacaatttaaatatcaaaacatgatattatttttcaggcctaaatgatagtttttattctattgggaaatatatggaatgtcttttgaggaaaaacacctgctcacactttcaattttatactattttttggtattatgtttctcaataaacttagataaaaatggtataaatcattaatataacatttttaattctttagaaatttaaaaatctggatgaagaatgttacagaacacatggaactaatttcagaggaaggtcagaaacataaaagcaaattacttggacaaatctgagaactatttttcattaaaaatcgacgtccaaactcatcattatatgcattgttatacacatattttatgggtaaggataatggaaatgcatttggaagctgtcgttgatctccaggaaggactgttgctgctattcaatgaagcagagagtttgtctggcatgtgagacaagctattttttttttttgagtcctgtggaccatgcagatagttgatagcttctcacagccagactgacactttttaggtagaggtttactgtagcatacaagaaacagtgacctgtgatacagccaaatgactgctaaaatggtatgaaaagagatttcaactccctatggcactgctaatgtacctgaaatttttaaagtgcattttagtagttatgaaagtatccagacagagagcactaaagtctggtggtgccctcactttatccacctcaactcccagcacagagaggcatcccctgattgctggtatcacttgtagtggaaactcaaggcatgtgcaagattactttattctcaatttgctcttggccctctctgtttgacctttgcctctctgctgagatttaaagttagtggaattcaggagagagcttttattttgatatacacttctgtagagactgacctagaaatagactgacttattatatgtaagtgatccgatttgcatactgattctctctcactgaaagcttgagccatatttgactagtgagctctaggagatagatttcatagcctacagtcaatacagataatcttctgattttcaggggtacattcttctggcaaagctactataagttaaaatgacattagtcaaattttctgccagaagaagtcacaaaagaggattctttttgaagacctggtagtcagcctcttgtagataagaagacacttttagctgggtgcggtggctcatgcctataattccagcactttgggaggccgaggtgggaggatcatgaggtcaggagatccaggccatcctggctaacatggtgaaaccccgtctctaccaaaactacaacaattagccaggcatggtggtgggcgcctgtagtcccagctactcgggaggctgaggcaggagaatggcgtgaacccaggaggtggagcttgcggtgagccgagatagtgccactgcactacagcttgggcgacagagcaagactccttctcaaaaaaaaaaaaaaaaaaaaaggacactttcactaaggaatggtaatgtatgaatgaataagttgaatgaatgatatatttgtagaatataagactagactgtctaaaggtcatatacataaaagaataatgcattgctaatcatagaaaaatacatataatgtgattttgaacaaaattgttgcttactgaagatgcagtttcatattttgcaatgcttctgagaagctgctgaccttagagaaataactttatctctgtattcataagtatacatttatcagtggggttaatacctgtttcacagattgattttagatgtagaatatcagctaggagttaaataaggactggatttgtatctcagctctgtgaattagtagaagggaacccaggtgatttactaggactttttaagtctgaatgctaatagtccccaatattcattcccttttactcacttttggtaatcatccaccttcccttggagctatgcaaagtcatatgactaaattttggtcaatgggatatgaaaggaaatgatgtagcacgttctcaatctcacccttttaaagcacctctttaccctccactgctctcagatacttccagtgggcttgaatgtagacatagtcatggaaagctggtttcagccatacccttgaaagcaatatctggaggatgacagaaccaacagacagaaagtatctgggtccctgatgattgctcttgtgaaacaaaggtgccttgctaacttgcctgtaactttcagctgccatgtaatagagaaaattctatcttattgaagccactgtacttgtgtgtctgttatggtaacttggcctgtaaccagaaaaccatcactttgagcaaagcactagaccccagatttttactttgataatccataaacatgatgtataatagtaatgatactacttataatgttatttttaagacaaagcatttcatgggaggccaagacaggcagatcacttgaggtcaggagttcaagaccagcctggctaacatgctgaaacccaggctcaactaaaaatacaaaaactagctgggcatggtggtgggtatctgtaattccagctactccggagactgaggcaggagaatcgcttgaacctgggaggtggaatttgcagtgaaccgagaccacaccactgcactccagtctgggcgacagagactatgtataaaaaagaatttcaagccaggcacagtatgcgtgcctttagttccaactactgggagggttgtggcaggagaatcacttgaggccaggatttcaaggctgtagttggctaagattgtgcctgtgaatagccactgcactccaatctcaccaacatagtgagccatcatctcaaaaaaaaaaaaaaaatttaatagtgcctggtacatgatcagcacataagtgttacttatgcttattttgtattcttctaattattattatatctgttatttgtgtacttaaaaaatcataaaattaaatattttcatcctcaataagacatattgagcaatactaaaagaaagttgtgattgaaaataaaatctttatcaatgtcatgaaattattttcttttttaaccacaaaaccctttcaagaaaattactgaaatgagtttttgactttgatattgatgcagatttatgtttttctattgttatatgtgtgttcctgttacatatgagtgttttgcattgcaaattttcaaagaacatatactgtttataattattttttacctttgaaaaaaaattttttacttttcaaagttgccatccaatccgggctggtactttgatctgatctgtgaccttaatgccacatggttgttcttaaacagggtttggaacacctcatttaaaaaacaagtgtggatggcttcccctttactgaaatatgttgtgcaagttccttaacatagcatctgaaagactttttcaatctagcagcaaattagttatagcagtgggcattatcctggtgtattagtttattttcccattgctaataaagacatatcagagactgggtaatttacaaaataaagaggtttattggacttacagttccacatggctggggaggcctcacaatcatggcagaagttggaaagcaaggaggagcaactcacgtcttacaagaatggtggcaggcaaagagagagcttgtggagataaactcccatttttaaaccatcagatctcatgagattcattcactatcacaagaagagtacaggaaagacccgccccataattcaatcacctcccacttcgttcctcctacaacacatgggaattgtgggagttacaattcaagatgagatttgcgtggggacacatacaaaccatattattctgccctgactgctcccaaatctcatgtcctcacatttcaaaaccaattatgccttctgaacagtctcccaaagtcttatttcatcattaactcagaagtccacagtcaacatctcatctgagacaaggcaagccccttctgcctatgagcctgtgaaattcaaagcaagttagttactttctagatacaatggggggtacagacattgggtaaatgcagccattccaaatgggagaaattggccaaaacaaaggggctacaggccctgtgcagtccgaaacccagtggggcaatcctaaagtgccaaaattatctcttttgactccatgtctcacatccaggtcatgctgatgcaaaaaatggattcccatggtcttaggtagctttgcccctgtagctttgcagggcacagcctccctctcacctgctttcatgggccggcgttgagtgtctgtggcttttccaggcacatggtacaagctgttggtggagctaccattttggggtctggagtatggtagccctcttcttccagctgcactaggtggtgccccagtggggactctgtatgggggctccaacctcacatttcccttcctcactgccctagcagaggttctccatgagagcaccatccctgcagcaaacttttgcctggacatccaggcatttccatacatcctctgaaatctaggtggaggttctcaaacctcaagtcttgacttctgtgcacctgcaggctcaacaccacatggaggctgccaaggcttggggcttgcaccctctaaagccacagcccaaggtgtaccttggccccttttagtcacagctggagtgactgggatacagggcaccaagcccctagactgcacatagcacagggacccagggcccagtccacagaatcatttatttctcttaggccttcaggcctgtgatgggaagggctactgtgaaggcctctgacaggccctggagacattttctccattgtcttggagattaacatttggcttctcattacttatgcaaatttctgcagctggcttgaatttctcctcagaaaatgagatttaatttctattgcattgttaggctgcaaattttccaaacttttatcctctgctaatcttataaaactgaatgcttttaacagcactcaagtcacctcttgaatgcttcgttgcttagaaatttcttccacaagatagcctaaatcatctctctcaagttcaaagctccagaaatctctaaggcaggggcaaaatgccaccagtctctttgctaaaacataaagagaatcacctttgttccagttcccaaaaagttcctcatctctatctgagactacctcagcctggatcttattgttcatatcactatcagcatttttgtcaaagccattcaacaagtctctaggaagttccaaacattcccacattttcctttcttcttctgagccctccaaactgttccaacctctgcctgttacccaattccaaagttgcttccatacttttgggtatcttttcagcagtgtcgcactcccagcacaaatttactctagtcatctgttttcatgttgctgataaagacatacccgagactggacaattcataaaataaagaggtttattggacttaacagttccacgtggctggggaggcctcacaatcatggtggaaggtgaaaggcaaggaggggcaattcatgtcttacatgaatggtggcaggcaaagagagaacttgtgcggggaaactcccatttttaaaaccatcagatctcatgagactcattcactatcacgagaaaagcgcgggaaagacccaccaccataattcaatcacctccaaccgggttcctcccacgacacctcggaattgtgggagttacaactcaagataagatttgagtggggacacagacaaaccatatcccctggtctgatttttctcaatgcgttgcacatacaatcgccatttttttcattttcataagaatctttgttatctatgacacttattttaagaaggtgtttcttagaacagtacttctgacagatggctcatgagaactgaaatatatttataaaaaatcatgatgtattgtggattattctccttttttgccaatacctaaggtgtgttaagtattaaagtctctgagcagtccttgagaaacaaaacataatttgctttaacccagtatttccaaacatgttactgaaacacattctttattaatctcagacaactagttgtttggatcccattttgagaaaccttctccaaaatattgcagtcgttagtatcacaagaaatgccattgcccttctctcatcgtcacagacacaattattatactctccctttgatctgtgctgctgtatcactttaccactttattgtgcttgccttactctgttttgtactcatatttctttttcacatgtgactccctatatggttgtgagttcatttaaaatagtaatctgttttcttctttctgttatcctacattttctaatagagtatacggtggggaggtcggagattattttctgtatttcatccctcttttggttggagtgtgaatgtgtaagttttaaaaaataaagcatgttaagacttaatcaaatgagagttgcctttcaaatggtctaagatgttgtttgtctacataattcttcctttgattataagttttatgcaactttattggaatcttcatctagtttcagaggctagaattcccttaattagtttaaacagaaaaatattttctaagtattaaatcactgggtagggttgatgaaacagattccagattgagctgtcaagaacaagtcccaaaatcatatcactgagttaagtaagctacccaagggaggtaatgccttttctgtgatgaaaagccatcggcttgagaaccagttcatagagccaagatcaggatccattcactgtcaggaatcatgtatgctccaaaaaccacaaggatcaggaaaatacgtctactattgctagattcagaactgtattagacttaattcaatcagccatgtctagcccctactggcctccaaaaacgatgatggaacactggaaacctagctaatgctgcagaaaaaaatagaaaaagtattttcttcatggccaggttttcaaatagaaatgaaaacactgcctctgcctcactttagttttccaaatcatctttaattgtatctgattggttgaatttatcatctaaaaccttggcaccagtgagtttaggaaatgtatccttctttctagcctttactatgctgaaaggcacacagaaggaaagtgaaatggatattggagccagaccaaagtttatcagactaactacatatctcaatcttttattcatatgtaatgttctttttcatttacataccttcttacctttctgtgtccctctctacttgatttcctgtgccctactctctttcttcctgcagtttatggcgtttgagtcaatagtgagacttttaccttcccaccttaatgaattgtatacaataagggaggagcagtggcacattcatgaaaacatatgctctgtgttaatattctaatttattcataacgagcatatctaatttattcttctcaatatttccatattgtagatattatcccattttagtaatgacaaaactgagtcactatgaataattacatatcatagctcatgcatcctataaatttgcgaccccatgttctcttcatattactatgtagtcaaagattgcctgcaatttgaaacacactgaactccattttcccacattttgcctggaaaatgaaggttgagaatttatagcacactgtgcaaaaacccatgttactgtttgtcatgggacctgttgtatggtgaatagcacagttttacttatgcatacacatcaattcttacctcactgaaaggtgatgctatagtctctgaacctcagcatctacttcagcttccaattgctttagtctctgaggcttcatattgctggatattttacatgctctgtcaagtcattctagaaaaatcacctactcattagttcagcacaatggaaatttgtattatctgccataggatttcttcatatttttcacttgtattgtctttacttgttaaatatccattagatatgataaaaatctaattaaatggaaagcctgctaatgcagtctatgatattatgaatccattcctgggttcatagtatactaaacatcaatacaatggatataaaactgtggctatttagctacactttaattccctctgaaatgccactctggcatcagttgaaagaaaaatggaagaaatgtgttttgaagctttacattcattttaacagattaggttctagttccctaaaataccaagatttggaaatcatttaactcagttatgtcttttcacttcattgtattttacttacagattctgtgctcataatagagtaactgtaccagaaaagaagcaacaatgataaacagctctataaacaaacataaacttttagtgagatttacacatttgaagatacttctttgctaattaaatgtaaaatatactatgaaagtctttctaccttcttttaaagtccaagatttatatctaatttaatatatcacaaatattaaaatgtataatgttatcaaatattatataaaaaatagttaataccataaatttaactattcccatacagtttaatgaaaaaggtaaaataccttaataatttaatttttgttttatctatctattttaaagaggccacagtcacactatatcccttagcaatcatttgggaataaaagaaaaacaataaaatgtaaagtataatttagagctttttagtaattttgagacatatataatccacaaatgctgctaaagaaattatcctgtcatatttgcacatttagttgtacaagcatgcattaaaaatatatatatttaaaagcccttctacattccatatgcttttaagtgcaaaagacaaatagattgaccaagaaaactacgtttcattacctttttgaatttatacacaagtgatggggagatataataaaagttataaatataactaaataattttagttgcatagtgctataaagaggaaaaacaagacccatgaaaacatgtaagtgatctggatccagcccagccaaggcagaaggtggaagtaagagtataagacctcactttaagctcagagtgaaggataagcaggagttagacaggaaaagtagggacaggggtgaggcatgggataggccatggagggagagcattccaaggaaacaaaaaatctgatgctccacaaaatgtcaacaacccacggccatgggagaagagactggtagttctaaattatatgaaaccttgtaagatatactgaaacttttgaagaaatgcatcagtgtagcttttcttattctatgattgggcatgcattatttgtagagaactggggtatcattgatacagaatgctactgaggtactttacttataatgtttattgagaatgaaattatcccatacatttagattaaacaggaatgaaggaatgaatcaagatattctaatttcttccagaatttttctttcctttttttttttttttttttttttgagacagtgtctcactctgtcacccaggctgaagtgcagtgcagtggtgcagtggtgcaatcatggctcactattttctccacctcccagtctcaagtgatcctcctgcctcagcctcctaaatagctgggactacaggctcacaccaccatgcaaggctaatttgtgtattttttgtagaaatggggttttgtcatgttgcccaggctggtctcaaacctctgggctcaagcaatcctctcaccatggcctcccaccacatgtgatctcttccaaaatttttctaaatactttagtttgatttgatctattcttattttgttatttgaagttaccaagtaactcatttttctaatctgtccattatttagaggtaagtgataactgatttatgttcatcagagtttgtgtggagactgggcttgggaagatccattttgcctgtaagactataaaggattctctttctaaatccctccaagatctttacaatcccactccatttcacattttagtaaaccctgagttatcattagagttagtgttaccttcattttcttcttccaattactcagaatgcataggattcctagggtagcagttcttaaaatttaatgggaagtttgattcagtaccctgggatagagtttgagaaatctgtgttattaaaattacctttcgctcactgttttgcaagacattcgcagatctgcatgttgactgttgactactgtttccttgaaagtaaaacagctgacaaaaacaaaattatcgatgacagaaaaaccatcaagtgcaagtaacttgagtctcagatcagtcatctctaaataagacagtaaattttatgtatcaaccttccaagaggaagtctatgcctagagcagacttgctgatatagcaaactaaaaatgcaaatttcagagtatgctaaaaatttctatttttgttcctgttaatttttcaaaggaattcaagccttttctgtatacatacgggctcaggatactgccatgcaagtcttatttttgcatcccaacattagctggcatacagcttgcagaaaaatacctagactacctggcaagagtctaattttcactttcttgtaacttgcatctttgttactgttaaagtattgaaccagcaaataggtttagtttaattgtcagagtaattattggccttaacacatggcctcctctatcataactgtcatccttcacactgttcatttcttatgtcaaggcccagaaaatgattaatgctcacaacaaaaatgagattcattttttaaagttactaatgtcattgcacatacagttaatgcatacactatgtttaagaaatgagtaattctgcaggtagattgtcatacggaagataattttaaaaaattgacctctgacacactataggaaggccatatgattctgtaaaaattaacagatatgttttgataatctcagattaaaacttttattccttttattttgcctgagggaaaaataactggtatatgtatgagtgtgtgttaatctttcatcgctataaacttttgaaatatgttcagtgccatgtttgatataaatatactttgtaaaataaataacttttgtgaaatattgggtgcttttacaagataccagtatactgatacaggaaaattagtcacagtatgacacactccagggcaaatcttgggtcccatagatatatagtatatagtgagtcgtatttgctcactgctactcaaagaatcttcagtaattattttcctttgacacaaaaataaaataattagaatgggatatatacccagacacacatgacatccacacatacagctacccacacagaagggtcggtgtgagtgtgctccttgtgtagggggagggtatgtgtgtgagggtgtgtgtgctagaagaggattacattattgagttgcataataaaactgttacggtcaattagattattttttgactgttcgtttttaacttttataattaaagatctaccaagaaagtaaatgtgctggaaggaaacattagcatcttgtgttgaaatgttgcctcattcctctgtaaagattgttctctctacttctataggaatacaataaaatgaaggtctgctattttcattttaaagaagatagttaatatattaactaaaagaagttaatatattaagtgaatattgagtggaactcactctagagtatattaatgaaggtagtatatcagtatgcccctgataagaactaaagaaatgctttttctgatccctggagaatttaattatgaaagagagccagggaaaaaaatgatgtgaagtgatctgaaatatgtgaaataattttatcacataattaagaaaatgattgcaatgcatgaaagtttggctcaaacaataacttaaaaaattgaataaatttctcagtgtggaagtaagtcctccgctcatggaagtgcttatgtaaagactagataattcttcatccgagatactagagaagagattcccactttgcctgggagactggtaaaaattaccttgaaatctttttcagttttagagctctgtggttctaagcatgtataagtaggtttctcagtattgtgctgaattaatttctttaacttacctgtgtaaacagaaattttttaaaaatactatatactatgtaatttttctccccttttatgaccttgctgttatagttcagatagtcattatgttttgctttgtgtggtaataacagccccataccagtcaccgtgcctccacgtttttctcatccagtccaaatccacttaaaaattgtatttctccatatgttgctaagggaaataagaaatccttagcaaagtactcaaggatctgatactactacttttctttttagcctcacctcttgatgcatcgcttcttaaacgagatgatctggactgaattgtgttctccccaaaatttatattttgaagtgctaacctcaacgtgactatatttagagatagggccattaaagaagtaatgaaggttaaataaggtcatcgagccatgccctaattcattatgaccaatgtccttataagaagaggaagagatactaggaatgcatgtgcacagaaaaaaaaaaaaaaaagccatgtgaggacacagtgaaagtggccatctgcaagctgaggggaaaggccttgggagaaaccaaccctgccaacaccttgactttggactttcagattccagaactatatgagaaaatacatttctattgtttgagtcacccagtctgtggtattgggtattttgttatggcagccctaggggactaatacagggagtcctacgtttaacccccatgcaaatgtgtagagtaactaatcagtttccttaatggaagagataactaggcatttagggtgccactaggatcacaggtatagaagcccaggatgctgctgaacatcctacaaagcagaggactgccctacatgcttatttcatccacagtacctgcccctcttctcaacatgctcatcccactgaccttatgttcccatctcaatgagaactttttcaacacctcaaagagaaatacttgatcctcatttataccttctccattgtttttttttaaatcgacaattgctctttatgtaatgaattttgaatgatgtttgccttttaatttcttctactggcctgtaaactttttgaaagttttcatgaaatgttaaaccttacatccctcgtattcttcagagcaatttgtatgattttgcctagtatattcctaatgctcctgatctcaattttattttgccccattgataaaaatagagacaactagtaccctctcgtgtacattctgactgataggttcagggacctagaaatgcatatttttgacaacggttttacgacattgtgacaagctggtgggtttaagaagaattttattcaatcttaatatactaaacggtatatatctttggcatgtgtaacagattacttatataagtaaatgtagcatttcacaaattggcaataataattttatggcattatggaactttagagctataacatttcagctaacaggtatgaacattgagcgcagagttaaagtcttacagaactaagaattatggtcagaaaatatttacaggccatttcccatctagtgcttattagtggtatttatgtgaagttatcttcagtatatcatggaaatttaatgctggttcatgccttaaagataatctattataactctttattatataaaagagcttaatcctcagagaattttggtgaattgacaggttaccaagatcctaagaatgacaccctatcacccttatacttggctcctatttattcctaaaaaatcatttcagttcattcactggaaattttcattctatcatatgtatgaaatgtaaggcaatatcaaaaattaaaattatcacctaccctaaatatgcaattgttagagatgcttgagaagaactatagtagcatttctattgaagcaaacaagaattttttactataatttttaagtagtaagtaaatgtgtgtgtgtgtgtgtgtgtgtatgtgtgtgtgtattttaatctgtgtccttaacggaataaagtcaatgttggggattaggttacttttggatgcccctatcacacaatgcaaaccaagtttctggcagaatatattgctttcattactgttcattttcataaaatctttatgtaaataatattttgaatgaaaattgatgaatcttagattttctcattactttctttctaaactaggaagcattcagatgttaataacagcaatttaactaaaagagcttaaagacagatgagtttattctctcgcacaccaaataaagctagaagtgagcattcctaaatttacaaaagcatcaggaagcaggtttctcatattctgctctgatgtccttagttatggcttccatcctaaagatccaagatgaacctgcatgtccaactatggcatccttgttttgaacagaaaataaggaatgggagaagggcaaaaagaacatgtgcaagatatctccccttttataatgagttttccaataagcgccactaataacatatagttatatttcattagcaactaccatcatctggaataaagtcagggctttgttactatgaagaaaatacacattggattgttagccaacagttttctcaatgtatgctttgttattatttttgcttctctttagatgttttcacctttgtttaggggaatatgttcataaagtctagtttggaataattaagatgttttaatctttggtaactacagcatgtgatactaaaaacatttggcatttgcctcaagaaagttaatagagagaaatgaaaaaatatcaacttaattactgagaaaacaaaactaatagagaaggtgatacatagcagcatctttgtgcacaaatcacaacacataatgcataaacttctgttttcctacaggtaaaatcttagacacgcaatttagaaactaataatagagcaaatagtggataaagtcatcagtgtatgacttgtcctattggtcagattactttatttctggagttaacattaatcattatttttgttgttgttgagttgttttgtttttagcaacttaattcagactgttttaaataagaatgtattttagtaattaattcaacatcctgaaatattactttcaaatggacagtgaataattttgtcacatttaaagccagctaaagaaatcttaagattcattctcaaattatttgttttctcaaagttatcttgtctgatgtttagaagttttaacagtcttcatttttattacataacttttggtactataatgagtataatttaaatattttaaatcatttaaacaataaggaagggggatgaaagaggaagtgtttctaatgaggcaaggatccttttatgccttttgtagcacttagtccttaaggtttcaatccttatgaagaaagggtgaatatggacttccttcagataagtaaccctggcaaggtttctgtccatcctctggcctggtaagccctctcttcaaggtaatgagtattctgtgtgtatttctcttcctgcagttagactgttcatgcatgataataaaaagctaaagggattaaaacttgcttatatgccttctgatcttacattataatgtgtccacccatcaaactatttcattaaacattattattttcctaggacattggcaaatgactagtataattacttgtcagggtttttgatcgttttcttttgttttatttttgcttaaacaacaggtacaaaaaattttgccatgggtaatcccagcactttgggaggccaaggcaggtggactgtgaggtcaggagtttgagaccagcttaaccaaaatggtgaaactcggtctctactaaaaatacaaaaattagccgggcatggtggcacgtgccttttagtcccagctacttgggaggctgaggcagaagaatcgcttgaacctgggaggcagaggtttcagtgagctgagatcacaccactgcactccagcctgggtgacagagcaagactccctctcaaaaaaacaaaaacaaaaacataacaaaacaacaacaaaaaaacaaacattgccatggctattaagcaaaacttacctaggctttaattactatgtaatttttactttttcaaatgtgtggatacaaatcattaattgaagttttcaaacttacctatttggaatcagtaactaagataagtttatacacttatttcccatgcaatataaacttaattattttacatttcaaagagattgaaatcttcaaagtgataaaatacgcattaatcttttcaacacattattattaaaatgatagagatggttggaaattccgtgttatgattttttaaatgccaaattagttttctaccttcataattttttgcagtatataagctaactatgtatatatgttatactatttattactgggattttgtttttcaaacttctacttttatcagtaatagaaaggagctattgagggattctaatattctatatattgatcatagtgctgtttacctatatttttacgcgttacaatttcacatatgctacaaggtcattaatcaaaattaatggagctgtacattcgagatatgtacattttacagtatgtgtgttatagctcaataaaattttaaaatatgtattggacatcaatttacagtttattataaaacaaatgatacactgtattgatattgtctgcttatttttctttttatgaatagggactttattgtttttactttcggtatccttaatgcttagtacagtatctggattttaatggaggcttcataagagttttctgactgaaataatgaaaagtacattgaaacagaaaagtcaagtttttcaataccatcaatttacaaatgtatatacgaaaatgcatcatatttagatatggctgttgtcctcaaagggctgacagtaatactgttatttatataaaacaatttttccttatcagtaaaatttcttcaggaatttggggtttattggtactttgagagctctcctaatttgtgctaaaattgtatcattaatataatacttttgctaatgcttatttattatcttagcgttttcagacttttattattgtcaccataattttaaacctacaaaggctttactttgaaggtccattttacaaaatcaagatgattgaaaacacttacctatccatgtgtttctttatattatatacatatgttttcacttaagctgcctgtaaaattcttatctgagaattaaaaataggcttaaccaagtcctttattcatgctatgtatgttagcattaggggaaaccctaaaaattttactcaaagactatactgttcaatcataatttggaagactttaattactaggctttcaaacctgtgattagagagcatgatcctgaggtagatatggaaatgtattaccagtgatgaaaagacatgattgcaaactagagagaagagtgtgcgtaatacatgatgagtgggaaaagataaagatgagaaagttggtgtcctggagggtcgaaggtgagattgctcagggctagggaagtggtttggaggagatttaggtcttcatcttccaacagaagttggattagtactaaaagaggtgacagagggtgaggctacttaaggaaattttatagggaaacttaacaggagaacagaaaatgatacctgttttccaaccttgttagagataaaataactttttctaaggtactttgaaagcaagtttatataaatatttacttttattactcttagtattatcaatgtgttggtaaaatgtccaattgagttaatacattattattaaaattattcatatatcatgattttatgtataaatagcttgagatatgttatgcttataaaattatattcatagctaattctgatcacttaactgaactttcaaatagttctgaagcaagggctatgaagacacaatttggaatagctatgttgtgggttttcaaatgcttcttttatagaattagggttggcttagaaagtattgttttcacccgcaaaaatggcagttttacatgattcagtattacagttagaagtgtagatttgtcaaagtattccaaaatgctagcaaataaaatcagagaatgttgtattgtttccttactagatattgccttttaaaactctgaacataatgacgtaatagaggtcattaaaatccaattagtaaaagtgtctgaattttttatgtgaattaattcaaatattaagaatatcaaatcattgttttctttagatgttttgctctcattttaagtattcacttacttaattttatgtcattagctctaaaacaaatacacaaaaggccagagttggtggcttatacctctaattccagagttttggaggcccaggcaggaggattgcctgaggccaggagttcaggaccagcctaggcaacaaagtgacacccagtctttacaaaaaacaaacaaaaaattagccgagtgccgtactgtgcccttgtagtcctagctactatggaggctgagaagggagggttgctttagcccaggaattttgaggttacagtgagttatgatcatgctactgcactctagcctgggtgacagagtgaaacactctctctaattaaaaaaaaagtctataacttcaactttgcttcctcctattttaaaacttcttaagacgttttggtaattgggaaaaatttttatttttgcttgccactaaatcaatgtttttcctttcatatgttcttaatattaacaaacttatctgaattttacccttgggaatgatttttatctggtgtgcttttgtttttatgatgatatcaaatttatacattaatatcacctataaacaagctgattttaattatgtagatttggataagagcatgtttcaaagatactgctctttttatcatctttacttctatatcatgtaaatatatagtctcaaaaaatttaaaacatatttccaacctcatatgaaatttcaacgtggcaaaacattttttaatgcatgtccatttttattattttaacaaagactggagcttttgaaacattcccttaacaaaaacttcactgagaatgattgttaaaattatgtcaatgactacctgttcatccacataattttataaattatacaatttgtgaaagttataatttaatatattttatctaatatgcattgtatttcatccagtcaggcaagtgaaattcatgagtatatacttttactcttaaagattctggtaaaattaaatattatataaaattctgaggttaaaaattaaatttttgaagtgatatctgtatcatatttatcagaaaatatgaaatgataaaatgtgaaatgtttgaaatataagaaagtcaatactttagtgtttgctgacagtcttatagtacttagaaaataagtttttatatatttgggcatttttaggttatgtctatatttcttttcaagctatcattgatccaaatacagtgaaaaatagcaaaccaggtgccaaatatgatccatgtgaaagtaattttctcatggagaagtatttttctgtcttcaagcgtggcagtaaagattttgatccagtggtctgagctgtgtcatcttttctttaggtagtttaaagtcatttgctttgttatgggtatgaattatgtggtattaagtactgcagtagcactattaaacattatatcataaatccttttagaatgtggaaaagttagtgtctgaaaggccatttaaaattttccactttaattccaagctaggggcagttttgtgttccttttttttttttttttttaacaactgacataatccactaaaaatgataagtctcttagtaccactcatgcatttccagacaaaatccaaacattatatagattgttttaaaatacagattgagattgttttaaatttgtagacaaacggatgaagctatttctataaaactgaagtagcaatattaattaccatcaacagccacaatattaaaatattctgcaattccttgaatctataagtggcagaaatacttcattatgaagtagtttgtttacattaattcttcagctctctagcttttaattttttaaataaatatatattaaatattgttttctttcattaaaactgcaacttagttttttccaagatacgtttttgagaaatgaggagaaaaaaaatataagaaattaacttttttaagttctaagtcagtattctaaccaaaaatacaattttctactttgagtgctatctttaaaaacaggctatatttaaaggcaaccctggaagaattaatcttgattgttcctgtatttctttgattagttaaagaaactaagtcacaaaagagatattcctagtgttttgtcattttcagtatgtgtgtagttaagctttttaaattcctattttacttttgatataatcctcttagtgaattttttctgggaaaacatgctgtcaaacacacaaagtaaaagaaagacaagaaacagtagttaacaaagatttttgaatacttttgtgtattttagctttaaaaaaaactttttttaaaactataaattgtaaattgacatttcaatacctgatcatggaagcgtttcttgttttgaaaatgacagggttggaacatatgatttaagtttaacattagagatgtcagagctagcaatgcattaacacaatttctaagatctttagctaaacaaaggcacaagtgttcatggaaatgagttaggtacctctagaatctaaaaagttaaaaagaaaacaactgtatgtatgtcacatgaatctgttgtcctgaactttattcctgtgtcttgaattcatgcttttcttttaaccttgcctaaaacttcttgtattttatctaagtatctgttggcttcctgtctctaacatgccttccctctgtaatccagttattaaggaaatgttggacatggaccctagtttaaatataaataaaaataaattttacagttcctttttggggtttgataactttagtcaagaagaatttactgaccaatatttatcgtgatatctgctttgaaaatgagagagtttgaataatatttcattctaatagttttacatgtttattttacatcactatcttaaggcttttttaaactctatattttaactctatattctttttagcccctagatatgtgctgtcaccattacaaggactcagggacacataaatgattgggaagaaagaaagaaagaatattcaattcaaacactgaggacccttcccccttgcaaatgggcaagatgcaatgataatagggcatcaaaatataaatgtgaatataaaggtagattttagggtgctggcaatgttaaaatacattatttaggggttttaattggcaaaacaaaaagaaaagctgtcatttgatgatgctgtattcattattacttactctgaagaggcagaatattctcatgtatttttagacttaaaacagaccacagttgaacaatcctggtgaggggagagggaggaagttcccatctttcataccaaatttaaccgaaagctcaattaaatagattttaatcagacagctaattaaaagattacaaatgcagacctttgaaaataaggacagaagtgtcattgaaatgaatagcaacatgtgacaagatgaaatacctacagaagagttggtgcttctgagcagcacctttcctaaaagtcaatatatgtttgggtgatttctggtgttttgcttttacaaacacaactgctattatcaatactgcatctgaataacggtttctctagagaacataccaaatagtgtagtccatttatttatttagaatacatgtgttgagcccttactctgtggatagtgttctaagttactttgataaacataaaagacaaagatcccagacacatcaagtatatattctaactgatagaatcagatgacccaaaacaaacataaaaaggtgtaattacattttacaagactataaatgttatgggattttaaaataatagtgagcaggtgtaaggagtcctaggggttccaggaatgaaaaagaggtgaggaattttaaatgaggaggctcgtgtaggcttcatggagatggttacattttagaaaaaagaggaggtagggaattatccatataaatatttgaaggaagacaagttcaggaggggacagctggtgaaaagccctaaggcaggagcatgactggtgtgtgaaaacagcaaagactgcagcagagtgatatgatgtggaggtaaccttaaatgatggcatcacttaaggttttatagttaactgtaagtgttttagatttttctctgagtgaaatgggaagccattacaggatgttgcccagagaggtacataattattacattctagaagagtccttctggctatttcatagaacaaatgaagaaagcaaagttaaaagttaagaaaatgattgagaggtgttaccattatcctgataagagatggtgctgcctcctacggtgatagaagaccgatgacatgtggttggattctgactatcttttgaagtgagtgtcatcaggattgtctgaccgcttgatatgcagtgtgttagagagaagagtgaaggataacctcgtggcttttaggctgtataaatggaacatacatggggagggttgcaaggatatgtttccaaagcaatgtaagagttaaatatatataattaaacattccaagagggtgatctaggcctaatataattgtggatatatagatggaatttcaaaccatgagcttggataagattatcaagagtgtgaacattgatggagaagaggggagaggcgaggacatttctctggggtattctagcattaagtctggggaaataggaagatgtagcaaaggaggctgaaaagaagtaaccaatgagttactgggaaaactaaacctctcagactaaaggttgagagtcaacaatcagaatcagaaatgaggaaattattgttgaccttagcaagagcaggtgttatagagtaatgaagacaaagtcccaactgaagtggttttgatagagaattgaaagaaatgggaaaggggaatatagctaactcttctttcaaggagctttgctgctaaagaaagtaaggagtgaaatggttgaattataagatgcacatgtgttcatccttaaaagagaacatgcaagaattttttattcaaatgtttttcagtggttcacattctttttagaaatatgaaagcattctcatggatccacatcctcatcaatacttagtattatttatcttctaaattctaatcttgggtgtaacaattatataaaattatgatcttaatttttattttcctgactacaaatcagattgaacactttttcatatgtttattggacattattatctatcttaagatattgattttaaatatgtatatctatcttgaaatatctattttgaaatgtagcaggttttttctcttgagatgtatttttatctgatatttttagtattttttgtatgttttataataaactttttgacaattatatgttgcaagtaactttccaggttattggattctctttgatttattcttggatgaggaacagaattcttcttcctataacacattctttgaccattcttaatttaaagcatattttaataaatagtcacagtttttcttttaatttaaaaatatttgtattatttacttaaaagataattttgtcagatatacaattctggatttgtggttattttctattagcatttagaagatattatttcagtgtctttcagtttctgttgcttgagaaaccttgagaaacctagttttagactaattgtatgtcttttgtaagtgatctgtctgtcacaccctttccctcacacttgctcttcaaatctacactttatctttgctgttttgtagctgcactataatgtggctgagaattgttgatttttattcatgttgatttacatacataaggctttgatatcactgttttcaggactccattagttgtgggaattgctaagtgattatctagtcaaatataacctgacttttattctttccctttgggatttcagttggacacacgttagattatcttactctgtttgccatgtcttttatcctctctcacaaatttcattgacttgcctgtctcttatgcctttgaccaatcttccaattaactctctcctctttcggatctattgtactgtttacagtacaatatccattaacatttctgtgtttgttatttctaaaatgtgtatttgacttttagtatgttatctgttatttataatttcttgctatatatctttgatactttaaaatttcaatctatttaaacgtatttattttattttctgctatggataagtacaatatttgatgtccttacagttttaaatatttagttgttggtatttctctgctggttatcacacacgtccactgatttctttatatattttcagttttatactgtgtgctcatatttgttagaagtcaatatgagggaatgccaacagtctaattaggaattgttttgttcaaagatatgtgtttccttctgctggaagccagggaaagctgccagtctgagacaattacagagttcctgttcagtgcaaaagactcagatgggactcctcaatttctggtgggacccaggcataatctccagattttctatgttatttttagcatctgcactagagtaacctagctttagtacttgcttaatgtatgtatatatgtatgtgcgtatgcgtgtatacatatataagtatatatagttatacatataagtatatacacatctaaatatgtatgtgtacatagatacttatttatacaaatatatgtatatatttttttacaaacctatctgtctacttagatttggattccatcacctctaaatataagctctgtaaccttaggtcattttttaaaactttttcctaacctttctttcttttacaaatctcatatttctcaataaatggcaactaacattgttaatatacttatgttccttcaacattagaaaaaaatgtgtctttatttattatcatattttttggacaaggtcttattctgttgcccagtctggaaagcagtggtggattcacagctcactgcaggctgaatttcctgggttcaagtgattctctcacctcacctgtccaagtagttgggactacagacatgcaccaccacgcccagctaattttgtttattttttgtagagatagcagtctcactatattgcccaggctggtctcaaactcctagattcaagcgattctcccaactcagcctctcaaaatgttgggataacatgcatgagctactgtgcccagctttttaagaaaaaaaaaaaaaaaaagtgtttttaaaataacctttctcctcctaaatcctatgtggccagtaaatgtatctttcataaatattttaagttgggaatttgtcactttttgttgtgttttgttttcttcttggaagcattagagtgaaggggcaagcaccggggcacaggagccagactgctgagttttaatcccatttccactacgtaagccttatgttaccttcggcaagtttattttaatctctatgcttttgtttatttgtacaacagaagaaataatagtttctcctttatgtgcttcttgtgagaatgaatatttgttactatattgaaattgcttagtttaatgctgattctcggtaaatatttactatgattatcagaacaaaaaaaaattatatcccaaattgccagaaattgttccagcttactaatgaaataccaaaaatgagaaagagaatgacttttttttccttcttaattagtggtaagtttatggactgtggagtctgtctcaagaggtttagattcagccttattacttcccgccagtatcacattaacaaacaactcaagttgtcaaatcctcagatttcctacctacagaataaggaaagtaggaataccttcctcttagggctgatgtgataacttaaaaaaatcactaatgtaaaacatctgagtacacaatctgcacataaaaataaatgtcagatataatttttatgattagttttacttaagaattgtcatctaaatttcacatgctatcaaattatatgctttaaataaagaattatacagtgctaacttccatgtgtgctttcctaacctgttaggaagctgtagaaaacagaataatcagtttcaaaaaagcatgacagtaatatgaatgaaaatataataaggaaagttaatattaaactagtgctatggtgtctgttgtttcatgattataatgaaattgctaaaccatcactgaattgtgtgaggagtttccaggtgagatatgcaatcaataccctgagacagcagtaaccctttctttaggcagaactttataagcagtgttagttccatgattttacccaaacaagacatcacaatacaaactcgaattggaagaactctccttggccagatatctaaatttaacaggaatttaagaggttctttagtgtagggcctcatgcagcatgtgttgaaaatagtgctgaaaacaagaaatatgtaatatatggatatacttaaataaactccaggctgtcttgtttccataacattggttattttctgccaatagttttgtcctcagtgagccgtggccatgacatggaatctgtccaagacacttggtgaccaagagcctctttctagtaggagtctgagctgaaaatagcttcctgaattttttcagcatcatgcatttactgtgcagctttaagctcttccctgaacacattattgtttaattacttactgtccaatattatattatgccagttatgtaaggactccagtggacctcaagcatggtaataaaatcactcataaggtcacgtgaagttcagagttgttagggaggtacgttgcagttagcttttgcctcttcccacagtaatgttcattaatacctcgtgtgagacactgttttccttgtgtagttcagaatgctactttacttcctgacccctggaaaccaggaaatgattttattagcaggcaagagaacacacacacacacacacacacacacacacacacacacacacacacactgtcactctctctctccctttctctcttagcttttgtcccccaaagttgaataacataatttttgggaagaggaagaatccttggcactgaattgtagacccatatggttcttggagatatggtctaaaaatgtaattgtttgaaaactttagtgaaaacaaagtttgtgatactatagatttatagagcatagagaaatagaaattttccacatatttgctatgtctcccacttctgcataatgaggttgaaaaaagttactatattttaatttttttgagtgggagtactaaactaattgagtattcataatgccagtctacgatctgtaaagttaaaaaatatttttgaaatatttaattccaggaccagcgactcataatatccattttttttttttttttgtcattttgcactttcttaaagcttctggacataaataacttgttggtaaatctagtatcttggctttccctttgtcctcctacattaccttcttagatattccagaatcataacattttgcgtaaagagagtaattaagattttttatattttaaagaaaagaaatttgtttctgtgttcatttatgcaccagttccatataccaggtcagtggcagagctgagcagtaagacagttttctccgttttgaatcttggacgttttctgcctttgtatcctgtactacactgcttgtcactttcacatcctatggttgtgtcttgtttgattattttgcctagaatgttcatttttttgcctaatttttatgccaaaggaagtctcccttccttaaatattccaatggatttgctcaactggttaatatactcaatagcaaaaataggtacttcagtaacagttgaagtgtttgggactttctgagggtggagggtcggaacagggagaagatcaggaaaaataactaatgggtactaggcttaacacctgggagatgaaataatttgtaccacaaacccccatgacacaagtttacctatgtaacaaatctgcacttttacccctgaacataaaataaaaattaaaaaaaaaaagaaaatagttgaagtaggaatgaatgtctgtagggccaatcaggcttacttactttgaatatgttatgcatttaatttattttagaattattaatgaaaataagccttctgttagtagaatatgtgttttgggagtatttgagctgaaagttggctctctactttctcttgggcatgctctaccactttctcagacctttcatacttttcaatagtgaaaatctgctacatgaaaggacagaacacaaacaaaacccattagctcaagtcttcattaaaatgttgcagacaaggtaagaacagctttaaattgagtgttcttgaagacagcaaagaatttaaagcttttataaggcagaatggagcaggtacattgacattcaattggttactgcacaaatttttagaaggtagggaattagtcacacattagagtgtaggggcagcaagactggaatgccgattagtggccattgtttggaaaattgggatttagcaagaggagtaaaaagtaacataagagacaacattattgcaaataagtgtaaatcttttctttattttatttttttgagtcagagttcttactatcagccaggctacaatccagtggcacatgtaagctcactgtagcctccaactcctgggctcaagtgatcctcccaaactggtgagattacaggcatgagccaccacaaaaactttactttaaaatgaaacataggcaactcatattgcaattggccactggccactctcttctgcctgcaaatttataacaccctatcaccctgccatatatatatgtgtgtatatacatatatacatgtatatagtttatacattatctcttagttattaaaagaaaaattgtatggcaaaataccaaaacaagattctcttccatgtgtgactagcttgcagattcacacagaagccatggtttctcacttaaaatcatttcataaattgatatgtttatcctcattgataaatagtgaaactaattgactccaaaaactgccgaatatttgcaattgaaacattttatcctcaaagtaaacagacgtttgtcctagaagtaacctggtgagtgaaaaaagaaaagtaaaaagaaggaatagagatatccaaattctgatattctaatacagttgactcttgaacaacataaggtctaggggcactgacaccttgtgcagttgaaaatccatgtataaattttgactacacaaaaacttaactatcaaccggctactgttgaccagaagccttactgataacacagagtcatttaataaataattgttttatatatatatatatatatatatatatatatacacacacacacacacacacatatcctgtatacttacaataaagtaacctggagaaaagagaacattattaagaaaatcataaggaagagaaaatatattcactattaattaagtggtagtgaatcattattaaagtcttcattctcatcatcttcacattgaaaaggcagaagaggggcaagatcaggaggactttgtctggctgttttagggtggcagagcagaacaggtggaggaggtggaaggggaggcaggagagtgatatgatttgtctgcaaccccattcaaatctcaactcgaattatatctcccagaattcccatgtgctgtaggagggacccagtgggaggtaaattaatcaggtgggctggtctttcctgtgctattctagtgatattgaatacgtctcaagagatctgatgggtttatcaggggtttctgcttttgcttcttcctcattttctgttgccaccaccatgtaagaagtgcctttcacctccagccatgattctgaggcctccccagccatgtgaaactgtaaatccaattaaacctccttttcttcccagtctcacgtatgtctttatcagtagcctgaaaatggactaatggagagaggcaggcacattcagtgtaactttacagaaatatatcataatttttgcctgacttgttttgctttttcacttctctaaaaatgtgtctataccataccaatccttcttacaccatgtgctttactttcagtgtcctattcctagaagtatccatgtcacaaaataagtcaaaaatagtcttgaataattggaaccttctgtcagattgtctattgttaatttgatttctggcactgcttcttctgcatctttttcctcattgtctggaacgggttcaaaagcactcatctccatcaagttgttttctgttaatttatctgatgtggtgtctattagctcttcaattcctccaagatccctatgttgaaacccttcacctccctccttttttatttatatatttttgccacatccacagtttctttcatgatttccttgattggttctgttgtaaatcctgtgaagttatgcacaacatctggacagtttctttagtaggaatttactgttttagactggatggaattatggatttttttataatgatatcatccttaatactgtaatcattcccgacttccatgatgttctctctattaggattctcttccatagcactgacaatattttccgtagaatactgcatgcaatgagtcttaaaggtctttatgacccttgatctagaggctgaactagagatactgtgtctgggggcaagtagaccacttcaacaccttaagtattgaaatcttggggttctgggtggcctgggacattgtccaatatcaaaagaactttataaggcagtcccttactagaaaggtacttcctgattcagggacaatcaatggaaccagtatagaaaaagaattgtcattgtcccagccttcttgtacaaccgaaagactgacagctcgtgttcatctttgccttcaaggcttggggattagtagctttataggtagggcaatcctgatcataaacccaactttatttgtacataacagtagagttagcctattactggagcttgcttctcttccttactaataaatgttctttttcagaatatatatatatttttcagagtagggcacttttgtctgcattaaaaatatgttcaggcagatatcttttcttcttactgattttcctaatggcatctgggaacttgtttgctgcctcttggttggcagatgctgcttctcctgatatcattctgtacatcaaacctttataaaattatcaaaccatcctttgctgggattaaattctagaactttagacttttccccttcctcgtcagataatgacttcacttgttctcaaatcatgttagagtctataggtaggctcttttctagcaattctgcacccatgtaaaagctatatttttcatacaagataaaaagatatttttcaaaaagtggaaggtattttgcacttgcttgcacagttacagggacagcttcattaattttcatttctttttttacattgatccttaatgatagattcatttatcttgatatggaagacaaccacagctccaggcctccgtttatagtggatatcaagtagttcaactttttcttgtaatatcttgacttttatctgcttcttgggaacacttctagcatcactagtggcacttcatatgggtccccttgttttatccaaggtttatggtattgcattcaacataataaacaacatgcaagaaccatgagggatcacttttactatcatgcatattttactagagagatgaactgttcatgtagaaacaatgatcatcacatggcattttaagcacatgctcataagacttgagctcattgcaatagcaatgggagttgcctatgaaattgtgatactagcacattatgcagtatagtgaagattatacattgtggtttaatactagatctttacatttgtttacatttctttggactgcaaatagcaccatgtgctaaatgtatgcacatgttttgcatatatttttaagttaacgtaaaagttttaactctttcaatagatttgcatacacttttaagttaaaaattttaactttttcaatatatttttgtatattttatgatagtgaatgatgaaaaaaagtatctttatattttatgcatttatgacatatctaactttttctttttttgctatttctatgctacatggttcatctgcaaatttttttcaaattgtcacaaatctacaaaatatttttcaatgtatttattgaaaaaactctgtgcacagactggacctatgcaattgaaacccatgttgttcaagggccaactatacccaaatgtacaaatgcaaaactacactaatcacctacacttacattctaaagtaacaatcaaatgtaatacagcaatttaggttgaaagtacaatacttgataaagtttttactgccttaaaaattgttattttaatggagcagtcagcctgcttccttgaatttacttttttaaggtcctgaatcaaacaaagataacatagtttgaaaattttttaaatgtttctttaaaaaagggggggttaagtatcattgtttttaatattttcattcagtaaaacttatttgaaatgctattttctatattttaagaagcggatatttcaacccacctattttgatttcagacacgttaacatgtatatgtgaaaataagtcatattttgtaagaccttgcctaatatctaataactgtattttaattttatgcagcattcagcaacaattgtacctgatgagctattaaaagtgtgtaaatcaaataagcttatatcaagaatactaaaaaaagtgacaaggcaaacatgtcaacatagctaaatatggctctaggattgaatgctgttggtgttagtcagtcaggatttccccttgtgatgtctttctggtattaccattattgaatgtttacaaattaaagggaccactgctaaaaatatgggattgagttgcatatgcatgccccttaagagacccttagagatgatttacaagaatgacagaatctaactttggacatttggttagttttcacacctccttccctcttaaaacttgcattcattaggagtaactctctgaagaatctctgtcttaataaattcagatccatcaactactttatgcagtgttgcagtactcactgtttatttgttaataagtacctgaaattactttcccactcaatagatacaggactgcaaagtagatgttctcctcttttgtactttttttataattagggtacagagttaccaagtcagcaaggaaggggcactttgtatgctacttgcatggctacgaattaactgaaatagcagttaaaatgttcattttaaaaattatgtaagtgtattgggttcctaaggctactataacaaatgcacactggatagcttaaaccaatggtccccagcctttttgacaccagggatacgattggtggaagacaatttttccatgggggctgggtagatggtttcagtgtgattcaagtgcattacatttattgtgcactttatttccattattattacatactcaccataatgtagaatcactgggagcccagagcttgttttcctgaaaccagacagtcccagatgggctgtgatgggagacagtgacagatcacccggcattagattctcagattctcataatgaaggcgcaacctagatccttctcatgcacagtttgcaataaggtcggtgctcctgtgataacctaatgctgctgctgatctgatgggaagtggagcccaggcgataatactggccactcacctcctgctgtggggccctgttcctaacaggccacagactaataccagtccatgaccctggggacccctggcttaaacaatagaaatttatttctcgctgttttagtggctggaagtccaagatcaagatgtcagcactttgggattcttctgaggcctttctttttggcttgcaggtagcctccttgtcactgtgtcctcacatcatcttttttcttcgtgtgcacatccctagcatctcttttttatacatttcctcttcttagaagaacaccaatcagattgttttggggcctaccctaacagctgtcatccatttaaacttaatcacctctttaaaggggttacaaatacaaatacaaaacagatacagcataaagtcacattctaaagtactggaggttagggcttccacatgtgcattttaggggttcacaatcctgcccataacagtaagtatcgttttctcaaggaaaattatttttgatagactaggtcaagttattctctactcagcataattataattaaacaattttaagcttagctttttaatgcctagggatgcttaaacaatcatattcactctgttcctatttcctttcatatgcttgctcatagtaaggactcagtaaatatttgttgaatgagtaaattacaattcctataattaatataattctcatttgcactacgtcagttctttttcatatgctatattatttgctcttcaaacaagactctgattaggtaatctcattacccctttttatatattaataaagaaaaataatcagcaatttatttaacgtgagtcagttaaggatatcagtggaatactatattttttctaaaacaggacttcacccttctgaagttagactaactgggaagatggcatagcaaaggaaatgtcagtaacaaagacaacaacaaaaatcacataaaacagattaacaaaagagaaaggaaggaaggaaagaaaaaaaagaaataaactcagcaaagcaactcgaagaggtagccttgggataagaaataaaaatattgaactaagaattagttaagaaggaatcaaggttgtagattgacacaacatgctaacataatagagtaagcaaataggaaataaaatagcacatatatcaatatggaaggcatatcaattgaaggagaggtaaccacagtcacatatacatggttcagaataacaaaataatgtgtttacattactgctgtttacagccagttggaactggcatcatattcacttttgatacttgtgggcattcagaaacaaagtgtaaagcataataggacgatcttcaacttcagtatggtacaggggagaaaaaaaattctagagagtcatgaagcccgatcatctgattctggtattttaggctgtcaggactcaagacattatgcctaggccactcttggacagatttagacccaaaaatgttttccatataataagatgacagttgaaagtcccaggctaaaatcttaaaacacagaacagtgatttcaatctgaatactggtcccactttttattaacccctgtcttgctcagttacttaagctctcttaagcctccgttttttcatccggaaacataatgataaacacggtgattacattaaaggattgttgagttagttgaaatatgcaatgcatatataatgtgtcacatagcacctggctcattgagtattgttgcaatgcaatgataaaaacattaagcacttttcttagaatacattattacatgaaatgtgtctttaagaaattcttttagttctctgagaagagcccctgagaaaggcagacaacacactacgggctcttccagctgttagaagttcctcccaaggaatcatctctttgccaatcatttatcttgtggataacttctgtgtagtgtgtcttgtcttaaaagtttaacatatgttcacaatattatgctaagtttatggcatattaatcatatggatgaaattttgttattttttatgcaagtaatttatttctacaaaaacctctgagcaaaaaccctttacgcttctctcttcaattcttaaaattccacccccattaaggtaaacattgtaaacactgcagagtgtaccttttcttgctttaatagttgcatataagtattcaaaacctgtattatagcatatagatttctttgttttatttaataatacatattattctgttcttcaaattgattacttcacttaagctacataacttggtcatctttacatgcgaatacttatttataaaatatttttgtaatataagcatatatataagcaaaagtaatataagcatatggtaaatttagtgtaataatacatataggctaacacaaacagtgcaatgcttaaatagatgccaagtacttttctggtgccttacatttattaactcataatactcataacaaacccaaaagttggactttttcttatccttattttatagataaagaaactgaggagaaaggaagttaaatcgctattcctctgtcacacaggtagtatgtagcatagccaagattcatacctgggcaatccatctctggtggccatgaccacacaggtatacaatgaaataccacattgttttttttaaaaaaaacttcataatatactatcggatgatttttaaattttattaattcttatgctgttaattatgccaatgttttcattataattttggttttacttgtctatcctaagttgtactttttaaaatacatatacaatattttttagagaagttttaggctcatagcaacattgactagaaggcacagagattttccataaagcccccgtccctacatacactcacagccttctccattatcaacatcatacacaagaatggtgcatttgttaaaattgatgtacttacattgacacattattatcacacaattccatagtttacattagggttcactcatggttttatacattctagtggctttcacaaaggtatataatgacatatatccaccattatagtgttatacgaaattgtttcactgccctaaaaattctctgtgctttgtgtatttatcactgcctccacccagccctttgctagttgtactttttgcattaaaatctactctatctagtatatatcataatcattgttgctgcaagagaatccaatgatgttgttttcacacagccattgaaccaattccagttattatacaagtaattctgtttctactgcgttacaaagctaaagtttgcttttcatacaataaggtgccagtatatatttggatctatttgtgggctccctattgtgtttcccagctctctattattttattcttctgagcatgtcatactgtttggttatagcagctttatagtaagttttcaaatcaagtaggaagatgcctccacgatatgttgctgattgtgttattaccaggcctcttcattccaatgggaggaggttagggatagagccttagaataagtctgaaccactaggaatggtatcactgctgcatttttctattttattaatatgtagaaccatatgtgaatcccaaagaaagttcatatgagaaaacccaagattgccctcacagatctaagagataggatagaactatttattgctggcttcctgttttgaagacaatatttgttgtctaggtaatatcaggatattttttggagactttgtttttctctctcgagggatgttcacaatcttttggtgctaatttcctcttaatatagtgctatttttttccatacaaaatttgaagtagaagaaaaaaaataaagaattggtagccattaaccaaagctggcattctatttccattttcacagtgagactaccattttaaggaattcaatatccctttgtgatcacaaaagtaaggtgtaattcaggagttttcctggagtccccattagatattatacaatgcatattttgtttcaatatcatggagttttaacacaaatgtaaatagaagtttaattatttatatagattcaatgttaaatataacaaagacgggaaagaaaatatattattttgatgtcatttttgttttaacttttcctaactgtggatactcttcctaataataggtagcccatatgtcattataaaaaaatgtatttctagaaattcaggtaccccatcaaccaatctttgtatctcctcatataataactttttctgtgtgtttatagaattttaagttcagtgaaaagattttcagagcattttatttttgcttctatctggagcccactcacatgtgtttatcttcttgtttttaagggggaccccaggcatgaaagtaattgcttttattgcattgaatgctaaaaggtatacagccatacattctttttgtatttgtttcttagagctgctgtaacagagttccacaaactgggtggcttcaaatgacaatgagactttattctctctcagttctggaggcaagaagtctgaaatcaggatgtcagtagagtcatgctctctccaaaggctctagggatggattcttctgtgccatctaccttctggtagcccctagcatttcttggcttgtggcagcatcacttcagtctgggcttcacagaggcagagattggagtgatgctgccacaagccagacttccttctgtgtctgtgtcattacatcgtattctttttgtgtgtatctgcatccaaatttcattcttcatataaggacaccagtaacaacagattaaggcccaccctaacgactttaccttaacttgatgtcttccaagatcttctttgcaaataaggtcatatcattttttagtagacaaataatcttactatgttattaaagtaattaaatcatatggaaaaatattctatttaattattgtattttacaaaacatttcaaaggatggatataattcagagataaccattaatattttttgcataggcacaaaatagttctagttttaaggattacaattataatagatatgaatactggcaatttatgagctgaatgtcatttatatcatatgtcaggagaaaaattctgtagaagatattgtctagtttggttataagtaaaaaaaatggttaaattattaggtgagtttatgtacagatatatactcagtctaacaataacagcaaaacttagtatgtgcattttaataaactatttttcttttgagtaagaaattgttttcttgattagtattctcctgtaagactgctttaattctgtattctctagatataaatgagaattgggaaacagaactaaaaagtagcaagtatcgtataacttaattaattcaccaagattgctttgtgagtttgcaaatgcaactgcaagtgggaagtaaagtatttctagtttattcataagtgtcctagttgaagtctttttgtaaataggctggagcctaaatttaataacctaatttaataacaattttgtctttattgttactaggtcagcagttagcatttaagatgaaaaattgatgggaatgataacttacattatccaactttatgtggttatttgttattgcctaaactccattgctaatacttatactggctaatatttcttctgatttttattatgggccaaagctatcctaagctttgcaagtattaactaatttatgctcaaaacaagtctagcagataggtaactattattatctcattttctacatgatgaaactaagaaacagattaaatttgcttatgtttatccttctaataactactgcagtgcagctttttacaacgatatcgttatttctcttttaccaaatttctgtgtgatttttttgatacttttctctctctctctctgtgcttcaactacctcatttatacagttattttaataacataaataaaataaatggattaaattgggatttcttattgttcccaacaccaaaattctctttttggtgttaatagaaattactataaaaagagaattgtggtcaaatacatttgggaaatacaacatccttcttttgaggacacatcagcattgggtctgagaatttatgtagcaaaagcatttctttcatttgaggtactttttacaaatgtatatgatcagcgatttttatgaaagaaatgccaactaataaaatgtattttggagacatcgtttgggaaattctgaatttagatcctctaaagttctcttgatctctaaaaatcctattatacggtgtttaaaggaagatgatttgcttggtgcagtggctcacgcttgtaatcccagcactttgggaggcccaggcagcagaatcactttagccaagaagttgaaggcagtgagctatgacattgacattgcactctccagcctgagtgataaagtgaaactctctcttaaaagaaagaaaaaaaagtaatttcctctttttgacacttctcatagtttctctatatgttattttttttgagctctttttccaagagttcagattatctctttgatttccctttcaactctgcaaatcgtatttactgttttttctccctactatcaccttcctggcactacacaatcatattttgtattgatcttttctctcatcattatgttcaaatatatacaaattcccaaaattctaaattatctgaaacaatatttctctcaaacatcatttattcttggcccttttatatgtactgtgatttaagggttatattgcatctttgctataaactatgtcaaatctattagaaaataggctatcgacacacacacacacacacacacacacacacacacacacacacacacggatatctaaataaatcacattttcgttaccttaagagattccattcactccttaggataccgaaagaaggacttagaaaactatctcttacacaaagaatttttaaaaatacactggagacttgtggttatattgttcttgttatctatattaaaagattgtataaatgcaataggcttattttcatctgttgttccaaaactgacataggtgttcttcctccattataccttctgctgacccctttcctagtatgtatttttttaagaaaataagccttctttttatatttctgtctccactattacaatatatattttcttttataccaagtaatgtatcttatttgaaatttatgttctgtgctaagtatgataattaggacctaagatatataagagcctgacatatattgtacataccaaatataatctaagatattaataattattatttggacaacatttcatagtttgaaaaaataattttacttcagtagtatttctaatagtattttgatggaactttcaaaacttctgcaaataagttttagtattatttgtaatttgcagataagaaaacaaaagctttaaatgattaactcaaagaaagttatcattacaattgaaattgaaggttatataatatttagataggcagagggcagaggtgaagtcatttcagagaccaaaaaaaagcaaaagtccggggatgaaagcagctatgacatatgttgtgggacataaaaacatgcattttggatagaatagggaatttaaaagaaatatgtcaattgttcacctattatctggaaaatcaatcatcttttattctcttgcaattgtaaaggctcagttttctacatattcatccaatattgttccaaatttcaggttatatgatcatgcctcaatatatgtatttgccttaaatgtttaagaacagattgctttcttgtcatttgatcatttcaacaatgtgagttcgacttaaattgagtatttaaattttggcctactgcaccattttttaaatataacctttttctggaatatctatatattgtgcatacagataaagtgtaccctttgcttattttcagaggactcataaaaaataaaactacctaggcaacatatatgttgattaaagtttgtaccttttttatatttttaatatattttctttctgtgtgcatattttaaatgtgatgtgcaaaaaaaatgtcaaagtaagtatcagtgactcagcaagaaaaggcaaaaaataagcagtgaatacaaggagttgtaattggaatatttctcaaatgaagaatatgtgaatattttatacacataataaaatctataatattaaaaaatacaaaagcactaccaaaagagatgaccatgacatgagacattggccaattaatttaccatatatgcagaaaagtcccctcaaattgtaagtgaaaggagacgttgataagatatgctgaagaaataataagacggaagagaatcagcaggggtaggatatcattataacaacttcacgttctcttttagacatagtttttctaacttctacatttacccacatgtttatgtgtgtgtgcatgtgtgcgtatgtgtctgtctatgtattattttgtggaaatcagcttaaatgaacattattaagtattgtggtaggcagaataatgtctccccaatatgcccatgttctaatccccaaaacctgtgaacatattacctacttgcaaaaaggactttacggatataattaaattgaggattttgaaatggggagattttcccagattatctgggtgattatattgtaatcataagggttcttgtaagagggagataaaagtgtcagagcaggagagagattttttggtgctgcaactgctggctttgaagatggaagaaaagggtgtaagctgaggtatgcgggtatcactagagactggaagaaaccctccttgaagcctccagaaggaacacacagcagagttgaaacatttatttaactccataagatccattttggttttctggcctctataattataagataatgtattcgtgttgaggtaagccactaagcttctggtaatttgttacagaatcaataggaaagtagtaaaaaagtcaaacattttatggtaccaataaggtgtaaatttaaatcagaatttgttactcagtcataagatcagcatatatgattaacactgcttacaaatatttcaccagaattattttagattagaaataaacatgtttaggggatgtaaaatttaagcaaaggaagtgatttaattagaaaaggtaacttccatttcggaagaaactttcaagtcaaagtgaactcattgtttctgctttatttttgtagagcttaagtttataaacaggaccagagaactgaacaactgaataaacatcagtgtactggaaataactgaagtattgggttcaatatcattatacacactattgttttgaggtcacagaacatgaaatctctgggtactttcacccagcaaaatgcacacgttaataaggcaaaagatcgtgaattttttttttttttactattttattcccatgttggctaacactgagaaacttatattctcagttggataaaacaaaatattttgggccaatatttatgctaggataagtgaagaaataagacagtcactcaaaggatatcctagatgagagcattttggtcaaacaaatttacaaatcaaatagggtataaaaatgaatttccttaattttagccatattttacaaatattttcacatagtataattgcggaaataggtccatgatttgagcaagaaaagatactctgccaaaatattaatataatatcttgctaaattgtctcttcaaaagcatcacattttattaatattttcttatccatgccctttagaacaaacattttaagagatagcatgtagtagtatttaaaactaaaaaatcttagttttcatggctaaaactttgagccactttgcaaataaaaataaattttaattgagccttaggagtatgaaaataatcagcagtaaattgaacctgcataaaaaattctgagggaactattgtcaaggaactatactaaaaatttactatcatggaatgtggaataaatatttattagaatcttctttgacccaaatgtcattttagtgcctactcatacagttagtgattgcagttatttgtgagatacagtagtgaatatacgtttaatattttggggaagttgattagctttcctgaatatttcaaatcctagattcttagatttgaaggagacctccaaaatggtcttctgttctaaattgcaacattccatttcgcaatactcctgataggtgaccatccagccccagtttgaaaaatagcatgaataatctccttcttgatctgacattggcaaaccaaacagaaataggataaaacaagatattattttaaaattacattatgctgttatttgtccactgtatcactatagttgcattagtctgcagttgaaggtattacctaccaaactcatgcatttttccactattttattctttattgcatctaaaaatgtatagtttatgttgtaaatatatcataatatttatatcaccaggtgtagtgaagtataaacttaataattcctgttaatgtctgacctgacaccttgtagatgttcaacaaacgttggtcctgttcacttttcatttttgaaaatatagtatttcatctgatagatactgagggttctattgataattcttcaactttaaacataatttcaattagatataagcataattttcatcagatttaatatgacttcaatgttgtgactacttagtataatttatatcatctaatatttgattgaacaatataaatttgaatgtcacttatgtctctgaaagaacttaaaattttttgaaaattcattcagttacagtttctaatttgatgaaattagagatttttaggatgcactttttttttttgcaaatttcacggaacctatccttaatttatgagttattttaaatttttttaaccacagttagatattttcatttttgggaattatagcacactttaagaatttttaaaaattggcatagtgtgtgctactcatgtgacagttgcactaaaatcctagactccaccattacacagttcgtctatttaactaaaaactacttgtacccctgaagctactgaaataatacaatttttaaaaaagaataaaaagaagtgtcaatgactttttatcatttttcacattggcactgttactggtagcccataaattataaaatttgtgaggcatttgtagatatacaaggttgtgtgtaaatctgattcatagacaatcttatgaattcttaccacagtaagaaaaatgaatggaagtgtaatagtaactttgaggatgaaagcttatataactacttttgtaaaatacatttctctttagcaggaatcaaggttttaattttttgcttgctgttttcttaaatttttatttcgtacttatttatttattttgtttttgagacagagtctcactctattgcccagactggagtgtggtggcacaatcttggctcactgcaacctccgcctcccgggttcaagtgattctcatgcctcagcctccagattatctgggactacaggtgcacaccacgcaatttttgtacttttagtagagatgaagtttcaccatgttggccaggttggtctcaaactcctggcctcaagcagtccacctgcctcggccttccaaagtgctggaactacaggcatgaactgctgtgcctggcctagaatcaagatttttagttcacctggtaccatatctaagataaatcttagagcatttaggtacttaatccaaaaatatctttttgcagtatgcaactgtccctgaaatccttgaaataaaaagtataattttctaactaaaaatgtagttttatactataatttttcttttaaataatagtaaaacatatccataccttttttactctgactccagtgtatatgcattggaaaaggaaaattccgtgttttagtatatttcatacccaaattttcttttacttaatattttcagtattatctgtaaaattgctttctttactgtttcttttgtattttgtctgttttgcatgcattaaaacaaaatgtgagggaggacattatttttgtaattgtctattcactgagataaactgaaatgtatatcaaatcagtcattaacccccaaatttacctaaatgattccaaatatcctagtatttctcaaaaacaaattgactcagttttgtgtttttcactagaggtccaggattgtattgatggctgaataatgagtcaggaaaattgacctatatgatttttttcttcaggaacttatgccagttaaagtaattgcattttataatataattttattgtgagtaaaatataaacagtcgacaattaaagtaaaatcatatgaaaatgggagacatatttaacaatgtgaatatcattgaacaaatgtctgttaacaatttaaaagtagcaaagaggtaatcaaataattcaaaatcgtgacgtacttctttatgcttagattcaattttaaagatgtacttatctgtaattagagactgtcacattcagtcatctgaaaggcagtaccagtaaggatcatctaccaaatttttaaatcttgagaataggcattttgcataagtaaactccatttgtttgctccctacaatattctatatattaaaaataacatgtgccaaaaaggcttcgccttagaaaatctgtacaacctttatgtgaacgtgaatgaacattgtttttagcaatagcttattaggaactctgattttcaaataaatatgtgaagatctttaatatatgaatatcagcattttcccaagaaaggtaagtggatgtttattatctgtgagtgagatatatgtcagtttagacatttaaaaataaatcactctgatttaatattgtaatatagattataaaaacattcttaagtggtgaaaatgatctgccaaatcggataaataaaaaagagtgaaacagatttaatcaaaacattctttccatgggaggagggtgtttttggtgataggaactctcttccctgagaaaatggaaatgtatttggatttaaaaattacaatcaacacatggatgaaaccatacatcatataaatgcaaattttacatgtatattttcattacactattaccactgtgattttaaatgtagtatttaaataccaataattaatttagcataatacccctgttttaataaagcaactttatatggtgatttttgttttcttatccaagctgaattatatatagtgatgataagatcactagcatcagatgaatgaaaaactgatttatgctgtacaggtatacaactctttataaataatcttgcaacttgatacagaaagtgtctataattctggcatgtttgacattcccattcagtccaataactcgttgacagatacttaatttgctacttcttgaaggtgttgcttgaagtttccttctacttgacaggtgtctgacagttcagtctcactcagagcttaacaaaatgggaaaagaatgcattatctaaacccctaggtaatatccattttatgtcattttatgactttgatagtatccaggactcaattctgttcctctggatagtgaataatgtgcacttttacttgtggctttttaagatatgtgtatatacctttagatttccttcagactctatcttgaaatgtcaaatctttatgccctgcagttcttaaactataactgatgtttacaatatggactgtgaaggaaattatgataaaaatatatttcctggtcacccactgttttggtcaatttaggctgctatagcaaattaccatagactgggatgcttaaacaacagacatttatgtctaacaattctgaaggctagacatctgagatcagaacgtcagcatggccaggttctggttcaagccctcttccttgttgcaaacaaccaacttatatcctcacacagcagaaagagagcaagctatacaggcgcttaatttcattaataggttctacttaattatctcccaaagaccctaactccgtatgctgtggggatttgatttcacatataaaattttttggatatacaaacattcaattcataacacctaccaaaatcaaaatattcataatacaaataatgctcttagtatctggcatctctgacaaattatttcagctgttttgcttttgaatacatatttatatccattcagatttatcagaattcttcatttaacttcagtacagacacacgcacgcacacacacacacatatactcacacacactttttaagatgtaagcatatgatttcattttagaatcaggcagaaccatattataagtcagtgtccacagataaagtatctaatataaaactgagtttctaaaggaaacgtattttgaggtgaaaatctgtttagcttaccagtgtctatataatatgtgcaaaatccttaacatcgcattgaaagattctttggatctgatcttaccatatatttctagcctaattaatcttctacatttaccctgccagttctctgttcctactcattgattccctaacaatgtaagcagagttcctttgttaagtcattcacagaaagttttccctattcttctctatctgaaaaaaaatgtcctctatccttggagatctaacccaaagtccatgaagcattttactgatactttcattttctgttgcagcacttgctatttcttttatgccatggagtgggcacattttgtatttgtgtcttgtattattgtgacttgatccttggattggatcttattttacttttgatgtatgtggtagtcagaggcctaccaacagatagaacccacacagtaatttggagaaagttttacataaagaataagtagatataatacagtatttatgtaatggaagattagctagtaataactaaagaggagtctaaagaatatagtaataataattataaggagaaaccattgcctctgaagctgagaggtacccaaaaagaacctcttcatcccctgcaaggctgatatccaaactttatttgtgaggacatgcccgtggctcactggctggtggacaaattgctgaggtgctggaacagcaggacttgttggaaatgttttcctctgggattccaaataagtcacccatagggaggatcctaaccagcagcactcctcttcaaagccatctaaggggtgccatcttcgtagaggtgcctcattggcaacacttcactgctatgctatctgagagggtaatggaaaatgctatccacaaggagactgcacattgaaagttaatgcaaagcaacttaagggggtgtggaagatgccatccacaggaagtgctgggcttcggaactcactgaaaagccatcagacacagtgtctgggtgcttctagccaccatgttctataggagccaggtattaaagaagctgcatgctgagaggagcacactaggaccagaaagagaaacctttctccctctagtgtccccccaatgtcatgtactgacagagctcaaaatgtgcaagttcacaagggagaaatatttatcaaacccatctccattattgtagagcaggcagtggggggtggatttggatgtgataatcaatgtattcataattggcacaatatacttgtttattgactctttgaacaaatcagaatttcttacaagatagaaatacattcttaactttccttttgtgcccaggatttttaaaaaatctcaaataaatattactatatttctccatcatattcttattaatatgatataaactttgacattttatgtgcacaagatatatcctaagcattaaagataactgtgttacataagtgcacattattgtgcttagtaagtgtatgagcatgtgtgggcatatatgggtgtatataaagtcaatatttgatttatgattgaccaatttgaaaattaataaaatgggcttgctgaaagctagaaggtagctactttaaacatcagaaagacaaatgacaagtcttggtatcagctagttaaaaacataagtttctacctttgaaaggattatgccacacattgattttcctattaatttaaataaaggtaggtataggaaatttactttagtttccatctttgaatgttataaaatattgtactaacacatgttgatttctgaaatgttataatcttattatacttaaaggataacattggggctgggtgtagtggctcatacctgtaatctcaatactttgggaggctgaggcagggggattgcttgagcaaaggagttcaataccagcctgggcaacatgatgatacttcatctctacaaaataaataaataaataaaaactaactgggcattgtggtgtgtacctgtagtcccagctacttgggaggctgaggtggaaagatcacctgagtccaggaggctgcagtgagccgtgaccgtatcactgtactccagccaaggtgacagtgcatgaccctgtctcaaaaaaaaaaaaaaaaaaaaaaaaggaaagaaaaaaacaaaaagccaaaaaaaaaccaaccaaaaaaaaaacccctcacaaacaaaagagcaatattgtttttaaaagtacattttactggccaagcatggtggctcatgcctgtaatcccagcactttgggaggccaaggcaggtggatcacctgaggtccggagttcgagatcagcctaggcaacatggtgaaaccccatctctaccaaaaatacaaaattagccgggtgtggtggcacatgcgtgcaatcccagctactcgggaggctgaggcaggagaatcacttgaacctgggaggcggagtatgtggtgagctgaaatcgcaccattgcactccagtctgggcaacaagagtaaatctctgtctcaccaaaaaaaaaaaaaaaaaaaaaaagtacattttactaaagatgtaccttaacccatttatgccgaatgtactttaacccatttgtcttcaaatttattcacattaaaaccttattattgctcatacattaatgcatgtttccttgttttcaggtttatgtatactgattgtctgttatatagccaggcaaaataaatgtcagagtttggtaaaggtttccacaaggagaagggaggagtgtttgcaaatgaaggttaaatatgctaaaattacaaaaattacaaatatcttaagtattttctaagaaatgatgcgtaaatatttgctactaaaagagttctggcatttgattcatgtggtctagattcaaattctaccttttcattcactgtttaaagtttacataactcttctggaaaatggggattctaatagtactagtttatgaaagagtttttgtggatttagtaaaagattaaactcattaacaacttacaaagctctgctgtattgaaaattgaggagaaataactttacaataaataaaaactgttaaatttaaaaacagggatatagtgtgcatgtatctgcaattcttctctctcttctaaggtttactttgtacataactacctagctgcccttcatgtaacttagaacttcatctactatctttaaaatctagtcccatgttttaaccatcttggatggttaaaaccttcaatgaccttcacctagttacacaattcagggacccaggagtcaccattaaccctacactactcacattcacatccagctggccactaagtcatgttcaatctgtcttttaaaattcaatttagtatgtttccttcctcatattcacccttaaaattttctttaactgtaaataccagcaattctatatatttttttcttatttggcttaattcatttagtttttcactgcattttatccccgcttttatcagctacattgctgtgggtttaaaaaattataattggatcatattattcctctctacaaaacttttaataccattctctccatacaccttactcctattttcttcaggataaagtttgtacttatcctagatgacattactttatccataggatgaccttaccaaaacctttaagttctagtcttaacctacctgtctagccatatctctcataaggccatatctcctcataaatatctaatgcttaattttatgagaattgctgacaattccttgagattgtttttatgcttccttattttttcaaatcttatattttatctggaatgccattataataatgtttaattgatttgtatcaaaactactgggatttgttgatggcttcttgccttatgttgttagatatttggctttttttttttggagagatggtgtctcactatattgcccatgctagtctcaaactccttggcccaagtgatcctctcccttggcctctcaaagtgttgagattataggtgtgagcccttgcgtccagccttgccaatttttttacacatattatttaatgtaagttctatggcaatttagtgaggaaacagatacagaggagttttatttcatgtccaagtttacagaattataagtggtagagtcaggccaatgctatgtttgccgctaaaaactatgttatccaaaagatgctgcaaaactgacctcaatcatattcatgtgtgtgaaaccttttgtgacacatctacatatgagatattgatgatcatgttgtcttttatgttatcactatatccacaactgtttctgttatctcaggtgtcacattatctcaggtgtcacactaaacttcaactgtgaactttatgtctgttattcccacttaattataaactgataagcagaataacagtattttaaaaatcataacctcttgcccagtgtatatttctcaataaattacatttgaatgaatgaatgaataatacagattccttcttttttttgtattcaacttcacccatacaagagagactaaaagtgtcattagctattatctttgtattcaggaaacattaaaaaagaaaaatggcatttgagatgggtgttgaaagataatgatggagaattttgacaggtggaggtagaatgagaaaaggcattaccaacgaaggcccaacttaataagagctattttgcctatactaatggacagttaacagtctgatttggtgtattgcttggaaatgatcttgctcgcaaacttattagctgttcaatttagttttaagtaaatgggcaagtggcaaatatatgaggaagtcagaagaacctttcttatattaacttgatgagtcgctataccattgaaatctcttacctcacccagagcagcccctctggaagtgctctttcatacttcatgtctcttctgggtgtgtgaggcaaacatgaagtttatatcagacacatatgaatatactcaatgaatttctgcctatggacaactacccttttgcaatacttacttgaagcatgttttctacatgaataatatcttgaagcccaaattatataattgtatctgtaatttatctgcttgatatacccttcacaataattctatagcatataatttttctcatttttaaatatttatgaagaagcttatgttgcaagagcttcattctcactgtatatacctgaatgctgtgataggttagtaatgggcactgaatcagaactatttatttctgtcctacaccaaagcccttgttttataaactaggcaactttactcccagcatgagcatgagcatgagcaaatgttacggcaataggaaagcatagtatcattcaaagaattatctagaaagtggataattttggccaaatctgagattctcagtgctgtttatacatcacaatcacccatgggaggttttaaaacttaggctcagacatcatcacaaatctccaccacagacaaattcaaccccaattgctgagagaggggtcctggcatcagaagtttttaagctcctgagtgattccaatgtgcagccagtactgagaaccactggactaaaatgaagggcacatgtatgggggcggcatgaagagtgaatagggtttaaaaaggaatattagaatcacatgggcaggataaaacccaaacagcctcactcagtaactatgtgatcttgggctagttactaaacttcttgaaatctctattttcctgtaagatggggataaactaaagcatgtaaaatacttagtatttggagtcagtttaattaatggtcattcttactatttaaaaaaaataaatttgaaaaatgataataggactatgttgtggaaatatttgactaccaactgcaggaaaggatattactacgacagcataggtgacaaaaacaaattagagatatattttttgctcagatgcttaaaatattttttttcttttcatatcttgtttgcagttaagtaatctttggtattaagcagttttaattgcaataagcttataaattattagtactccataatgaagagaaatgataaaagtctgtcttgttttgataatatatgaataatagtgagaattataatgtgctttcttttactaagcatcagatatttttcagatgaatagaatttcgatgagttaactaccaattgcgtagtaccatttacaatctcatttttgaaagacactgtcttgaaacaatctagaactgacaaatgacaacataagatactctgctttgcatattaaagactttcacattcacttctcatttggttctgcccacagccctgagacatgggaattaatgagttttataaagtttattggtttttaggggagagggctatgacaagaatccttcccttctaactttgaatgtaatgcttcttttatgacacacatacttatttggaatatgttgaaagtctagaaactaagaattaatatgtaggcaaaaggaccagtgcaatgctgtgaactcgatgtgagtagatcttagggattctaaagggcactctaatgcctttagatttaagctgaaagtcagagaaacagttaagatagcagaaacctaaaaattctcaaaatatcaaacaggcagagttaactctaccaaagtcagaatgactcaaaacactgttagcagcaaatgaaaacaaagaaagaaaacagcactatgcaacctctggtttgcttatggtacttactagaagtgagtagtcttggctgcaatgaactttatagaaagtgtttagcttagagaatgtcagaatcctataaataccctggaaatagcgggtggcataatgtcttctgcagtctcgtttcagcagataaacttcttcagttctatttagaatgcattttttgtactacggttgatatttcaggcaacagtgatgtatatacaagtatcttcaacattctattaatttcaggttcaatttttactgaaatcaatatctattaaaattatcatgttataattaataatcttaaattgtacaaaattcctattctcttgtatctgtataatatcaaattagatgtctaaaaatctaatctgattttcaaattaacaaaataacctagaagcaatactataatcatcttctctaatatatatacttaagataaaacagctaattataaacaacttatacatggaagtatgcataaatattgtgatttttacttaacacagtgataaagaaattgatacatttaaataaccatatatatagccaatttgaaatttaggtatactccaaaagtagatattttgaattgatatgtttaactggcttaattcaacataatttaggccagatatttcataaaattgtgtttatttctaaagtaatgagtgcttcttgtaaataattccaatacaaaaatatgtggagcaaaatgcgacattaagaagcacaccaaaattaggatggtcagcgcctctggcaatgagggaatgggattagaagagagaacaaaatggttgacaaccttatctgtcatgcttaatttatttcatagataaagttaaaatgatgaaatgtttctattgataatcatggattctatgtaagaatttgttacagtatttttgtagctgtttgttttttttaagtttctcaaaagtgtttaagatttaaatttgaccatattactaggtaattgatcttgatttcagttaataccctggagttacataaacagaaatttaaaataatatttttgattctacaagcattccacattcattaatgtaatacaagaaaaccagatcattctactgtgatcaacttacaaattgtgttggaatctgcctgcatatagcccaccccctcaataaggcaccataaaagctattttaagtaatattctctcaatcataataaaacacacatagcaagaccaaaaggcagtgattcctttttccatttccaacttgtcctcaagctaagcagtccggcaactcaagcaaaaactgtgtttcataatatgaacagccacttaaatactttctccccatctctttatgtttcactgctggggaagttaataatgattaaagtaggaagattttttgttttaaatcagaaagtcagttgaaagaaacctaaagttctgccataaatatctagcaggtgctgatggccacctgccacacttgcaccagattgtctatgtagccagcagtctggccatcagcagaccagagaggtgcaatggggagtctctgccttgctgcagattccgataacttcttgcttaatttctatggtggtcttgccttctaagtcccagatcttgatgctgaggcctgtggtagcgcagaaccagtagcagttgaggctaaagcacagggcattgatgatattcccaccacatagcatatcaaggtgcttgcctttgttgagatcgcatggcatggcatggcatggccagcattgcctccagaagcacagagggatccatctggagagacagtcacagtgttcagatggactgtgtggccaaagtggttcatcttcagcttgcagttagccagattccgtaccttgaccagcttgtcccagctacagaggtgatagtgttgctgccgttaggtgagaagtggacataagacacctactctgagtggctctccacctggacagtgtatttgtatatactcagggttataaccataactagacggttttatctcaggatctagagacaatctacaggttgtcaatggagaaggccacactcaacacgtccttggtatggcctacagatcatctcatagtggtgccctttgtcagatcccagaagcacaggtttccatctcaggaggctgagaggaaaaagtggccacctgaagagatgattttgtcatagacaaagtggaaatgaccctccagggcatgctgtgggatgccatagttggtttcgtccctgttcaatgtccacatgatgatgattttgtctcaagaggtggactgtatcatgtccagggcagtagcgatctggttactcaggtattgtggccttcaagagtgtcacaaagggtcttctgctctgtcatggtggtggtgaggtcaggtgtcactgcagcaacgaggatgccactcagagagaccagagggacaaacaccacagccagtcctgccacagccctgccacaaaaaagtaagccaagcagggaaattttaatacatgaaaaatacaaaatataggcataggatggaatagtttcactaatttagagtctatgtgaagggcaatattggagaaggtaattatgtacaaaagtatcttggagctggttgaattgtttgccctttgccctttatgagtcacatatatatggagaaaagaagttgtctattgccaattggtacaaggattaaaattaggaactatgaacatttcatggcagaatttttgacaatatataagtaatgaaaaaagcagccttttatatttaaaatatacagagcttatctcttatttgctgccaatccctagcaccctgtacaagattgatctattgatatttgctaaatttgttaaaggacattaataacttattgaatccgtaataggtgacatgagagaaatcagctcagggaagcaaattatgctgtctatagtcacacagatagaaaggttggaacctggatggcaacacgggtctgtttgactagaaaactccaatccatcttcttgtcaactgaatagtatttatatttattagaaacaatcactgaaaagttctagattaaaaatgtatctagatcattgcacaataaaaaaaatcttacatcttccttaagttatgattaattttagtgtgtcagtaataagataaattagttgtttggtaaagaggtgctaatctgataaactctgaaattccttctaagcccttttgtttatttatcttaccatggatacaaaaatggccacaaaataaaagaaggatgtgactattttcctaggagtgtgcattgtccaccccagtgcctgacaggtcgaactgtttgtgatgactccagaatactctgaatcccatcagtaattccttccagtgttgacaatgaaatttagaatagggactggtggtagtaggaacagggatggtgtctatggggttgcctaataactaatattatggataatatctaatacaaagggaccttcaatctggctggtagttcaggggagataggatgaagtgaaacatctctgaaatgtctgagctagataatgaaggttaggccaggtgaacaggaatgttaggagtttgacctgtaggctaagaaagacgtagataaaggcatttttgcctgcttaggctgaggttctcttcctttataaatagaatccataaaatatcattaggttcttatatttgttggaggttattaaaatttatcattacttgtgtatttgaaaaatatatgatctttttattatctccaaatgtttaagtctctgctgtgtagtagctatgatttttttccccatttcttttgtttgtttgtttctagcagtttttgccagctattccctgctacctgtgacacccttttttgctaagaaaatacttctgtcttgggtgctagtttcatggctagggttttatattctcaaaagaataaattaattattaacatatgtttctgaaaataaacttttattatttatttcaaaatttaataacagttgaaagccattaattgctcttttaaaaaactaaagaaaattataattatcagacccacctcaaagctctgcctttgtctcttatcagtccattccccttgcatttatgtgtaacaagtttactcttttagtttatgttaattgctgatatgtctactcataaactactgtataaataatattaagaatttggattgactaagaaattaactttaaattgcctctataaacattaaactttacctttagatattgttttttaggaaaacccatgaagtgctcctttgtaattaataaaataatcaaaataggttgttagaaaaactattaaacacattgatgctatagcaataatgacatgataaccagataaatatatgaaagtttataatccacaatttatttttcatatccacaaatttcttaaaaaaaaggtattaacatgtatcccagaacttaaagtataattaaaaatacataaaattttttttaaaagtactaacatatatctgcccatttaagaaatatttccatgacagacacttagatactttgcaaacaatcgtccacctcttcttctgatttagttcatgtattatgcccagggatgaaaaaccagtagtaaaccagggtacaactagcctaaagagaacctttgcgcaaattacaataaaaaatcatcctatgaactcaaggatgatgaacagaaaaaaattcaccttccattggggctcgcagtctgttgagaagaatccagactgaacttcagcccctactaaaactcttggccaggtaccaagttacatgaacataagcagcagctctgcttatcagttgtgctatggcaccgaggagggttacaaacatgctgagacattgattcttcagctgtcatgacagcgaagtgagtcttaacatggccaaatgccataaacagaacacctccaggcttctgcagtcttgtctgtttgctctaacatctcatacctctatcattatttgctatgtgacatgacacatagcaaggctaaaaccagtcttggtcatactgttcccattcacatatgggtatttaaaggtggatattttagtaagctaggttgcatattattcccatataaatgagagccacctccgcccccaacagaaaccatgttgtcaaaatagcatgtaatgcaaggagccaaggcagcccatatgcaggcctgaaggaatgttcaatagacacctggacattgtgccatcagcaaaaaaggaaacagccttcatgttcttagcaacactggggaactacttaattcattttctggagcccatgttaggagaaatattaaatgtcctaactgcttaagccacttttggtttgatatattgctacttgtagctgaaagtatcctgagtgttccaacttggcactccttcagtgagtactcagtacagcagccagagtgatcctgttaaaacacaagtggcatcttgtcacccttctgctcaaaattctcagtagttttctctttcattcagagtaaatgccaaagtcctttttcagagctagaaatcctatgtaatctgcccttgctctgtctcctcctttcctcctaccttctctgaactcattcctacttatttctctttgtccattttatttaaacagacaaggtatgcatccaacttagggtctttgcacttgctatcctctgccttgaaaactcttccctgatagcttcatggattgattcctaagactcttttgctctttacattaatcttcctctctcattgaggcttttcctggatgcaccatctaatgacgttccaaccagcaatccctaacacaccatattttctatcttccttcctgctctatatttgtccatagtacttctgtataacatgtttcagtttttaattaattatctcatttgtggtctgttattcccactggagtgtaagttccaaaaagaagtgatttttgccagttttgttccatactgcatgtccagtatccataatagtacctaggactcagaaggctcttgatagatatttgtcaaatgcatgaatcatagcagttaagcttactagactacttgcattacattattctagctttgaatgtgacaatttataattatctgtataagataaccaacatatttaaattaatttagtacttttgtacaaaaccttatattgatttgcaaatcagctgatttaaaatgtcaagtattacaacatgagtttttcatataacaattagaaagacttaggcaatctgattttatagactggtaattggtttgattgatctaatgttatttcctttatatccaagtgttctcatggtgtggccttgggatactatcagttcattgagaagagttcattgatatgtttcaggttccatattctaactgagataggagtttttatgtttcatcaaaaatatccaaaattttatgggaaggctattgaaatacacttctcccctccagttacattcctgtataaagctgggccttcctcatatttcaattcatgtttcttaacaaattgagtagaaaatcagataaaagaatccacttatcctctattaagtcaaataccaagggatttgcaagtgttaggcaattaaactattctattttatttaaaaccatttatatttatccaaaaaatatttgttagttatattaacgtttaatgaatgaaaaagcatatatattggaaattatcaggttaattttgggtgcaataaacatcaacaggtataatccacataaacaaaaactctttggaaaactcaatactttttagcaatgtaaagggatcctgagatttaaaaaaaaaaaaaaaaaggagggagtcaatttttgttactatgtcccttctgtctttatttgttaaaacatttatgtgtttaacacctcccagccccgtcaagacccgatattctaccatcctggtagtatcttcacactactgggttttgtttaaatgctaagtagcttttaatcatattatcttaaatatgatttttttctccagccaagacaccaatatttcagagaagccatttcatggcagtgactcacacttaattgttgcatctgatgcccttaagagggtacaaagcagtgtaaatgctcaacgaataaaaaaatgaattaatgaatgaatgatatatgaagagatggatataagcactttccttttagctaaaataaatctagtttgctattttatgtttcaaattatttaacatagagcttgttatattgctgacagttttctttcttttttaaacttgcaggaatatgctgtcaagtcatttgtttggtatgaatctatagctaagtaaccaattttgatagttaacttgatagttaatgttgagaatgtcaaaatatatctccacaaatgatcagattaatagatatgtaagaattcctattgcagattcagtttcaggaacttcctgctaggctttcttgacttcaatctccaactaaaaagtctgagaaactgtattcccctacaactcctcaagtaattggtaatattggtcaaggattgtttcctaaataaaaccaaagccgattacatttgagttgctaaaatcaaaataggactatactgattttagttcccaggtccactttgactcttctaccagtcactggcaaccaaagtttattaagttaaatttattcagaattcataatgactttattgtagaaatctgcgaatagatttgcacttgatagatagacaaaaattacctttgatagaattagtaaattaatagttttaattggattaggtagggacttaagatgaaactgcttaacttatttaagaaaacaacttggtctaagcagtctactagagcacttgtatagaatagtgtgctaattatgtgtttcttatctcttcattaaggtagatttgtcagaatcattctttggcaacattgtttaataattggtttatattgctttatagccctgaagaaaataaattcatatttggttataaatgccctacatttctgacttttaactaattacagatgataacttcctcaccccaattaactcaattaatgaagttttacatttttttctttttctcttgtgtgattttggtaatgttaatcaacactgaaaaacattgtttttcaaaaatttgctagctttttttatgctctgttttagtacatgttgaaacaggtataagtaactaaaagaaggcaaacaagtgtctgtacatattcttcacccactttttgatggagttgtttgtttttttcttgtaaatttgtttaagttccttgtagcttctggatattagacctttgtcagatggatagattgcaaaaattttctcccatcctgtaggttgcctgttcactctgatgatagtttctttggctgtgcagaagctctttagtttaattagatcccatttgtcaattttggcttttgttgcaattgcttttggtgttttagtcatgaagtctttgcccatacctatgtcctgaatggtgttgtctaggttttcttctagggtttttatagttttaggttttacatttaagcctttaatcgatcttgagttaatttttgtataaggtgtaaggaagggatccagttttctgttttctgcatatggctagccagttttcccagcaccatttattaaatagggaatcctttcgtcattgcttgtttttgtcagaagacatttattgggccaacacacatatgcaaaaaaggtcatcatcactggtcattggagaaatgcaaatcaaaaccacaacaggataccatctcatgccagttagaatggcaatcatttaaaagtcaggaaacaacagatgctggggaggttattgagaaataggaacacctttacactgttggtgggagtgtaaattagttgaaccattgtggaaggcagtatggcaatttctcaaggatctagaaccaaataccatttgacccagcaatcccattattgggtatatacccaaaggattataaatcattctataaagacatatgcacacatatgtttattgcagcactatttacaattgcaaagacttggaaccaacccaaatgcccatcaatgatagactggacaaagaaaatgtggcacatatacaccatggaatactatgcaggcataagaaagaatgagttcatgtcctttgcagggacatggatgaagctggaaaccatcattctcagcaaactaacacagcaatggaaaaccaaacgccacatgttctcactgataagttggagttgaacaataagaacatatggacacaaggaggggaacatcacacacgagggcctgtcaggggtggggacaaggggagtgagagcattagtagagatacctaatacatgtggggctgaaaagctggaagatgggttaataggtacagcaaactaccgtgacacatatatacctatgcaacaaatctgaacattctacatatgtattccagcgcttaaaataaaattgaaaaaaaaaaaagcaaaactagcactgaggaaacacctaaagcaatcctgggactcataaacactcccatattttctaatataattctcaaaacagtgtccagttattttaagaacagaaaatgaactgaggctaagaacaataaattatttctccaagatcatgcagtaagtaggacaactgggatttacattgttttttttttttttattctgaaagactccttatgtcttacttcaaaatatttctatgttctctaaaaagtgaactgagctaagcctacgttttgtggtgcataaaccataccaacataccaacatcattatggcattaatcattcattatggtaccactttgctttatgttccaaggcattcactgtcttctagatattttttattttatcatgaataattttccttatttaagcatactattattattattttagtactaataattcaactttatcaaaacacattttttatttctcatttaaaaatatctttaaagagtcataagttaaataactgttctcagcacagactgctatgggcagatgccaagaaataagttctgttgagtttactaagagattcttcatagttttattttttaagttgttttctttctaattttatggttttattacactcttatttaaactaaagcaaaaatacttattctacctaggtctacagtcttcatcactttaagaggaaaacaaagctattccatttaagtatctgggtattgcaataattcattgtgtagttacagaacatatcatagagcagtcatctaacccttctctcagacagccattcaaggctgcctatgtctttctcaggaggagatagaatggttaagctgtcattatcttctagtgccactgaaaggacaatagtttcaatgccatattgcctgacatttaaactgatataccttgggatattgagaaacagaagggactaggggaaggagagagccagtttttaaattgttactatataagaagattctaggattttttcccactctgaattttaacttgcattccatgtaacaaaaaatagaccatgtaaaatgaatatcatcattttatgtctattcttttatatcactgtgaaagaaagcaacagaaatttaccaaagaaccaaaggattgtgaatgacttttcagaatatgagtgagtatgcttcacagaaaaccaaagagctgctcccctaattacaaatggctggtctgagagatgtcaaatgacaatgagattaaaaaggtaatgtacaactcaacaaaaacgtgagctaaatgattggagatccagctgtagtataaagttaaacacttttactctgtagtcagagaaacctggattcaaatgccaatttcgttttttttttttttcaaacctgcatggctttgagcaagttaactggcagaaagcttattttccttatctataaaatgattccaggcatggtggctcatgcctgtaatcccagtactttgggaagctggggcaggaggatcatttgagcactggaatttgtgaacagcctggacaacgtaaggagatgctgtctctacaaaaaattaaagtaaagttagctgggggtggtggtacatgccttagttagtcctagctacttgagaggctgagagaggaggatcacttaagccatggaggttgaggctgcagtgagctgagatcacgccactatactctagactgggagacagagcaagaccccatcttgctatataaataaataaattatacatctatataaataaaccccccaaaataagaaagtaaatagaacataactgctacctacatcttaacatggctctgacgattaatgatacagtgcataaaagactgtttcagcaatgattagtgtataaaaaggatgtaataactagtaatattggccacaaattctattaatatgctttatatgtaaagatatataaaataagtaaggtattaagagaatacaaatatcaacttatgaaaataaaaaaaaggaaagattagtaaataaaaatgagaccgggcatggtggctcactcctgtaatcccagcactttatgaggccaaggcgggctgatcacttgaggccaggagttggagaccagcctggccaccaagatgaaacacgatctttactaaaaattaaaaaaataaaaaataaaattagccaaatgtggtgatacctgcctgtaatcccagctacttgggaggctgaggcaggagaatatctttttttgttgtttttgtttgttttgttttgttttgttttttgagacagagtttcattctgtcacccaggctgcagtgcagtgacgcaatcttggctcaccgcaacctccgcctcccgggttcaagctattcttctgcctcagcctccagagtacctgggattacaggcacccgccaccacgcctgactaatttgtgtaattttagtagagacggggtttcaccatgttggccaggctggtctcaaaatcccgacctcaggtgatccacccaccttgacctcccaaagtgctgggatcacaagggtgaagcaccacacctggccagagaatctcttgaacccaggaggtggaggttgcagtgagccgagatcatgccactgcactccagcctggacaacagagactctgtcacaataataataataatataaaataaaaatgaaatctatttagtcctgttatttgcctgcactttttctctatgcatccaagtggatatagtaatgaactcacttttatcaattacagtattcatagtgttcataagaaataagacgttaattaggtcatagggaaaagtcagtataaactgactttaaaaggtatattgaaagatatggtagatgttatgtttacaaaatccctagaataaatttaataaggcatgtccaacagttgtttcttaaagtatatgctagtgcaagccagaagcatagaggtaattcaacacagcatgaacaatactaacaggagccacagcaatgcaggataactttccatagctcttaatgattgagttgaagtcaagggcacgatgtagactgtcaacatacttccagagaagcgggggaagtctgtaataaaatcatctgacatggactttaagtagttttccataaatattggttaatacaagtcaggttgtgataaagaacagtagagtctaaagttatacaagactctgggatgtactgacacatgtacttcatccataaaccccatcaagggctgtcaagaatgagtatctgttctttcatccagtcataacagtggcaataatgttaataaacaattcagcaaattacttcatgttgccctatagctcaggaatgacacttgatgatctttctttctctgtagcaaatgacttaaaatattcttattcagacagaagaagtaatcatatatgccctacctaacatgagcaagtttttaccatcacataaacagctacagatgaagaataaaaggataaccaattctaaaggactgccattatctaccataccctaaaatattggataaattgagaatgaaattgtattatgaatttttattaatagcatagtgaaaggatgaactattttcaaaatcttggatgttaaaaagaatagttttaggcagcagcttccgctgttagcttattggtggctgtggtaacaggctcctgcatagcactgagcctcctagaatcttcctccagttaatttcctgtgggtgacgatcactcctgagccaacaccagcacattttaacttcttcaggagcagccatcatgacatggaaaactaactgcttttttaaaggatgttttcacagatacctgttgaaatcagatagattcatgtcaaataagttaggtcccaaattcgtttttttagcagcattgatttgaaactgtcagttatgatagagtaatatctacttaaagttgattaagagaatatttattccttgtcggtgtcaacttaaaggatttcccctgaacctttatatttatattgcaatgtaagaaacaaatgctagtactgtgtcaaaagctattgccattccaatgaatatcatcaatatttccttcaacaatatgggaggttctcttttgatttttatttcatatattttcttttgttttgtctaaggaatttcatttcatatctcaggcaaagataataaaaccatttttcaccataaagagtttaaatgtttctattttcattttgctttttattcatttaagccttatgtgttgttgtcatttggcattataacagtggaatattgtctataggtgatctccacattctagcataaagattagtccttttatgagatggagaaatgagggattctgaatttttgtcgtttaatcaggcagtatgcaaacgtcttttatgagccaagcactgcattactggggtatggtaatgaataagacagacacagtttataccctcaagcagcttatactgcatcagagaagaggtacattaagcaaatggttttcaataactaaacacattatttcaaatgtagaaaaggctttagataactacttggttataggtaggttgggaagtactaatatttctttgtgtgatttctggacactgcatttttatcctaatgaggcctgtaatacttacttaggtctgtgtggtgtttgtgatggggatggagaataagggatgagaaagtgtgaaaagacacgtgcagaatgttctgggaatgagatttaataaaacacagctcttgataatgtatcaagtgaaactgccctgttacttcgccttggaaatgtatgatgagaccctgtttcctcaattcagttagcatgggttgaatacctacatagtatcagaaactctgtaatacaacaaagattgaaacagctttacttttctgagaacttattttaaataagtcaaagaatcacaaaattttaatatgatatggcagtgctcaatggaaagtaaaatttactgtaaggagacaaaacaagggttgagaataataaaaaatacaacaagcagctgaaagaggtaaaaaaaaaaaaggtaacaaatgaagatgaggttgagggtagggaaagtatctcaaagtgtcaaaacaaaggtaggaaggaggaagataatctaagcattctatgcatacattaattatttttggaggctgcataagagaatgaagacattgaataataaagtcagataagctaaaagtagctagcagtaggtagagaggcatgtaagaatattataaaaatgtttataattgtttatattatctgtctatctagtacagaggaagttctggttcaggaaattctacagataatgcttatgctgtttctcatacgtatgaggctgtacattagttttacctactgccttctacatcagaattgcatgaggtcctgttgacaaggcagatttcataggctgtagcctaatgccagacataagaagaatttttaaaatgggaccaccccccatgccagttcttacccccaggtgattctgaagccactaacatttgagaataattagataaaagcctgtgacaatttccttccctacatttcctaaaatttacatacacaaatgtatgcatacatataaaccttaaaaaattgttttaatggtaatgagtgtatacactcccctccacacttcgtattgtctttcactttgtccatataacaggaatcccaatatattgtgtccaaatttccctctagacaactccttgacagcagatcacaggcttaatttgattgtggaatacttctacggtagtttctgtatttcttggtgtcagagaccctttatattcttaaaaaatattgagaaccaaaagagctttcatttatatcagaggtcagcaaactgtagcctgcaagtcaaatacaaccagtatcttctttttgtaaatagctttttttggaacagagctactgccatttatttttgtatcatctatagctgttttctcactgtaacgacagagttgagtagtgacagagatcatacggttggccaagcctaaactatttacaatcttgtcctttacagaaaatgtttgctggcttctggtgtatgtggattatagctattgatttttagcacagtggaaactaaagctgaaaaattaaaatcaagaaatatactagcacacattccattagccatcagagctaatgttcaaaactccactgtataatcatgaatgagaatgaaaaaggcaaatagcatcttagtattattaagaaaatagttttgacctcatatgacaagctgaatggatttgatgaacacagtttgggaaccacttggatggtacatggcaaatagcagccgcttaatacatatttgaatgaataagtactaaccaaaaaaaaacagaaaatatttgcattgttatatattacagtttacaaataattttcatgtccatttctactttaggaaaatgtaaggaggcagaaatatcaaggaaaaggattttggtgtaggagatattagagcatgtaggctgagtagaaagacggccctagcctagtaaacagaattaaagacacacacacacacataaatgttaatttaaaatagaccatataaatgcacttaattgacttagtttagtatttggtaaaccacatagactacaaaatagtcccatagtaaaggaaatataatgtaataatctaataggtgggggaatagaagaggaatctttgaaacagcaaagcacagatctgcttcaaaagaaaatcgaaaatcttcaagcgaagattgcttgaggaaattttaaaatggaagacacagggtcatcaaaacaccaagggttcagtctaggtcctgctgctggctgcacagaaggccaatgactgagactgtgagagtattgccaaggaagtgcttcagtcgaggagatgggagttcagtctcaaatccatctccctgaatgactaaaattaggagtttctatagcagggaagaaatgtagaaagcaggaactctgaatggtaacgacacaatcctgatgaacgaggggcctggtgtttcattgtctggatgaaatgatctgctgagtttcagttctttgatactttttaagaggcctggggatcctttcctgagaaaggaactcaaacaaatacaagtttcaagctttaagaccagaagggtccatttctatgtttacccaagaacaagtctccgtgaaactattgggtccgtttcaacactaccttcaaaaaaattggggaaaactgtattcagtgtgtaattccactctagacatagcctgtatttgtacccttcaggttaaaaaaaaaaaaaaaggccatgtacatttttactcatcaaatgtaaccttgaaaaaatattcagtggttaaaattttatgttctgaatttctgtctaaataagatgaaaaatatgaaattccaagaaaaaatgtttttggtgttcagaaatggccaaaggtatttcaacacttcttttataatcagaagttaatttgagaaggggtgtggcatactaatatactattatactgtacctttccatgttttacttggtaaaaagtaattggatttggactaggatctatttattctcatcacatatttaattgcacgcaaatacatgctctatcataaattaacaacaacctaattgtggttaaacaatgtatgatttatgtttgagccgcgaattcaagtccttgttcaaagtctttatggcaaatgtctccttttacatatgtcacttgactataagctttattcctaggagagatatctaagtgctacacagtaaccaagcattcaattaaaataatgttttaaaaaaatgagatcagcaattatgaacctaaactcatctagaaacaatttgttctattacattatcgaaaacaaatgcaaacaaacttcagaaagccatggtgttttacctccttcaatattatattgacattatttgcacagcaggattagaaagtaatccctgtggagatattaagaaaatcatttatttttctgttagatacacaaatgggtgactgtgtattatacaatacataatggcttttaactgggagacataaaaattgaatatcactaccatgtgtgacatgtgaattttgatataatatttataaatattttagtagttaccatttaccagatgggagtgatgtgtgtctttgtgagcatgaaacatcttttttatgataatagtctacacttgagataattgattctgattttgcaatatggatgcaagttctctgtactatatacagtattcctagcttttagcaaatcaaataatcccaaacataaatacacatcaagatgaatgttagtaatccatttgactaatgaatattaaattgaaatgttttacctctgtgtctgctataatttgaaaccaaaaggctgaacaagcttgcatgtacatttctattatcaaatgtaaccttgaaaaaataactttaatattttaacatggagaaaatgacatggaagcccatgttctattagacataaagcattagactgttactgtctatatgaaggtggtaaactaacattcctccatattttgtaatctggaagaaatacctgctcaatctctgttaggaggtgagcagggaactttagccccaattttctttatccttttaggatcatttcctctcctctcagatctctattacctctatcatcacctttctgaaatgctatggatttatttaaagttacttagactagtctttatgtgagttctatagttgccacgagcaacaatacaaataaaacattacagggtcactctttccttttctactgattaacacaatggattatctggccagcgtcctgcttatgaattggtgtgtctgagaatgctatggcagtgattttataagtctttcaagcgagcatgtgtaattttagcatttcttgatgcatccttgaagaactgctctttggtgctttcaatcattttaatgaggtatcttagtttgatttacaaatttggtaaacatgacttggtgttgttatgtttagactttggttcttatttcatactgtgtgttgtaagagttctttttttttttaatactttatgttttagggtacatgtgcacaatgtgccagttagttacttatgtatacatgtgccatgttggtgtgctgcacccattaactcgtcatttggcattaggtatatctcctaatgctatccctcccccctccccccaccacacaacagtccccagagtgtgatgttccccttcctgtgtccgcgtgttctcattgtttttaaaattaatgtttttaaaattaaaaagttttctttaaaaactttttaaagaaaagtttttaaaattttcttttaaatttcttcttcaatccagtggtcattcaagagcatattgtttaatttccatgtgtttgtatagtttccaaaattcctcttgatatttacttctatttttattccattgtagtcagagaagatgcttgatattattttaatatttttgaccgtcttgagacttgtgacctaaaatctagtctattctttgagaatgatctgtgtgctgaggaaaagaatgtgtattctgtatctcttggataaagtggcctgtaaatatctattagatccatttggtctatcgtacagattaagtctgaggtttctttgttatttttgtgtctgaaagatctgttcaatgctgaaagtggggtgttgaattctccagctgttactgtattgggacctatctctctctttagctctaataatatttctgttatatatctgggcactccactgttgagtgtacatatatttaaaacttgttatatcctcctgctgaattgacccctttatcattatatagttaccttctttgtctcttcttataggttttgtcttgaaatgtatttttacaatataagtatagtgactcctgcttatatttccattgctatgaaatatatattttttcatacttttatttccagtctatgtgtgtctttacaggtaaagtgtgtctcttgtattcaacagatgcagatcgatcttgttttttcatccattcaaccagtctcagtttttttaatagggaaatttagttcatttacattcaatattattattgacaagtaagagcttaactcctgccatttttttaaatttgttttctgtttgtcttgtagtcttctcttccttctttcttttctccccttcttcctctactgaaagtgattttctatggtgatatgatttagtgtctttttttttaaacatagggagtttattcagtcctcaattattcccaaactccagatgaactgtctttttgaaactcagttacttacattaattcttcataattagtaccaaaagcaaaaatgttgcttcaagaaattctacgtgaaaatgtataatcttgtttcttggggcattttgtatcctaaaagctttcattgagcagcttcttcattgagcatatatgtccttccttcttctatgctacaaagccaaatagtttatactgaaaacatacttagccttgccctcaccagtagtatctttccaagttcaaaatcaaaggaatagttcaaagaaatatttgaagctctcttgcttcaactgcaatattcacatattgaaaatagcaataaatgtagtatttttgtttctcttggtactctgtttctctgtttcagtaactaaatgggttaattctgcttgctaaaaggcctcagattcttttcttcttaataactattccaaatggagaatgaacactgaaacaactgctttcccaacttatcttgattccaagatctgctctggtctcatcaagaagatttaggatatggatggtttatgtgagttgactcagagacagattatgatcttcctagtaactcctctcctcatttaatctaggctgtactagtaattgctttcaccacataatagaacaagttaattgcaaaattttgcttccacaggaactgtcaggtaaaattcactgatttaaagccagctgaaatctttttgtcagaaatgtactcacttttttctcaaaacatttaaattgtttaaatttaccaaatatatattttttcaacaagtaccatacattttccagaaataacaagatagtttatgacctgtatcatctttccacagttataattttacatatgcagaagtcggggttacaagcttatttgaggagctatttatgtctttcaatgtgcttctaatattattagattgttttatttccagaccacaagactcattactatttattccatatttagatgatgattagtttataagaatctaaatatcagttaatattagtttcgctagaaaaagtttaacattccagatgcagtcctttttcctacaaacaggtgcagcattacaagtaagctgcatttagatgcatgctctccagttctctgtggcaatgtaggccaagtgaagccagaaaaattattgcccaaggggaaacatttgtacttctcacttcattttgctaccttatcactaacaatatggtattcaaacaaacacatatatttatatttatagcttaattttttttttcctttagcaattctgacagctttgagttctcctcttgagggaatacataggaatatcatctctaattttattttctttttaacttattgcatttataccagctaaggactgtgaagacaaggtgaaagtgtaaataggcagggctgcagtaaaatgaataaggctccttaactggccttaatgcaatgcttctggagaagttactaccaaattgcagtgtttgcaactttacaaaaccccttaggaaaaatctaggtgtcatctctctaaatacgatggttagatttttaagaatgctgcatgatgctatgcttgtaaattcattatagtgatgtagcccagactctctctagggatcattaaacagcatgcattagggttttggtgctactgtacacaatttctaaacctgctattccataagttatttgttttacttgaaaggacttatggtatctgtgaccacaaaatatttgaagcatagtgattacaaagcagagacggcatgcctgcaatgctcaccatctactataggagagaacaaaaaccaagaaagcagtttttcctacaatgtggtagttatttacatcattaataaataacatttactggatgttgaactcatctatcttagttgtatatgaggaaatttcatatgcttactgaaaagggaaagtttatattttgtgttattctattatttagaaatgtttctaaaatttgggaagataaagtaatataattcgttcacaacaaccactcagtaatgtaggtcaaagtgtacatctccttttagatagtaggcagcttggcaggtgctgagaaatagtattttttctccttgcctagaagagccatctagaagcaaatgtgatctacatggaaaggcaagataaagataagacttagaagaaaaagatgaaaaacaaaaaaagtgggattacaggcatgagccaccatgccaggcctaatctttacttggaagaatgactgacagaaaaacagatcatttagatatgagtatctaaagatctgagagagcagatatcaaacatcaggtgtggtaagaaatgtggtagaggcaggcatttaggggatgtgtattagaaaagatgaggctgtagataagaagtcaaaaccaaaaagaattaaagccaggcatggtgttttacaccggtaatgtaagcactttggcaggccaaggctggaggatcatttgagcccaggagtttgagacaagcctaggcaatataataagaccccatatatacaaaaaataaaaataaaaaatacccaggaggggtaacacatacctgtagtcccagctacttggaagctgaggtgggagaatcgcttgaaccagggaggtagagggtgaaataagctgtgattgcaccactgcactccagcctgggcgacagagtaagactctgtctccgaaaaaaaataaaataataaaataaaaacaagtcaagaagctgaatataaaatcaggtaaagcagaagttcataaattcagccatcaacaacacaaggtctaattcttaaacctcattttgaattcaagaactcctttcacttagaaaattagtgtgggccctgtagaactttggtttttatgagctatacttattgatgtctgctgtatctgaaatttaatcttagaaaatgtgaaaatatgttattacttaaaatggtaatattaaattataaacctgttgcatggtaacataacattttcatgaggaataactatatttttcaaaataaatacaatatcatgagaagatactgctttacccttatacaaatctattttatgttatcttattagaagattctgcatccaatgtatttcagtacttggtttctgttgaacgacttgaggaaaatttagtgtcacaaagatgtgtagttggaaagggaggattttttacaataaccttcaaatatttataaatatcttctttgatactataccaaattcaacaagtagtttaagttttagttgcaatgtagaatctgaaatcatatcaacaaacttttcactttactaaattaaaatccgtaggtctactgtgctctttgaatgcatatttactcatgaatgattttgtaacaatgcattcgtcatttggaaaatgctggttcactgaatattgcagatcttgaaaatgctgacgtagtttattatataatatcaaatcccattgattaatatcaccactgatttaataaaaaaactttattgataatctattaagttgactgtggtagataaatttttcaaattctatttttgcttgaaattttgaaatttattaaattcaacaaggagtataattccgttttccttgaattaacaagcttaactcatttttgagaaaaatctgtcagatactcaaatctagattactagtttttctgtcagtcattcttccaagtaaagattaggccaggtgcggtggctcacacctgtaatcccagcattttggaggccaagacgggtggattattggaggtcaggagtttgagaccagcctgaaccacatggtgaaaccccgtctctgctaaaaatacaaaaaattagccaagcgtggtggcaggcgacgtaatcccagttactcaggaggctgaggcaggagaataacttgaacctgggaagaggaggttgcagtgagccaagatcatgccactgcactccaacctgggcgacagagtgagactctgtctctaatcatcatcatcatcatccacctttaaatacctatatgtgaatgggaacagtatgatcaggattgattgtagcctttcttgtgtcatgtcctacatagcaaatgatgaaaatttcagattgtgccactgcactccagcctgtgcaacagagcaagactctgtctcaaaaaaaaaaaaaaagaaagaaaaaaaaaagattgaatttgatgaagaaatctggctagaccagctcacattcccaaacaatcacacaagatgtctatgcctccttctcattttgtcacatagcgtagtattaaaaagctattctcaagggttaatgcttttttaaaaagtatcttttttactgctttaataaggacattcttaatgaaactggatttatgcatttgtctatttacttgtataataataaatttgtggctgttgagcactaactagtacagtccagtgccatggccttgattaggattaaagcaccaatagttttactgatcattgctctaatgacatcagtacaaatgtgcggacaaggaggataataatatctcagataatattgtgaaaatagtcctgacttgatggtcccctgaaaggtcttgaagactcccagggaccacataccacaccctgaaaaccactggaatagaggcactttgattgatttttctaaatgccatgtcttgaaactctttttattctcttggtttattttttggtttgtttttgatgctcatattcatacagagcagaagcagtagccctgtaacaatttcctgtctttactttttgagttccttaagatatagcattaaattgagttttaagttgctctttcattcatgaaatatctgtagagggcttaccatgtcctgtgcattgttttagaaacttgacaacacctctttgtaaacattattgttgacattggagtgggagttatctccctactttttattccttttggacatgtagatggggtacctgaccaaaaataaaaattttaaaaaaacatagtaaatataccatcctgctctctgccctcctccacccttctcaatctcctttacctccttttacactccctacgagtccaatggatatcaggtgcacacctggcagcaaccacacaattgagaagcaattttgttgttgttgcatgcatttttctttagagataatccctttgactatcatcctagacctctttatattcttccaagaaactcgcttcatcatttggttttcagcatgtatttgtttcacatatacaagctttgctctagtgtgtagtaatttaaggaatgcatttttattctgttaatctgttccataattatgatattcgacaatgtctcttccattttatggtcatagcccttctttctgaaccctgtttgatctatttttccacctggctcttcatttctagccccaacctcaaagctatttaggttttttacctccatttttgtcactagagaaatctatctcttcttaaactgttaaattcatgacttcttaatatctagttaaaattacagatttcatagccacctccttctccaagttggcctttattccctgggatgatgtgtctagctttcgtcttcatttctgtttataatttcaccttttattttaggttcaggggctacatatgcaggtttgttacatggtatatcgtgtgatgctgaactttggagtacagatgatcccaccatcctggtactgagtatatagtacctaataggtattttttgagtctttggcccccttcatctctcctccctctggcagtccccagtatgtattgtactcatctttatgtctatgtgtacccagtgtttagctcccttttgtaagtgagaacatgaagtatttggttttctgttcctgcattaatttgctaggataatggtctcccactgcattcatgttgctacaaagacataattttttatagctatgtaatatccctttgcttacagcttgatctcttcagaccttgcttttagttgcttatcaggtcttcccctttggtttagattcctacattcttggactcctgtgctcctctctctacctttgttttgtctaatccacctgcattcccactgtccacctcacgtattcataattcccctttctgggaagatgaagtgacgtgaattctttactcacccttccagcttagattgcactccagtttaaatatttcagtcagctctccacacaaaaaatacttgaaacaaagagagctcatttttattgtgtgccttacatgtatttagtcattacagtaacccaagatgtaggcgctatgctatttacaaaggaggaaactcagtcatagaaagattcccatgttcccattgatgagccctgaatcctaaggagacaatctgtcttcaaagccagcactttttgttaacacaatagagcctcccaccagtggtatccttttaaacatttaaaatgtaaagataccacttttccattttctctcactatgatcctgactttttatgtcacaagtcaatccatggccattttaagaaatggaatatgttgctaaacatatggaaactctttctgcttggctgacagctgagactttagccattgtcagtgttgcaaatagacaacctcttccttttctaattatgctgctgcttcctttggagccttgcctaaatttttgctgaagcattaggtagacacaaccaggtcaaactgcagaatctcaacccccagcacttctgctcctggcattttcccatggctcagtctttcacaaatactctaagaatggcagatctctgtgacagttttttcttgggcttctttgccataagcactcaatagctgctacatgatttaagttatatctcgctggcctctctatcactgtctttctcttcctttcctgctctttaatattttaaaatccccttctcctaggctgcatttgtgccttcaaataataaatatgaatttctttaaaataacaaaatgtctattttgataacataaagagatgtcttctacttcagatctctgtaattttaatatagctttattcttacatacacagctatactgatgaatttgttcccattaattttataatgacatatattccattccatacttagtctagtgtcataaataattatttcccaaggaatgtttattttatggaatggaatcaaataaaataatctgtttcatgacacaggacagttaagtggcaaacgaacaaatcgtgttccatttactttcttttttaaaaataaagtatactaaaatacttatataataatgatatatatgtttttattcagtagacagtattagcttcctgtgcatttgtgcattcagtgtatatgtatataatagatatatgcctttagaaaggattttcttatctccatgtcaacagtcaaaggacaaggtaataagtaatcaaatcccatcactttacacttatcttactagattttgctattgaagtaatttacatctatattgtgtctgaatggtgaaaataatggtatgttactgtgcatctcttccatttccacagtcattgatgtaacacaaacagctcgaaatcagtctttttggaagtgttcacaccacagaaatcaacaaacacaatcacacattcagggatttttttttttttttcacagagatctagttgctaattatttaccagcactcaactagttttaggcttgacttaatgtagagacacaagttaggctttcaattctctcctttctctactgccttcccttcctgccttgcttcctctacacatctctttctctcttcactcctcttctctatctcaattcattattgtttctactccatatgtatgtgtaccttattccctcctgctaaagaaaggctttctctatggggtgagagaaatggaagcaacaaacgatcatcatgaaatagagttccatgacctgaaaacttcttcaactccattttgcaaagtgcaaatcggaggccttggagtggcctttgattgttctaatacccacacctggaacaatgcctattgtcaagttaatgggtaactagattgatgagtctacatcattaccacctgagaatttaatgaagcgggctacggggatctggagtcacaccagaatgactctattttggagatagggtctttaaagaggagattaagtttaaatgacacagttaaggtaggcctaatctaatctgactggtggtctttataagaagagaaaatgtagacacatatagagacaccaggggtgtagctgggtataaggaagtccatgtgaggacactgtgagggagtggacatctgcaagccaaagagagaggtcttagaagtaactaaactcctgacaccttgatttgtatttttagcctccaaactgtgggaattaaatttctgttatctaagccactcagtgtgtatactctgttataagaggcttaataaactaatacacttgcattagctttccagggtatagagggctataagtatcctgtatatgccgcctaccatcaccatgccatttaccccagcactgaattgaaactggatgatgtcaattgatgatgatgaaaaagaggtgtttctgagtttgtattaggatgagatatcaagcttgaaagcatcttgagtactataatttacctatcagataggatacatcagcagatgcatttttccttagtacttgcctttatctgcagggcctggtttctcttctgggagatggtggaatgtattctttgacttggggatttataacagttggtacagaattctgcctggaatgcactctatttctaaggaaggaagtttgagaccatgcaatgagttagggagtgggaagaagcagttgtcaaaggcaggtaaaaggcatgacttggctaaaatatggagaaaaacatatcctataacaaaatagtaattttaataatttaaacagttgtgcttttctttgatagttacctcacattgtcagcttctagaaacattctcatctgcttaccccttcaactccatttttcaacttataacatcttttcttttagcttattaagcaatctttattatagtctaaaaatcacttatatttactttgatattaccaagacattataatctctaccttaatttattatttattatgtaagattggcttctaatatgaggctagatgattatttcaatggcataaagaaccaagactttttacaataatttgtacttattttccttgtttcattgctatgatttttaatgattgaaatttccagaaatctactttatcatgggttattacagtaaatttaattgcaagaagtaataaagcaattaaagattataatatattttatagctttctacttgagaagacagaattaatcacatgatatgccacaaatttaaatatctttaaaacaattatatttatggttctcagaacattgtgtgtttttcaaaaatgcatgttttatatttcatacaaatattcaaagttcactaatactattgaactattaaaagatctacaaagtttatcagcactaagaaatcattgtttttctagtaatatatattgatatgtttatagataaatacaatatataattataagtgaatctacactacatactggttctatttagatatacattgaaataaaatattttcataattcatattgtatgttataattattctctgttacacacctgaacaaatattcttataaaaatatgcattgtttcaggtattttattcattgtaaaactttttgtaaacaaatgttacatatttacctcttggtgatagttgaacatttttcatggatgttaataaacaatttattttggtagtgaacacaaacaggattgattgacatagatatggttttatttgcagtgttcatacataaacttagaagatcacagacattcattgtgagtattttacaaacccagattgtgtactatggtatcatgtttatttcttacccatatattttagtatttttcctcctaaggagctagccacttttaagaaatttcaagaaaggtgaatctgaattcccaaatgatagaaacagttcagttattttattacaatatagcaagctgctgcagatgtcagtgaccagttaaaaaggttgaaatgtagagctgttgaatcgagacccacaatgacccaagagcaatttacttccttcagatgattgggatgtgttcaaaaataccatttgagcaataaatttctggatatccagagactttaagtgagtcagttgtcttttgaaaattcttcatataatggctttattttaggcaccaataggaaggcattaaaatcatttcattgccacaggtgtgtgcatatgcacatgaaagtcaaacggtgagagaggagaggcagcaaacatgatcatttaattatagtcaagtttacttttaattagtattactgaaatatttttaatttgcagcttattaatctattgtttcaatagcaaatatccttaattatttcaaatcaggcttcatgatcatttaatgccatgtgatggtaatatgtacttgtgaattactgctagacctaaaatattaacaaatcagccaaatactttaaataaaaatttagcaattcaaaagtgcttgcttataagaaagtatgatttttttactcttgatggtaataagaataaataaatatgacatggtaatttgaccatttctatctcaccagaaaaacatttctattaaagcaatgaggcaaaggcaaatacagctcattcaaaatgcatagtaaatcattgagagggttcagtttatatttcattgtagttatttcttatcaggattacagaatttttagagtaatctagtcttcaatttaataaaacatataatagctttgaatagtttttccttcttctacataatcagatattaagaatctcaaaaatgtaattaagagataattatgtaggtaatgtttaacatgcaaaagaggcatatcaaacattagtatatctaaatttcagttaaagaaaagttgtgatgcatagcacttaaaacacttgttcaactttgtaatgaatcagtagtacaggtaaaacaaggaccaaactctaaatgccatgctttccattattataggtcataggagtacataatattgcctagtgaggccaaagtaacacctaagttcctgcctacagagaaagtatgtgaaaaagtgggtgaactttgtaacggtcattcacaaaacaggaatgaatcaaaaaatatgtactttctttgcaaaagaatgcagaaagactcctgagaccacctaaaaaattgcaagaaatcaattcgtaaatatttagagtccttttgttaagaaatttgtaaagagtggtaattatataattaggtctgtgcagaaggggaagaagcaggcctttggtcacaaatttaagttgcattaaaaacattattaaagtattcattacaggcacaatgataggcaaattaaagacaatctcgggtaagagatgaacacttgtgttttctctgtatgtggaggggggtgtatttgtggcatttaaggcaggatagagatgtgtaagggaggtatttgtctataaaaaatcatgttctattttactaggaattcctcatctttacctttttttctcagctgaatacatgctccagccagttccagtcttttcatctgtactgtctcctcttttccctttctgcctcttccagaagactgaatcattaataaactttctgcatcttcttccctactagctcctttccctcagataggctgaactgtcttccaccttaaaataaacaactccacgctgaagggaaactctttcttcaaatttaaattgcatgcttcactccattcacttcaattgtcttaaaatatgtgtccactttcacccatttctgcttcagtgaccccactctgaagctctttgatataatttcctcatcatcaaatgcaatgatttttttccacagtccttgttattagtaaactctcccaggccacagattccattaaccatgccctccttcttgaaagtccccatgtcctgggtttctacaccatttttcctgtagctcctcgtggcgcactctttgctgtaaccacactggaatattatgaagagccacactatttcacacctctttacctcagcacatactctttcttctgctaggaactttcattctcccatgttatgcctgaatttttacccttccttaaattttcagcttcattgttaattattttgtgattctcccttatgccttcctaccatgaacccaggaataatcaatcattctttctgttctgctgtaaattctttgtattttaatatgccagtgtttgcattttcttataatgtgcttggtctgctctgcaaggatatgaacttcttagaagcagaggcaaatccttgacatatagcacagactttggaatcacatagaccatgactcaagccttgttgatccacatttagctgagtgactatggacaagttgtttcagctcactaaccttcaggtcccttatctgtaacacgaccatcacaaagtatcagaaggattaaatgatataatatatgactcaggaagtgccaaagtggattattaaaggaatgtcaaataaataattgattaagacaatgaaactctaacatggatataaacacaataaatgtttgataaatttatattgaataaatagatgaattaattaatgagaggtatttcctttgtatgaagattttttgttttatcttttacactgactttctccaatctcatagaaaatttaaatcctcactgtcactccattaaaatagtattcatatttttatttctgtcatgcttatttgaaatgacattttatctcaccagaattttgactccataaaataaagacacatgacttcctttttttatttgccagagcctaccctgactcatagtagctatttaatataatttatatatttcaatggtagcattttattaaattagttaaaattatttttgagtgaatttaactcttacctgtcaatagtggcttaaagagcatataagtctgatgaattaacagtgaatttggaaaagaaaaccaaataccaaatggtcttacttgtaactgggagctaaacattgagtacacatgtacacaaacatgacaacaacagacaatgtggacttctagaggttggagggagggttgagggaaagggttgaaaaactacacatcgggtaccatgcctgcttcctgggtgatgatatctgtgcaccaaaccttagcatcatgcaacattcccatgtaacaaacctgcacatgtacccccatatctaaaatcaatttgaaattaaaaaaaaaaaaaagatgagaactgtgaacagatctgtggtgcaatgactccagagtgccagaggaccaaaattctttttttctttctttcttcatcatgtggcttcaccttatcatccctaaatacaaggggtggtctgggctacagactttattttgagtagccatatgcaaaaactcaaatttgagagtagagaactagtagtatgtgctataattaaaatcacacaaaatgtttgaattaatgtgctgtatttccctcatgctgaacaagacatttaatccaatagaagacttattactactttcttacatttaggagaaaacatataactgtcttctttttcccttctctgaattctgggctgaaaagatcactccaggggcagagacatttactgagaaagccatcaaaatatttgcttatctgtgcttgaggaacatagagtgatattcttataccacaatgagaacagctaatttaattatacatgtttcgaacactgcaatttctggagagaagttgtgatgtgtgtttgtgtgagtgaggatgtgtgtgtgtgtgtgtgtgtgtctgtgttttgaggatacttagccttaaattagaatctacgtaaacaagatgatatgaaagtcaggaaaagtaaactttaaatatatgttttaaaaaattacacaatagtaaagttttacgaacaagtgcaggataatatatttccaaataaaggtacacaagttttcaaaatttatctcaataaaaatgtattattaatgtaaataataaaaaaatttagaaaggggaaaattttttaaatgaagattgaaagtttatagtttatagaacaatgtcttatttttgccaatctctttgccataatgaaattgagtattctgcttagctcttacttcaaaatatccatttggaaaggaaataatattttgtgttttctacatctggtttaaaggataaaaattcaaatataaattatagtcaccaaactagttttattcaataaaagttctggcatatctgctattcccacttggaagctattctttataaaaagccattttgaaactataaccatacagaattaattgtaagccttttggatgtcccaaatctagcattgtgagactacttcttacagctacctagtgacagaatgacaaatgaatgtcctattcactgtagtgtaaagatgactgacttaatgagctgtgtcctacttgtcaattaagtttctacctctgtatgtcactttagagataaagcaattccctgaaaccacagtataaaggagagaaagatgtatatggtacctgtctttaccttaaaggcgaatagtcctgcacatcagataaaaaattatttgttattattactatatttattatttatatatgccatatgcatgtatattgtctactaatagattcaatcactttagatgaccatggtttcccatgttctttttgttatttgattctgcatatgacattgcttacttaattctagtcattcaaaatctatcactaatattgtaattccattttccagaaataaaacaaaattcatattccaatattgcaaatatacatactatacactagtgtaatggccttgggaatataggtcaaaggaaagtgataagttaatataaatagaaaaataaccattgttgtttataggatttttattaaacttaacacacacctttttagtcttaagaactgattacttcataagtataatatgaattatttttatctggaggtgaatttcctgactagaaataaatactatcttagagatcaatggagtacaagaaggtatataacattaatatttttctttctaattttaaatataggaaaggtgaaatgattgttttcactcattgtacaatgttaacagtctacttgaaggttgcatcatgtcacgcgatgtttcaggctttttccacttgaaatatatttacaattactaggaaaagcctcacgcaaaaaagatactttaaaaccattactgtaaaaagtggatgagtctttcctccaagctggaatttttttccaattatccttaattggttatctgtatctctactcctgtgttactggtttatttttaagacagctgggtctacagagagatccagtttcaagaactaaacaatagatttgattcttccttgttccttgcttttttcaccaacaatttacacgacatatttttctattatcatattttcattcctgtccttcttgtcctctgaatttctatacccactatctaatatcaggccattatttaccaaaactccacctcccattccagtcccttcgctccttaccattatgtttggtctttccattcttaacaagcaatatgcctaaatttaaacagtatactgaaagcctggagtttatccctctaatggcaactgcacctttggaaagcataatagggtcaaaaatacaagtaaatttgtgtgtgtttctgttgcatttttcaacactttttttccagaagatagtatgaaaatcattattgataatcagttgcaatcaaactatgaatttacttaaataaggctgtaccattagatttcacttaaggtttttccactggagtttaagttaaaggatatcactgttatgaagcaaaaacttctctcctgtgaatatcttacctgatgcattagagaagttatccaaaatgtcagcatttttcttcaacatcttgtacgtagttggttttatgtacggacattgttaacttctcaccattgcagggatacctttaagcattttgctttatggcacttcacagataccgaactttttttaaaaaattggaatcttgtggcaaccctgcagtgagcaagtctgtcagtacgttttaacaatgaacacgtgcttacttcatgtctctgtgttatattttggtagttctcagaatatttcaaacattttcattagtattatatatgttaaagggatctgtgatcagtgatatttgatactgttataattgttttgcagtgccattaaccacgcccatatgatagcaaactaaatcaatcagtgttgtctgtgttctaactgctccagcaatggattgttccattcccctcccgctcctcaagccttcctatttcttgagacaaaacaaggttgaaattgggccaattaacaatcctacaatgatctttaagtgttgaagtgagaggaagagtcatacatctctcacttttaatcaaaggctagaaataattaagcttagtgaggaaagagtgttgaaagccaaaataggctgaaatccagggctcttgcaccagttagcaaagttgtgaatgtacagggtgtgttggtgtgttcttaaaggaaatgaaaagtgttactccagtgaacccatggatgataaaaaagcaaaagtgccttgttgctgatatagagaaagttttagtggtctggatagaagaccaaagcagccacagcatttctttaagtcaaagccctaatgcagagcaagtccttaactcttcaattttatgaatgtgaaagaggtaaggaagctgcagaagaaaagttggaagctagcagaggttggctcctgaggttcacagaaagaagtcatcttcataacataaaactttaaggtgaagcaggaagttttcatgtagaagctgcagaatgttattgagaagatatagctaagatcattgatgaaggtggatatacccaacaacagatttccaatgtagataggacagcctgatattggataaacatgctatctaggactttcataaatcaaagcctggcttcaaaccttcaaagaacaggctgactctcttgttatgggctaatgaagctgttgactttaagttgaagccattgctcatttgccattctgaaaatcctagatcccttatgaattatgctaaatctattatgcctgtgttctataaatggaacaataaagcctggatgacagcacaactgtttatagcatggtttactgagtatcttaagcccacttttggagacatagtgttcagaaaacaaaattcctttcaaattatgtctgctaattgccaatgcaacctggtcaacctagacctctgatggagttgtatgaggagacttatgttgtcttcatacctactaacacaacattcattctgaagaactgagtagtaattttaactttcaatctaattatttaagaaatacttttcctaaggctaaagttgccatagacagtgattcctctgatggactgggacaaaatcgtgtggaaaggattcaccattctggatgccattcagaacattcatgattcatgggggaggtcaaaatatcaacatgaacagaaatttggaagttgatttcaaccatcatacatgacttttaagggttcaagtcttcagtagagaaagtaactacagatgtggatttgcaagagaattagaattttaagtggagcctgaagaagtgactgaattgctgcaatcttatgataaaattttaatgaatgaggagtttgtttgttttttttctttcttttgagacggagtctcacactttcgcccaggctggagtgcagtggtgcgatctcacctccctgcaagctccgactcccaggttcacgctattcttctacctcagcctcctgcgtagctgggactacaggcacccaccaccacacctggctaattttttgtatttttagtagagacggggtttcaccatgttagccaggatggtctcgatctcctgatcttgtaatccgcctgcctcagcctcccaaagtgctgggattacaggcgtgagcactgtgtctggccaggagctggtttttatgaaggaataaataagaggttttaagtttccatctcaggaaactattcttggtgaatatactttgaacattgttgaaatgacaacaaaggatttcaaatattgcataaactgatttgataaagcagtgaaagatttccagaggattgactccaattttgaaaatcctactacgggtaaaatgatatcaaacagcatcacattctacagagaaatcttttgtgaaagaaagaaagaatcaatgtggcaaacttcattttattcttattttaaaaaattgcctcagccccccaaccttcagcaaccagaactctgatcagttagcagccatcaacatcaagataaaatcctacaccagcaaaaatattatgactggctgaatgcacaatcattcacaatttatagcaataaagaattttttaaattaagatatgtgcattttgtagacataatgctattgttgatttgatagactatagtatagtataaacacaatgtttatattcactgggaaaccaaaaaattcatgtaattcactttattgtaatatttgctttatagctatattttggaattcaatccagaatatctttgaggtctgaccctattcttttattttaaataattaacaaaaagatccaaaatgaatttccccttcttccttgttatcttatagaaagttgctagactatgatttgtgaaaattatatcctcagattttttccttggattatatttccagattcaccttgtaaaaattcaaacaattctaggagacaatcatacacaaataagtttgaatgacaccttgattgaggagtagataccttaacaaagagaataaagggtttctttattctctttattagtgagaatagtgagaaagaaatgatctgctgatccacaactgaaatttcttcagatagcagcaacttgcctacctagagtagagtttctcagtcttgacacttgacagaaatttcttcattgtgggcatttgttctgtgcattgtagaatctttagcagcatttctggcttctgtccagtagatgccattagcacccctctagtcatcaccatcaaaaatatttttctattttggcaaatataggagggcaaagctgcctctagctgagaaccactgacaagaagaagaatggagtaataatcatatttagtacttcacaaatatcattttatgcaatacttacaacaaaccaaagaattgtctttttttttctggactaaggcccagagaagttaatttttaaattgaagattacagacttaacaagtggcaaacctcagaactcaacattataatttatactggaaaattctacagagttgaatagaacgtaagaggtgacaaataaacattgtgtccacctaacaattttgctgagggccagcaccggtcagctttctttttgttaacatcaattttacaaggctttgcttactcgagatgttggtctatgtatagaattttaaaagcgatttaattttattttctactttgtactcagagcttggattgtagttgttagactatgatttgtgaaagtgcttggaagccaggaaaaaggcagagttttgctattacaatgatagatttgatggcatttcaaagtaaatattgcctataaagagagtaagagtatacaaaacctgggagatcagctataaactgtcagcatttttcaccttttctcttgaaacttatctatgaaatgttaacttctgaaaattgcagttgaagactaaggtagaagttgaaaatgagaggaaaagtgattagtttatttatcctattcatttattcattcggtcaacaagtatgtaatttccatgagggtaaggacttgatttcattcctgttatgactgccatttcgcctgaaccctatacagtacctgaaaggcagttatcaatattaaatatttatcaaatgaaaaccagtgtgaaagcataagaacatgtttcttatcctttacgtatgtgagaaaatgtgctaagtacactaactttaaagagctaatagtttaggaaggtgtgtggggcagggagtagatgtgcataaagacacttaatgagataatataatatgttaagtttaaataaagttataaatatatgacagtaccaagcattttaagtctaagtaaatcaatccttccttacttattaatcctacccattttaagccaaagtctagattattaaattatggctctaccaactttaattgagcaggatttatcattactgtctacatctatattagttttctattgctggtaacaaattatcacaaacttaacaacttaaaagaataaccatttatcagctcacagttctgtgggtcataactcagaaaaagaagggacttttaaaggatggtaatattatgtcaggctcatccttaatctccctatcgaaaagtcacctgcaccatattatataacctaatcataggagtaaaatctatcaaacacccagttctgtgaattacgcaggggacacgcacactagtgcgaaggaaatcttggggctatctgagaattctatctaccaaagcaatcatctttttctcatgctgttttttctcatatggtcctcattgaccacgagactaggttaaccatagctgtcacagtacctactatgatcttgatcttaataatcaccatctttattgtcattgcttttttaaattttgtcttcctttttaagcgataggcatggtaatgtcagggactggtctggcttggttactactacatttctgacacctaacccttccctggactacacaaaatagatgttcaataaatatgtgatgaaggaagaaatgaaagcaaattcttattaaataagaagtaactaatcagactactctttaagttaatccttgttcctattgttcacattttagctccaattttaccttcccacctcattgaaatattgcaaatgtccaccctggctactccatggatcatcattctttttatttacttcctatctcttatcactttatataattatctctgttgcttatgtgagtacttccttattgtctgacgcccactatattataagaccccagaatttttctgtctcatttacccaagtatctccacggttttacctaacaccttgtctataatgggtgctcaataaatgctgaaaatatgaaggcctggcagaattgtcttacagggcatggataaaatttcatgtcccaaagggtactctggatatttaaaacctctcgacaagcatttcaggacctttctaacattttgggacaattgtttcaatcttaacaaagctatctgtaattttcactctaatttcatagtacatttacctcatattttgctacccccaaatcaaggatgttttatgcaaattaattgacaaacttaaggcaattatgaatgaaattcattaagggtttactataacgtgaaaattctaatttcatgatataaatttatttctctaacattcacttgggtgtaatcttttttttattttctacaaagtgaaaattgttttttgtatttggctttaataattgcttgtgttctgatttttaaacttctattagtcggcatgtttctgtgctgctccctgtgtttccctttggaaactcaaagtaaaaacaatatgaaatgtatcactatttgtaaagcactttaatcttcctagagcttcctgtgccatcaccaactataactccaagcatgtcatcctattcactttgtcaaatggaaagtaaaagttttctggtactttgcagcttgataaaatgtctcttagaaaataccttaatcagcataaatttcagttgttgtgcatacattttttataactaaatgttctaatgcagttttaggtatcctaaaatgtaattatttagatagtaactgcaagtaaataagtccttcattcattttcttttaaatcctgaaagctcagtgctctaaatactgctttggtagaaaatcattgacagctgcagactcctggcacttgagacggattgataaatgcacaacaacttttagaaaactccattcattatttaccagtaattatctcccactagctcttctctcggcacttacccatttagtctatcaactgattaatgctaaataactttctaagtctttgagcttaaaatagtaaatcttagaaactgtcttggagttatgcgttgtgcagaactttagagtttttctgtctgatgaaaaaagactgaattttcatttatcttttgatttaggcttttattttttacacttaactttgccaacatgtacatttctacatttttcctacacacatatcgtttgtccatagtgagttaattgccttttaaactccatcctcttaaatataattttgcactgtcctctttgtgctcctctctgtactgtacctaccacctttcattacagtccctatgaagttttgaaataatcacttattcacaccaccgactcctccagcagcctgtgaaaatacttaacctgttcccctagtttataaattcaggcaactagaatgacaaaagtggatatcaataaatgacaacggaaaatgtcccaatcaagattaaattacagcagcctgctcatctactcttcaaatactctgcagccctcattccaaattccacatcagcttttaaccagtagggtaagtacatatttgtgaagctttctctatgtagtattagtgtgtatcttcactttcatcatttttactgtactatgaaaaatatgtcttcattttatggttttgagaacatgtcgggaagtatagctgaaaattccgtgccacaggattttagagtggaggtttctaatagttttgctattgttaggtcaccatggaaggaacatcattgaagtcagtcagtgtagttatggtgccctgagatcatcgcactctcgatgttatttaactaagatctatgacctcaattagagtgaaaaggattcatctctcagctccacaggcttagcaaaagtctcagccattcagttcaaaggattaaataacccatgttagatggttacaattaagactagtaaatactgttttatttccatttagtaacagaatagacacgcctcaaggtgcttcccattaataagatgaataaaattaaacagttacataacgtgtctatccataaatcatttaaattcaactaaagtacctgactagcagtgttttacaataacaggcatagctgccatttgacataaacctgggttcactctgagccaagaacaagatcaacacattgaagactgtccttttcaaaagtctggcaaaagaaatttggattgttgaccaaaacttcttagtcacttcccatgggaaaagaagttcttttggaggacagtactgaatagcttggcatatgctgacacttcgttacagtcttttcaatagcagaatcatttccaggccaccagacacagtgaatgattcctgaatgtgctacatgtggtgtggccaagatgacagtactgccatctggaataataacaaaatttcttcaaaacagacatcctttatggaaggataactcatgcaggtcatgcatcaaggccttgatttcttttgacatttccccactggactttgcagtcacaagcaaaagcacatttatagcaacaaaatactactgcagatatgaactacataaaccacaccctattgccttttgtagccttccagatattaggaagggtatagcatccattgatacatagatactactactaggcctttccatctgatgtgaagaggttacattattgtttgtcatgggaaaagatacaagttcaccagtgacagggacaccatagactactgtgaagataatggtagtacctggataaacaaagacatcttatctcaacctgtatcacggaacataaattcagcagtttatggaaatattctgattgaaaatagcattgctttattgcctaactaacccgtctacctcccctcctggatccccaaaatttatttgatacagccaatagatttttttgttcttgctgtctttattaatgacttcattatccagtgattttcaaacattctactaaacctacaaaacttgtctttgtattaaatcaatatagaagctaaaggtataaaatctgtaggagattgttgtcttaactcgagtgaggtttgaggttccctgacaggatagattggtcccctttgtatataatccctggaattatttctacagaaccctagagcaccaattgtttattttcaaaaactcctgcctttactgtcataatatttacacagtcacttctctttctctagtttgaaagaaaccctgttataaacgtgaattcatcagatgatgttcagagatgatgtctaacaaatggatgttttggaataggttattgaagtaataaaatacaaggtcttttttactatttgtgatctattaaaatggcacaaatagttggacaaaaggaaatattcagaaggatgaaggaaacattcctgaaggaaaaatgtgaaaattaattgtattcttctgccagttgtcaacaagcacctttgtctataacttgcctaatctataaatatatgtgtaaaattttgtcattagacatacatatctgatccttgctatcatattcccttcaggctaaagtggtgtgtaaaattttctctagatgaagtatgttgtgactcaattcactcacagtttcactctttggccaatttgatatagagtacaaaaataagatcccgtgtgtttttcaaataagttgaatgactgaatgaatatttgtgccactgaataaatgggacgactgactgaataatatttcggccataaagcatatgtgttttacagtttgattatcaagaaacggcaaagcaaaaatactcttgtttgaaaatatgcaatacaaacaatgacactaacatgacagcttgcaaaaatacaaacatcgttatcatatactagtgatgaattatttttgtaaaagtgagtaaattaaaatgaaaaattaatttcagctatcactaatagtaaattgataaaaaatggagaagacatgtaagcagttattattcatttacagaaccaaaggcaagatagatttctttggttttcaaatcatggcctacctgaaaaactctcttggtccggcaccctgtgaatgatactgcacacatgttgaggatatttgggatagtgagaggaatattgtgaggaagtgttgtcagaacttcagtaggattttacagtccatcatcactcaaattgttgatacagacatagatggccttacttgttgcctctctgatacactcttacccacttatcagttgcttccttctctgtcatccgtatcacttcatacaaatctttagaagcttccatactgcttttggtattctgcttacctaacagcctctccctctccatcagattctattcagaggtaagtattcacttttgtgccttctttgccttgtcccatgcctaggaaataagtgtccaattggtgtcagcagactgagtaaacaatttttaataaagataattttaagaaccaaatggtgttgttagaaatcattgatgttatccttttttttttttcttctgagatggaggctcactctgtcacccaggctggagtgcagtggcacgatctcagctcactgcaaggtccgcctcccgggttcacgccattctcctgcctcagcctcccgagtagctgggactacaggcacccgccaccatgcccggctaattttttttttttttgtactttttaatagagacggttttcaccgtgttagccaggatggtctcgatctcctgacctcgtgatcctcccacctcggcctccccaagtgcggggattgtaggcgtgagccaccgctcccggccgatgttatcctctttttgatagctaactcacatattctctggcatatttaacattaccatagaatgctaacccctggcattctgttttttgaaacaaattaaacctgtagttaatggctcattcaatgaagcttttatgtccatcatattatcatgtcttccttcagtcttcctgtggatctttttgatggcttagtagtttaaatgatttttattacattttaagaaatttaagaataccgatactgtatttcttcttttacatagtaaatacatcatgtaaatgattccatttatcattaaaaatggttgttaaattttttattaataacatattggttattgcgctgcaataatttatcccattgtcttttataattattcaaagtaacagctatcctaagtggtagttgagcagtttattagcacaaagtcactgaaaaaaagtgctattgattctccttactgcaattaaggaaaccctttattcactagaatcaaggaagaaagctagagtgaaatatgtcaaacaccaccaagagcagtgtgctctgctgccacatctaatggcgataccacaattctaatcagagaagacagtgcagttccacacatacaaaactaagaatgctaatgctaatttagcttgagtactccagtcagtcaaaaatggtaattgagcaagtgattatggaacccctgaatgcagagagaagtttagctgtactattatttttttttttttttgcatgtcaagctttagagaacagtagttaatgtgttggtaaaaggctatcagtaaaatggatttttaacacttggttgctcaatggaaccttaaaaattcctatgatctgcattccagggtatctgtcgtactagatttgctattgtcctgtttgttgaagcttcgtctatatgaaaccagttagatatattgttgggtatgtacagctattcaaatgtgtttggaataccatcatgcaaaaatatacataaaatgttagtcattagaatcatttaacagatcagcaaactgcaactcacagggtagtgattcccaaatccaggttacataagcttcctgggtcccattttcacagttggttgtactttggctcagaagagattttggtgtaggtgataggcaaatgatactgaaaggttttctttctttctttctttctttctttctttctttctttctttctttctttctgtctgtctgtctgtctgtctttctttctttctctttctttctttttttaatgtgcagttgacaagttaactatttcatagtctaatgtattgctattactccataaactttgaatatattaagacaatccacaatgtgctagttctactacttctttgaatagatatattctacaacagggttggttttgaatcatggggcttagctacacagaattttcatgggcagaattatttgaaaaacaaaatacccgtacccaccctttcacaccaacctcataacaaacctgaagcatattaagccttaggagatttggttccctaccagacgcagctaccagagattttggttattttgctcccatacatacgaatttatctattacaaaatatttgttctctaaagatttcattcttctgccaattcaaagttttattaaaacagattagtggaagattaaaatagaaacaagtaggctattctttctcctttaaaacaacaaaggcaatcagtatgttgacattatttgtgactagtttctaaattgtgccatctttatagtagtttgtattatgtcttttgataaattgtgtttgacatgtagatgaaagagcagaggaaaactacattttatgtagtgtgtgtgtgtgtgtgtgtgtgtaggataatgttttacaatgaaatctgtagaaacaccctattaatttcatgaactaacttctaaagaatatgtcaaaaataagttggcaggtacatcttagcatttatcaagagtaatattgccagaatatgtttctatttatattgcttaaaagatgcatgaaaaaaatctacttttttcaaacatggaaatgtaaataagggatttcaaattgtttgattttcttctaggtccctgtctatgacatctaaattacatattaggatgataagtatatacaattttctgtggcctctaaaggaaattacttttaattttgtataaatgtgagaacaatatgtgtttccttctgtgtgtccatctctgcctctttctctctttctttttgtatttataggggtaaatttttcatctgacagattaaaaacattagattacatcccgcttacagtaattacagcttactggtgatactgtcattagctgagcaattttaatgtctaatttatagcaatataacgagtgattaattcaagatgaaatttatcataaagtgtaatcacgatgaaatggataggtactcaatacagaagcttttagcagtcatatgtgaggcagtacccaaaaaacatttaaatagtttaaatttcaaaaatccagcagatgaggtccacatggatataatgagctgatcgaagttttctgtcaaaaataaccaaagcaactggtagttcggatggctcatgtataccttctatttgaaacaggcagagatcttagcccatctttgtgtccttggtgtccaaaacatggtagatctaacattcttttttaaaattaattaatgggggaatgaataaataacaactgagttaccctggcttataaagcccgacattatcccagctgaaaactattgactttcttttgcattattcaccacctcaaccacattcagccagagtgttcagctttcctttccttgatcatgccaatctctttcccacctatcacagcaatttctctccctataatcctcttcccctaaaagtagtcagagcatggttgtgtctttctcatcattcaagtctctcctattcaaagaagccttccagaccaccttaacttcaactatcattttctgaaatgtttgtgcattatatacttgaatattaactataagttgggtgcagtggcccatgcccatgatctcagcattttgggagaccaaggcagaactacatgaggccaggaattcaagaccagcctgagcaaccaatatagtgagaccccgtctccacaaaaaaattaaaaaaaaaaaatagccaggcttggtggttcatgcctgtattcctagctacttggaagactgaggcaggaggattgcttgagcccaggagctcaagtttgtggtgagctgtgatcgtgccactctactccagcatgggtgacagagtgagactctgtctctaaaaaagaacaaaaaaaccataatgtctataaactatatatataatatattaagtacattatacggacacacacacacacacacacacacactttctctctctctctcatttagaatgttcatcttcctcttccacaggagtttaagctccataaggacagcacttttgttattttattcacgttgaatgcagaacagggcttggcttacagtatttaggtgtttcataagaacgtagtgaataaatgaatactttggaagtgtttccaaaatttgttctcaagtgtatcacattgatcactcctattgaaaagaattaaacattataatgtgaataggtgagatatatgtttcagatatatatttattttagtttattttaaataaaaaagaaatacatagtgaacaacaggaattattttaaaaagcattaacagatggcattcaattattaaattatagttcatctttcatagtagagaaatatgaagttgttcaatgcttggaaattgttgtatgcattacatgtgataaaagaaaaaaatagcactaccaaggggcaggggaaaataatctttactagattttacagtttaaaattaggttgctgaaatgtatatggcaaaggtgtgtgtgtgtaattgtgcttatatattgtgtttataactttagtgacaggaaacaatataaaatcatatgaataacttgtgataacatcagcacataatgatccctttcttatctggtgttttattgtactattcaaaagtgctaaataaaaaattcttctaaacatttttttcattaagatggatggatatgtattttctccttctctccccctacaccccatttctctccctttttcattttttaaaacatgtattaggtaaacagaatgttggtagatagaaatatacagatagatagaaacaaaaagtcttctctcctggagttgcgatgcctggtttaacattctgacttggtcactaacttgttttgcttttttatttttttgttttataattgttaactatgttttatttactttttttttttaaaagaactaaataacttcaatggtcatttagccactgggattctctgattctttttttttctgttaatgtaacaagttaaaaggttaagtaaatctttaggcctcagattttttattttgttttggtttgttttgcatatgaaaattataacttaacctagaaggtccctaacatgatgcaattattattctattaaatacagttgagttaattgattacaatttgttttaagttagttaccagaagtttaaaaaccatgtcctggtatttatgccagctgtacattcagggttctctttggctatgacatcagggcagagtactgacactcatgagtcaaggagcagggaagagggtataggaagccaataatttagaaacttaatgacttacactccactttcgaaaccggcaaatattagaattttttttaactcaactttccaaggtaataattttaagttttcagagttcagtgacttagagacacattgcaacaaaatgtacaaaagtcttcttggctccatactgtgaaagacaggggaaagaatattgtctaatgttttctatggataaaatggttgcttaatttaaatgaaaatgttttttactaccttgaggggctctttttcctgtgagtttctttggtgtttcagagagagtaagtcctattcaattaaatgtatagtgaaatttgcgtataaaaagaaataaactctccaataaatctgtggtcaggtgtatgtgtgagtgtgtgtctgtgtgtgtgtttgtgcttatttgtgtacatataggttaaactttgcatttgagaagaaagtttctgaaattgatttagaataatttttatgtttattaacttatttttagtagagaaattacagcttgtttcatatcataattatgttaacaatttattaggataaaatgaaaatgtatgccaaacatcaacattactctttattaatatcaatttatgaacacatttatgaagaaagaatatatgaagaaagctgttcaaatgtaataaccaagaagacatataaatggcaattagttaaactgaaaactttccaatttcatcttagaaaaaggaaactagcaatatgaaaataacaaaaatcaagcttaatttatggaattctccatgaagaaaaatccttaattatatactgcatatttttggtaaggagaaatgtttttattctacctaaaatttttctagaattgtagaattaaatgatggaaattgaaaattaattatttggatgattaaaaataagaaaatcattattttaatttgaaaaaaaaatgttaatactcttctgcagggggcaaatccatgcaagtatatcttcaaagtcagaggaagccaagaggcttaaggaagaggtgaacatattgttctcagaaagaaacattttataggaaatttgaacagaagccatgcctgtgcctccagcaatgagacatgctggcacagctcagtgaccttaccccttggacccagggcttatataccatagggaaagaatgtgtaggacaattgcagggaaaggcaaaggtgctctgtgaatatgcctaagggcaggatttatggtcaaagctgttttgaaataatgcggtaatttttggtaagtacatgctcttactcaagaaacaaaagataaactggagatcttagaggcctttctagaactggagttaactagaagtcaacatggtggattagtacccaagatggaattgctttagcttccacagataccaacagaaaatatagtattataatagtattgagtataagaataaagaaattggactatgatagagctcaaatttcataaaatgaaaatttttttgtttggtttgattgtgcttctttggatcatatatcatgaaatatatttattattgtacttataatatcagtctgtaatcatttagatgtttagtttattaagctcttcaattctattatgtagtatagttttcacagactcatttactgaggtagaatagatcttattacttttattttaggaatgaggaaacagagatttagctaaatcaagtgtcttaaggaagcagcaaattgaaatgccaggatccagtcccagcattttcattctaacttcaactttttttttaatataaccacgattatatgtattttcaaaaaaatcatttaaatgttatattattaaaattggacttgaactcaccttgctccagtataaattctacattcaaatcttgatttttatgtctaggtttacattagataaataaaagataaaaatttagatacgcttctattgtcaaaagccttgtatatctaaagctaaaattacttctgatttcctatccataaaagagaggtagagggagggaaatcttgctgaatttgatactagtttaaacatcctctaattgaggtttttttgtttgtttgttttgttttgttttgagatggaatttcgcttttgttgcccaggctggagtgcaatggcatgatctcggctcaccgcaacttccacctcctgggttcaagcaattctcctgcctcagctacccgagtagctgagattacaggcatgtgccaccacacccggctaattttgtatttgtagtagagacggggtttcaccatgctggtcaggctggtctcgaacacctgacctcaggtgatccacctgcctcggcctcccaaagtgctgggattacaggtgtcagccactgcgcccggcctcctctaattcttattaaagagccctgtcctgaaacttctacttccccctattcttcttacactcaggaagagaaaggagcaggaactgataaagggacccttctcacttggaaaccctcaacctttgaatatccagattttctgctgcacatataattgatattgtcacaacatttgggctcttttgtagcagtctgtgactgatttcgtcttgttttactttatttactgtaacttcaaatgttgtagcgtcttccaattagtagcctcttcatgaagataggactgagtattttgcataagacattcattcaaaataaaatgaaagattaaattaactttattaaaatgaaatgattcggatagcatcctactcattagcctttagttcattttaaaacaaatataatattatcgtctatgctttcaaataaatgtcatacctccatctaattaatagtgataagcagttaagaaaaaataaaaattgggttcaatatgacttttacaacactattttaaacatccaaagagtactcaattattttcctactttccattacttttgaaagcgaagtattagatagcttttaaaaaattacaacatttgtatgtatgagtaaaggttagaatttaaagacagaagctacaaataatatttttcatcttttctatatgaaaagacaccagacccatttaatgcacgccatgagcgtttggggactttgacaagctgacttgtagatgtaaaaaatctaattaaaattgttgtcaattaagttacagtggtactcagataattgcatcactcttcaaagatttgtcttccaaacattaattttaagtatttcaaaccattttattttcttttttcaaaaactttctgatgcagacctggtgttttgttgttggtaattagtgtttacaatcattcacataattttttaaacatttgttttaggcagaattcaagtgtgtatccataaaatcagtaacattttgttttgtaattagaaaacaactggactttattagatgtaaatattgtttaaatttacggtgaaatttcgtgtgccaaggaactagaggtagcaactgaaggataattcatgaaactaaatattaactcaaaaggtttttttttttttttttttttttttttcccgagacggagtctcacactgttgcccgggtttggagcgcaatggcgcaatctcagcctactgcaacctctgcctcccgggtacacgcgattctccttgcctcagcctcctgagtagttggtattacaggcacacaccaccacacccggctaatttttttctatttttagtagagacggggtttcattatgttggccagactggtctcgaaatcctgacttcgtaatccacctgcctcagccttccaaagtggtgggattacaggcgtgagccacgtcgcccggccaaaagtattttttcataagcaaggttgtaaagttaaggttcaatacaacacatttggttgtgtaggagtgaacatctggaaatgtttaataaatataattttactgcatgttagaaaaatatagctaattcttttagaatattattttgaagaaaataataatatacatggtgtgcagatatggcacaatacatgggggtgggctgaattttgggaaacactgatttaatatcacatttattgtatagatgagggaactgagatccagagaaataaaatgaattattctaaatcatgcagttttaggatagttaattaaatttgaaagcaaataccatatctacctagaataaataaaaatgacttttttttgtcaataatcattaagcatttactgaagacttacaacatgtgtaaggtgttatgatggattaaaaaatgcttcccaactctattagttcaattgaggaaagttcttgctttaaggatatttgaactagcagagagcgcctttactggggcctggaaacatgtgggacactaaaatagcattcacggtcatacagtgttctcttcttaatacgctctcaattcaatctcctatataccaaatactataatattaaaattctaatatttttggctttttgctctgaagtcatttaatcctcaatttccagagtgatccctttgtaatgtttagaaatgtcaccttatatatttaaaattatgtattttgacagtgtggattctctgtttcgaacagcaaatttataaattatgaaattaaaaaaacccaattatcttttttttttattattttatttatttatttatttatttatttatttttgagatggagtctcgctctgtcgcccaggctggagtgcagtggcaccatctcggctcactgcaagctccgccccagcctccagagttcacaccattctcctgcctcagcctccagagtagctgggactacaggtgcctgccaccacacctggctaattttttgtatttttagtaaagacggggtttcaccgtgttaaccaggatgatctagatctcctaaccttgtggagacgcccacctcggcctcccaaagtgctaggattacaggcgtgagccaccgcacccggccaaaaacccaattttcttgattattactacagttcagctatatcagtgcacatcttatctaccaggaaaatgggtaaaatgcatcatctgagatctttatcaccagagattctgattcattagtttttatttttacaaaacccacagggagcagcagaacacacagggaggacagggtagagactaagaatttatagttttagcaagtagcaagctaattccaatgttggtggactgtaagccatgctttgagaaaaatttaatcataagttataaaatatagaagtgagaagtaaacatggttgaattgaattaatccctgaaaacatattgaactttattcagtgctattttaattgtattttttaaagtaaaggagaacatgttacttcaacatctatcaagagtgaattatggtttttatttgtgttttaaaatatcttggctgtgtacatttataagaaacaaaacaaatttttttaaaaaactctccattaaaagaacttcatgctaactctgggacctcaatctatgtatagagtctcaacaggaaacttaaatgacaaggaaatgagaaaaattttgccttcttattccttgttgaatcaaggcagagtccaaggttagtacactgcatctaaggtaggaaattgcttaagcagttttcaaaggttcattctgccttcaggcaaggattttctatttaaaagggataagtttagccaggagcaaaatattcctcattgttttttctctaaagacagaaaactctcagtaattttaacctccttgattgtatgtgtggagcaatatgaagctctgaagtaactttgtaactgtgctgagtccgtgaaggaggtacactagttgagtaatgaggatgagcgaggcatcatttatcaaaataatcttcaaaatcttgccttacttcacacacattcttatgtacaagataaagagaattaagttatccaggtcagcatcagcccaaatatacagtttgttcttttgttcttctacagtcagcataaccaggctacaatcaggatacctcccatccttatcagaatttcacaaagaagttcattagtgtgtcctgtcactctgaaaaccatatagtcctgcaaagtggtttgtaagtccatgttgatggatttatgccacacctttagggacaaagatcaagcatccttagctactttataatttggagaatgacttaagatttcaagattggggaggctttttatattttactctccttaagcttttaaatcctctgctcagtatatttacttcttctcagataagttttatagagttggagaccagaaaagaaaaaccgtctggtgtttcttgctccccaggtatttctaaacatttcaatagctttgctacaaatactcaatttgtaccattcaaaattaggacataaattcagaaatcggaggataaaaataaaggcaacatggcagttgtgattgatataactgggttaaattcttctacagagaagagtttttcaagaagcagttagatatctactttcacaggttgatttaaccaggatgtcacttgaacaaagaaaaattccttccctacattgtctgcattacattaattctccattaaaaatgtttattattcagtgtaggaggcggttttactcagtcatctttcaaatatctgcttcactcatctgttccaactgatggtgatagtagtttagaaaaagtatttttaaaaaacaaatatttgaaatcatttttatgtagcccagcagtacatttcatcgacttcaataaatttgatcttattgtttgtttagagtaatattggtgtctgttatttgttgataagtctggctagaggatggggagaaaagagagagtacctggatggtagtttgaactttaaaagtctctattattaagaagttcaagatgattttacttctgtaggatataccgcttgtttaagatttcgtggctcttttcaaaagcaaaacagtgacatctgttttatgatgcatatttgtaaatttcttatactgaatcacacttttttctttttatattcatgtattcttttagcaaatatttattgaattctttatttgcatgatatatagtgatagaaataatattccctgagctcaaagtttatcatttagagagatgacatccatacaaggaattagagaagatagcctttattgaatgtcataaatgaataggaaaatctctagcaagagttcaaatgaggatgaaatcatgtaagacaaaatcccatttatacaaacccgtgaggctatctaaattctgttggtatacaaaatgttatttcacgttttgctgctcaccaagctttgagggaaatggcatcattttaaattaattactcttgattagcataattatctggctttctagagctttatcttattttgacatcaaactgttaaaagcatatagaattgtatgtatattctattttcaatttcgtttaatgcaaatgtatatagacaaagactagaaaaaagatataaaatatggtgattttattttcaaaactgttaatgatactatctttctaagtatatatatttttaaaagtaggaggtatgagggtattgatactttgcctctcccaatcagggaagacagagtaaatactgatgtgactgacccttgtgaaggttgactgacaccaataaaatgacacccaaaatagtacttcttcataggcatcagactgagaaaggaaaaaatgaaataaagtaaatagtactacatctggcacatctaagcccacaataaacattagccctaataagtgctaagcagtcttctcaatgtatagccaggtggactagtagcagtgtatacccatacagctgacttcagagaatttcaaagcacctttgttctggaagtgttatcttctgccagagatcccatatacacttgcctgtaaggcaagggaaccattgtcatttttattcatagctttattcccagggcctaacttactatttaaaacaaagagactttcaattatatttaaaccaactaatcaatcatttattaatttaaaaatctcagtcacaaaaggaaaaataagctttaatcacattcaaatgtttcaacacaatgtgcaggagaagttaagtaaacatcatgcaatgtttctatgttaatttgttctacctggattagtggtgaaactcctcattacggaaagtcaagtatgcaactgttctttggccaagagcttttgaatctcatagtgctccgaattaatgaatccaattggaatccagtaggtaacttagcttaaatataagaataaaagaaaattgtgtatttataattttttttaccaaacagaaagttcaacacagttttgtatgtataaaaatccaaggaattttttgtccagttttggattcagaattttttacagaactcatgattctaggatgcaaacaggaaatcaggatctcaagtcaggctaactctgcaaactgtgtttattcccgttctgtgataatgtgaccttcccaaagcaactcaagattaagtagacaggtagggatgaaaatgaaatatttttggtggagcatttggaggagtattaagaactgcttgcacttgattacctattaacaactggtctttgaggggctttattttcctgtaaagatgatgcaaaagtttttcctctttatcttagatgtcttcaagagacagaatttaaatcataaacattctagtccataatattttttttctcagtgaacaaatttttttccaccttctgactagatatcaaatactaaagcttagtttcgacttttcttgtcacaaaggaaaaataatgaatgattataattatctgattttagctactgctgcagctgaaggcaactgaattttgaaattttgtcatataactgtatatcatagaaagtgtttgtttcgtttcaacatatttctaattcatatttaaggataccaattagtatctatatattctagagggataataaatatggccttttcaaaaaaacaaaaacaaataagaaaaaaacacaacaatttggccacagagatctttcttccttttttattttggacataattttgctcttttctgcccaggctggagtgcaatgacgctatcttggctggctacaacctctgcctcccgggttcaagtgattctactgcctcagcctcccaagtagcgtggattacaggcgcctgccaccactcccgggtagttttttgttttgttttgttttgttttagcttgagactgagtctcactctgtcgccccaggctggagtgcagtggcactatctcggctcactgaaacctctgcctcccgagttcaagcgattctcctgcctcagcctcccgagtagctgagattatagacatgagccaccatgccccgctaatttttgtatttttagtagaggaagggtttcgccaagttggccaggctggaatccaaagcctgacctcaggtgatccgcccacatcggcctcccacagtgcggggattacaggcgtgagccacccagctcggcctctttttttctttaacaataaaaatacactcactcattcaccaattcaatgttatagttctcagagctcgccacctgagttactcaaccctaaccaaattgtcattttcctggcttcttttctttcatgatgccatcttcacctcttgattttacatatataacatttacctgtcactttccaatacagaagctaagtacttggccaatcaaatccttcactgaatactagagggttctcaaggtggccatgtgagaattagtgcaatataaagacaaaagaaaaaatatttcgtctgcttccttttttttcctgacccaataattgatttgcattacaacacaagtcaaggtaaaaattctatatttatgattttatagttgtcaatagatcatatgacagtattgtgattagagaaatggaaggttgcagtgcttaataaaacaaccataatggctgctaaaaacttttgttatagttattaggtagaaaacattactttttaggtattgtttttattaaataggaaatgaatgttgagaaaaatattgtctttcaaataatgaggggaatgacagaattaatgtgatgttgaaatgttttatgaaatatatgttttgatgtgatatcctaataggtgtaggatcataagcaatacactttttaaaaagtattatacttttaaacatattgttttaaaaataaaattagataagtgatttaaatactgttactaaatagtatgttaggaattaattttctatacctttcaattttcattatgtgctggtaatattcttaggacacatatcatttagtaaggattagagccagctggggcagattatggctcaggaataatccttaaggaatgcccagattcaattattcctacttaaatgatttagtttggatgcatttggtggagtagagttttattttagaagaaaggtgatattttttgtctttagttctactcttgaaatagtctgccagattgatggagcctcatttagggctcatcagaagctgtgaacgctgcaatatggtttgattatagtgctaaatatcaagcaacagagacaagaataccatttagccaggtgtggtttacacatatttgaataaaaaatattttcctcagaacttaagataatttgttttgtacagaaagcatattttacagatcttaggaagcaagacttttaaataatgtaagactgtaaataattttagtaaaatatttttgattaaagaaacattactgaggcaatactggatagtcagtggctctctcattttttttttaatttcaaatgcctagaactatattaggggttttcagttagaaaaacactctgttaattaaaaatgagacattttatttactgtgaaatattttagacccttcatcacattaatatacatgcatacctcagagatactgtggcttcagttccagacctccacaataagtgaatattgcaataaaacaagtcacaaagatgtttggtgtcccagtgcatgtgcatataaaagttgtgtttaaagtatactgcaatctgttaattattcaatagcatatgtctaaaaaatgtacatattttaatttaaagtaaaacctttggtggttaaaaaatgctaacaaataatttgagccttcaacaagtacaaatctttttactggtggagagtcttgcctccatgttgaaggctgctgagtggtcacagtagtggttgctgaaggtcggggtggctgtggcaatttcttataataagacaacagtgaagtttgccacattgattgactcttcctttcacaaaagatttctctttagcatgtcatactgtttgatagcatttaaccacagttgaacttccgtaattacagtcagtcctctcaaactccatcactgccttatcaactcaatttatgtaatatttgaaatcctctattgtcatttcaacaagatttatagcatcttcactaggagtagattccacctcaagaaatcattttctttgctcatccataacaagtaactccttatctgttcaagttttaccatagtattaccacaacttagtcacatcttcaggctctgcttctaatgctcttgctgtttttatcacatccacagttattttctccactgaagtcttgaacttctcaaagtcatccatgagggttggaataaacttctcccaaactccttttaatgttgatattttgacctcctttcatgaaccatgaatgttctgagtgtcatctagaatggtgaatcctttccacaaggttttcaatttattttcccagattcatcagaggaatcactgtctatggtagctagagccttaagaaatacatttcttaaataatgagactgaaagttgaaattactccttgattcatagctcgtagaatggacgttgtgttagcaggcatgaaaacaatgtgagtcttcttgaatatctttagcggatgtcttgggtgaccaggcgcattgtcaatgagcagtcataatttgtaagttatactgttttctgaacacttggttttgaacagtgggtttaaaatattcagtaaaccatgctataaatggatgtgctgccatccaggctttgttgttccatttatagaacacatgaagaataggttagtataaatttactggatccaggattttcagaatggtaaataagcattgacttcagcttagggttgtcagtttcattagtccctaataagagagtcaacctcttctttgcaagtttgaagccaggcattgacttctcctctttagctatgaaagtcctagatggcgtgcttgtccagtataaggctgttatatctacactaaaaatcggtttagccacttcatctatgatcctagctagacctctggataatttactgcagcttctacatcagcacctgctgcttcactttatacttttgtgtcatggagatggcttctttccttaaaacccatgaaaccatttttgttatcttctgacttttcttttgcagctttcttacctctctcagccttcatagagttgaagagagttggggtcttgctctgcattaggttttgatttaagggaatgttgtggctcgtttgatcttctatccagatcactcaagccttctctatatcatcaacaagaatgtttggttttcttattatctgtggtgttcactggagtaacacatttaataaccttcaagaacctttcctctacaacacaacttggctaactattcggtgcaagaggcctagcttttgccctgtcttggcattcagcatgccttcctcttgaggcttaattgtgtctagttttgattttaaaataagggatgtgcagttcttcctttcacttgaattcttagaggccacggcaggacttttcactggcctaatttcaatattgttttgcctcagggaatagggaggcctattgaacattgaaactctgcctctttccagagtacaacaagttaactctagctacctgaagcctcctttaatgttcacttgaaggactaatggaattgagtggaagctcttctcaattaataataatgctatttaaaaatttcatgttgaatcagaatgtaatgctttatgtgaaaagaattactaagtatgtccatacagtgtcagttgagaaatgttctgagaatggtactatcaatgtagatgataagctggtgacatttggtctccccaaaaaaaaaaaatcgcatctaaaaggcaaagtgttttaaataaaggtgtataggattaattactgctgcacagtgttacagaaacaagctgaaaaacaggaacagattcttctttcctcttaaacaattcaaccatcaaaataaatttattgaaataaaaaaactgttaaaatttaagtaagttaaacttgatggttttgcctcttgtgtaatcactaatacgacatcttcagtccttgtcaggatagaactaatggagtacaacgtgttgtaaggctgtacttttatgaattaatgatctgaggtttgatggtaatgtttctactgtctttgtaggtttgatcttcctttgccactgctgacagagctaagcctgggggtgttctggttgcaacagcctttccttattgttgtttgattttgagaactcccatgttattgatacgtggagggaattgtaaaacttgttgtgaattaaagctaagcctcagattttttgtgtctggatttgaaattaactcagctctcacttgttcacattgctataaatatgcttagcattttttgtgaggaatatctaaagtgccaagaatgaaaagtgggctgccctgatggtacttttcatttcaaaatcaaacatattccttgcttttgtctgtgatgattctgttgtttaaagaacatgttcttacccccgtttttattgtttggggattctttgttgtaagatgactctcagaaattactttttgattgatagtcagttaaaacttctgatcagaatgaagttgtcttcttcaccactttcagttgtaattctggccaaaagcaaaggaactttgatttacttaatttgtgcacttggctaacatgccgtttatattagactgtttggaaatagcccaagtggtggctgtattgctctttgtgaacctgttatgggtatagtaactctcaagtaggaaccaactgtgttaaaatgttaacttccacatggtaatatactatttctttgttttttaagaaaattcaactgaattttaagctaaatgttcttaatgcaagatcaatatcttgattctcatggttttcttttataaattttggtttatttttaataaatgtggacttgcaattgcaattacaactttcagccctttctagtacaaaataatataataataataagcctcaagaggcctatttcctgaggcaaaacaatattggggaacagccagtgggtggagcagccagaaccagcacaacatttattagtcaattttgccatcttatataagcatggtttatataagcatggtttgatattacaatagtaatatcaaagatcacttagtatagatcaccacaatagatataatcatgaaaatatttgaaatattgcgagaatcaccaaatgtgacacaaaaacagcaagagaggagatgctggaaaaatgggcacaatagatttttagatgcagggttgccaaaaactttcagttagtaaaaaacacaatagccttgaagtgccataaaatgaaatataatgaaatgaggtatgcctctccctgtctccaagaaaaatatccaagaaagacctttatatttgaccagagaatctttaaatttgaaatatcttaccttgctattattattattttaaatttaattttatttaatttaattttatttatttgtatttattttttgagacggagtctcgctctttcgcccaggctggagcgcagcggagcgatttaggctcactgcaagctctgcctcccaggttcatgccattctcctgcctcagcctcccgagtagctgggactacaggtgcccgccaccacgtccggctaattttttgtatttttagtagagacggggtttcaccgtgttagccaggatggccttgaaaacctgacctcgtgatccacccgcctcggcctcccaaagtgctgggattataggcgtgagccaccacgactggcccttaccttgctattattttttgggggaaaaaaaaaactgttgaaatcactaatctaaatattattgcttcccttttacaattatctcctgtcttcaatttccttgctgtgtttaacataaataactctacatatgatttctgtaaaaggccacataaacccacagtactgttaatatggtgttttgtttttttgttcatattgttatcattattgctggttccttgtgctatttcccatcctggaggtctacactctcctgagagatggtaaagagagaaagcccagcaacataatgtctggatggctcagtatccttacataggacacccagagggtgccccaactcagcgtacctgattactgggtttatttttgcagagcttggtgcctggtgactagaaaagcagacattagaaatttgcatatctttgtttttgttttgttttgttttttatcagctctggattgaagaaagttggtagaagtagcagcaggtcagagaagttccttttaaggttctggccccagtacttatgtgcagaaatcatttgtgtcatgttcattgtgtcactcattgtgcacccctctcaagtgctttaaaatgtcttctccctagttagaatcaatggatcttgattctgatctctgcctctaattgcatgatggttttcatatcatggtgtcatcattagataatggtgctaggaccaggtctactgcaaagtagagtagaggaagcacagttttgacaaagatcttttcttaatcagatttcgcctgtgtattttggatgctttcactattgatgaaaagagaatattggcaaaatatgttcaaagtgcctcctgttttctttacctttttctctcttgctttcttaaaatctgattctgtccttaagttctggctgaactgtgcattttcaaattttctaactcattgtctttatttctttctgtcctcttttataccatgttctctcgctaataatagcttctcatttcatgcacacactgtttctatacatctgtttcctagtgcttaacacaaagaataatgcagagtaaaccatttatatatgttaactgaattaataaataaatgagtgtgatagtatctatgaaacctagagttcgaaggattatgatgcagcctatatggtgtatgatgaaccatctagcttaacttgttcaaagagagaagtttatgaaaagaattgttatttcatctttctcaactttctggtactcaaacgattatattgtatctattgtttaaaactgtcatttattctaattattaactccagaacacataataaatgtacttattagaaatacaacatcttagggtagaataaagggctcagaagaggtttttggggggtagtatttaatgatttaaatatttagtaagaaagtaattatttatataattatttggctattctagaagcctgtaatctttcgaatttgcccagtcaaccaagcctggggtttaaatgaattttcaacacctttctgctgacagtcacacatgttaaaccttgatttgcttaaaagtattattaaggatgagaatgtaatactgccagtggtatgtggtgatattattgtggcgctggggggatgaaactaacgtctttcagtaagtaaatgtttaattttacacaccatataatcagttgtattattgcaagtgcacagcaggtatgtagaaaaatagaatgcatatatttaacatattagaaataactttattaatattcctatttcatgttctcatgaaattttaatcatttgcattttttagcttcaaacatttttataatatgtttctcttgcaccctttatctagtagctgacaaccatatagtgatccacttatcagttctttttaatgcaaataaagcggacattttttacctattagatcacttggaaagaaaaaaaaactaaaatcaatgtttcatgctacatattatctgtatatgagcagatatacacattttacaggtcaattttattgtattttggtaattgtctttcctttatcttctcttatttagtctttagatttaaaattgaaactgttgttgttgtactgaatgctaatgcagtgcaaaccaagacagtatgttttacatggcctgaatagattctttgtcactcccttaggaaaaatacgttgttcatctcatggaaataaacctttatatatagaaaagtatttaagagaaagtaatttttaccgtttaagtattaaattttacctaaacttctattacgtgaatctcagtagatacgttcaccattataaagaagcagaagttctggccagggcaatcaggcaagagaaagaaataaagggtattcaaataggaagagaggaagtcaaattgtctctgtttgcagatgacatgattgtatatttagaaaaccccatccatcgtctcagcccagaaactccttaagctgataagcaacttcagcaaagtctcaggatccaaaatcaatgtgcaaaaatcacaggcattcctgtacaccaataatagacaaacagaaagtcaaatcatgagtcaactcccattcataattgctacaaagagaataaaatatctaggaatacaacttacacaggatgtgacagtccttttcaagaactacaaaccactgctcaaggaaatgagaggacgcaaacaaatggaaatatatcgcatgctcatggataagaagaattaatatcctgaaaatggccatactgcccaaagtaatttatagattcaatactattcccatcaagctaccactgactttcttcacagaattagaaaaaactactttaaatttcatatggaaccaaaaaagagcccatatagccaagacaatcctaagcaaaaagagcaaagctggaggcattgcactatctaacttcaaactatactacaaggctacagtaaccaaacagcatggtactggtaccaaaacagacatatagaccaatggaacagaacagaggcctcagaaataaagccacacatttacaaccgtctgatctttgacaaacctgacaaaaataggcaatggagaaaggattccctatttaataaatggtgttggtaaaactggctagccatatgcagaaagctgaaactggaccccatccttacaccttatacaaaaattaactcaagatgaattaaagacttaaacgaaaggcctaaacccataaaaaccctagaagaaaacctgggcaatatcattcaggacgtaggtgtgggcaaagatttcatgacaaaaacatctgaagcagttgcaacaaaagccaaaattgacaaataggatctaattaaactaaagagcatctgcacagcaaaatagactatcatcagagtgaacaggcaacctacagactgggacaaaatttttgcaatctatccatctgacaaaagtctagtatccagaatctacaaggaacttaaacaaatttacaagaaaaaacaaccccattgaaaagtgggtgaaggatatgaacagacacttttcaaaagaagatatttatgtggccaaaaaacatatgaaaaaaaaagctcatcatcattggtcattagagaaatgcaaatcaaaccacaatgagatgccatcacacgccagttagaatggcaatcattcaaaagtcaggaaacaacagatgctggagaggatgaggagaaataggaatgcttttacactgttggtgggagtgtaaattagttcaaccgttgtggaagatagtgcagtgattcctcaaggatatagaaccagaaataccttttgacccagcaatcccattactgggtatatacccaaaggcttttaagtcattctactataaagacacatgcacacgtatgtttactgcagcactattcacaatagcaaaaacttggaaccaaccaaaatgcccatcaatgatagactggataaagaaaatgtggcacatatacaccatggaatactatgcagccataaaataggatgagttcatgtcctttgcagggacatggatgaagctggaaaccatcattctcagcaaactaacacaggaacagaaaactaaattcctcatgttctcactcataagtggaagttgaacgataagaacacatggacacagggaggggaacatcacacaccaggggcctgttggggagtcgcgggggctaggggagggatagcattaggagaaatacctaatgtagatgatgggttgatgggtgcagcaaaccataatggcacgtgtatacctatgtaacaaacttgcacgttctgcacatatatcccagaactcaaactataagaaaaaaaagcagaagcaattaatagtgttgcaattaattttcagttttaaaaatgtataagtacctgttatgtgccaggcattgtattacacactaaagatacaaaagaaataagaatttagacatgatctccagatacaaatagcagactaagcaaagtagaaagagaagtcctggatgaaccacaaggttgtttatctgttctctaaataagaagtgtgaagtgttttggaaaagaaagggagaggttgccttccttttcactagtcatcaggttgtcacctagagctgagcagcatttttttttaagaaaattagcacatgtactgggtgaaaacagcctattttctattttaatgagctaggtacatagaaaggaagacgtaaaattttcctaaagtagaatcagtataggctgtaatgttttgcagccagaatctgggacagacttgcctatctgagaataaattgttacatcggcatcataagagtcataagtactgggggtgcagagtacagagcccacttattgagtcacacttgcacatataatgattttcagtctctgatatatgtaatgcataaatggccattaaagtcagatttttcaagggcagttctgtgtcaaatattctttcctgttttcttaaatattgcattaacatattgagagattcccattattttacctttgaaagtatgcctcttataatgtattttgcacccaaaagtatctctaaacagacacatatttaattatatttgattatgaaaatgtaatagctggtttttttttttgtttttgtttttgttttgagatggagttttgctcttgttgcccaggcttgtgtgcagtggcacgatcttggctcactgcaacctccgcctccagggttcaagcaattctcttgcctaagcctccctagtagctgggattacaggcacctgccaccacacccagctaatttttgtatttttagtagagatggagtttcaccatgttggcctggctggtcttggtttaaactattctgttaaaaaaaaattgagggaacttattctggggtaaatgatgttttcaaatacattgttttttgaaaaatttgttctgagagatatattttcttcattgttaaaaaaaattgagggaactttttctagggtaaatgatttcaaatacattgttttttgaaaaatttgttctgagagatatattttcttcattgttgtggaaatatattatgtaagctatattattatgtgtgagaataaagaatgtattttctctgaaaatgtggcagctcattctttgttcacagtgctggttaaagagattaggccacaaatattagccatcacattgttaatgcactcaaactgccagttcatgaccctgagattggagaaattaataagaaaaatataaacataattttaaaaataactgatagaaaatccacttgggaacacataatttttaaaatctaaaatcatttaatgataaaatagtatgtggtcttgccaaatgatctactcttctactgtgaaaaccatagattattacagatttgtaaagttgttgacactttaaaattaattttatttgttaaaggaaacaatttactaacattaaactgtttagcataaaataaaacagcatgcagcatttcattacagcaaacatgaaatatgaattctaaagaaataaaatatgaaagaaatgcattctttttatagcctgaaaagacaatattaatcaaaataaccaaaatactttgaaaatcaatgttgaatgtgaatgtttctggttttctttttcttggacttgtatttacttttgtcaaggtaacataaagctacagtatatatcctctgtaacagtaaaactcagaatgtagattttttttctgagtatagtgcctaccctagtgcttaccctacttatctttataccccatagagtttaaacccgtgactagcagaagtgagtgctcactgatggaaattaaaatgaatatatgcctgaatggatgaataaataaagttaaccatctgctccttcttgttcgttccttcagaactctttattccatattggttagattatcacttttcaacccaggggcatggtggggaaataggaaggtatctggattgacataaatcctgagcccttgtcctggctctgaccctttctagttatcagacattaggcaaatcactgaacttctctgagcctgtgttctcacctgcaagatgaaagggttagaatagcatgatcccaaaagtatgcttctatattataacatagtagcccatgtgtaactttttttttcctcttaatctttacagtttgtcaaatctctgctccatgcttttcttgggtgtaaagagataattaattatttctgtttaaaagatttcctactgtgccacagctggcacaggtgaaagaaattaagtaagaatgcagtagcacaagacatcatcacccactctgcttaattatagaagtcagaacttgaaaatgagatttatgaggataagttgaaatgcagataatatgtttcgggataatgtagagttgatgatgtgttattttggaatcttaaatttccaagttctgcataagtaaaggatgatggtatcataaatccaagtggaaaatggatccttcagtgtctaggccagtgagtttgatgtggacccagtaaacttttaaatttgataattaattacctagagtgtgggtactaagaaaataaataactacaagctagcaagtcttttggttacagctaggtcagctcaaggagctgtgtgaaaataatggtctttaatttttactaggcatttaacaaaaacatacattatatttttgtccacatggtagagaaatatggaccaaagtacattcataaggttgatcaaacctacccaaatagtgttcatataaatctagagagaaggtctcctttaccgtgttatggtggtcttcttttattagcttttccatgattggatgtttatttgcttattatttttcagtgactgaatatgatatttttaaggttctagatgatgatttagtgcttgcatttgtatgaatgtttagtgttatcttgaatggccaggaggatagactataaaccaagtaggtctacattttataagacaggggttttacatttgaagtttaatgttaaaaaataaataaataaactacaagtacagaatcctgagggtcccagcttgacaatatttcaaatggagaatattggtgattgcagtaatctggagcttaattaatagaaggatagattttaggcaaaaacaggtaatattcctactatgtactatattgctcagacttcatgatgagtacttaattatggggaacacgtttaaaagaacaattgtctaactgaaataaattcagcaaaataataagattgttgaaagttctcaaaatcttgttcagtgaaccgtgcttgatttactatccagattattcaaccagtctttattttatggtggccataagcctgtttccctcctgagaatcaagacttcttccactattaatccttgtatttagggtaaagttgactctacagtctgcttcttgggcaggtcaaggggagttcttgaaatagaattaagatcagtaaagatgcactgtacggccataattgctatttatggccagtgtccattctaactggcctgaacccagttagtttatatatgttatgttaaacctgtctcccatatttaagttaatcaatatattatatttgtcatgccacagggattaatactgtggttaatgagaattggctggggacattttctgtcttttccactaaactcagagttatgaagtcacaaagctgggactatcttaacattaaaatggataaatctgtgaggccaacatggggtagaatgtaagacaagttttgaagatggcaaaacaaggttctaaagatgtaatctgagcctctggtcataccaaacctgtagctggtagatctactccagtacatgggttaaagaaagaatgttttgcttaagccaaaacccaaagagcttgaattgacacatcatgtagaaaacatatatatatatatatatataaactgaaagatgtttagcttacaagaggtgagggaaaacaagttatataagcttatcagacttctcctcattatttagagagaatcaaaggctctatctgatgtaggaaggtagaattttcaggtagaccgaattgggatcaatgaaaaaggatgtacatcttcacaatttgagttaccagtaataaaacaagctgtcttctgtgcttaaaaaatattaaaatagagtgtagtttataaagactctcatattgagttgaaagttctactatctgttactcaaatccttagaatgtgttaactaactactgtgccagacattataccaggcactttatataaatttcctgtaaagtcagtaccattatgaactgaagaaaccagggagtaacaatgttgaataacttgcccaaggtaaagaaatctagtaagtatcaatcaatgaacaacaaaccctatgtgtctgacttttctttccactaacattctagcaatacctggattttttatgaattcaaagtaattatacaactcccctgttgtcagtattttagccatgatttacataacagaaaaatgaaacagtttagttcaaaatgaattatttttgatttagggacagtaaggaatttctaaaaatgcactaaaagcactttagtacgtaaattccatcatgactaaaaggtgccatgcctatgtaagtataattgtgctgaggtttatacaattccataagtactaaaaagagaagttttttaaaaagtcataaaaatgcaaaacaaatatgttctgatttctgagaaagcctagaagagcccccaggcaatatgtattcaagggctatgtagccaggtgttcccctctggggttgtattcaacgtgatttcttgagaattaagacagtagtgaggaaacacagaagaaaaaatttctgctgtaaataaaatcctgatagaaaaagcataccagggaattttggttgataattgtttcgctaatttattgcctctcactttatctcgaaaaataaaacattgtttggcccttattcaaataattttcactagtgcaggaattctggtaacctgatcatatatatctatctttattatgagatcttcagttgtttaaagttaccatattttataatattatatatatatatatatagtcaattgaaaaactgatgtagtcgagaacacaccttgcctaatataactgctacattgaattcatttacatcataacaatttctcagttctttaaaacagaagtttaaaagcagattcattatgtggttcattagattgaattctgtggtcagacaaacccaggttttgtttcttttgtgtgtgtgagacggagtctcgctctgtcgcccaggctggagtgcagtggcgcgatctttgctcactgacacctctgcctcccaggttcaagcaattcttctgcctcagcctcctgagtagctgggattacaggtatgtgcgacgacgcccggctaattttgtatttttagtagagacggggtttcatcatgtttgccaggctgatctcgaactcctgacctcaagtgatccaccttcctcggtctcccaaagtgctgggattataggtgtgaaccaccgcgcccagcccaaacccaggttttaattatgaccctcctgtttgctgggtgaactccttaagactctgcatgtctctgttttctaatctggtaatgaggatcctaatgcttaccttcttcagagattattactggtattaaattatattattttaaatgtctctgtctgcctgcaatggtgctgaatcaacagtagctgccttctctgttttccccaaacaaattctccccatgtctctctaagttctctgcactaatttcaaagttaatgaaaaacaactatccatctctttaatactattcagattttaagcctgtgattttgtgtataaactattctcaatcatacaaaacagtgtacttttagagaaagggcaaagttcctattttgtttgttttaaaaaaaaagtaagttagaatgaatgggagttcatttttaagtcaacatctatttcccttttttgtcactctactttctttcagaatctttccatgccacttccagcaggacttacacgtgggtgccctggcttccttagttgcattgcagaatagttattgtaaacagaaaatctttcactgccaaatttgaacttggagtagggggtcttccctaatttgagaaagtcattcaagtgtgtaactatataggaaatgtattactttataagtttggagaggcttggaaatattgctggaacacaacgaaaaaaggaaatgaaatgaaacctcattaactctgtccctaattcttttgtaagcagatagcagttcccttgaaatggaaaactgggaaaaaggccacaaagaaattatatgattattctcctaagatcacataggaatgaagtacaacagttatgagcataagctaagatgatttaggatgctaaattttggctaagcaaacatatacacttttccagcttaggaagagattcacgtatccaacactacatcttctttacattttaatttttacttcatctgaaaaattgtaagttaaaaaaaagttgtagataatatataagaaaatacaaaacaagttcaaacccacacaattatttttcatatattctagttatttctcactgatcattttgttgaaaatacatgggatatatcaatgtcctgactgcatgaaaaagaatttcagtgaacatccctaaaagaaaagacgcatatccatcctttcttccccgtacccagcaaaatgagaacataaacatttagtccctaaaagttttcagttgccagaaaaacaaagaaatatagttacacatccatttttaaccatatatagaacctagctctgatagacttgaaacaaataacactatttttcccaatgatttctaaaagcagcaaaccatgaaatacaatttcattttcctctaatggtaatagaagatatttcatgttgctaccaaacatatactgtatattcttgtctcttcaaagtctattttttattagcttaaaaccctgagctgttaaatgtagcataaaacttctgtgaaattacactgctttgcatcaggggaaaagggtcttttaattggatgattgcagaagaggagagaaaaaggagagagccttcaaaagtttgggtagttcagattttaaaaatctggatgcttcagcaaaattgccaatcctctgagctttgattattattactaatgtagcgcttacagatactgtaaattagatcttgagcacattatgggccaaataccatccttttatactcatgtgtaacctttaacaggtttcaatgggaaatgtgcatggttactcgaaagcagttttcccattatttttctactctaaatctgatacaaaataaggcaattagaagaaacatgttaaaaaattaatagtaacaataactttaattttgtatagacttttccaattacaaagagttttacacaacataacattatagctgtatagtgaaataagtttgtgtatataaaatcatattaaagcatcttcaatatcaaaatttaacatcagtatatctgataaaagatgattgtttagatttatgtttgacagagtagcattttgaaaagaataaaattttgaattcaattctgttaaatggtcaaacacgttaattttaataataggagtaatttatactttatataatctataaacattattcttttataattgtttttagtttatatttttcttgtatgtttgtaaatctgtcttttgttttccctttatttgcttgtttgcatatttctttttcagttttccgaaaaaatttagctatattatgtttttatttttctggttcattgtcttggaaagtattcaccaggatacaggcttccaacaaggcatattctgaggaagcatcctaagtcattttcacaagtggttgaatttctgagaagtaatatcagtcttgagctacttccattatataacctaggataaaccctgtgcattctagttattcaacaggacttggtatttcctaagcctgtatcaagatgcattaactgatttaatagtcagagttctttaattgtttgttattttgttttattcatttacattttttacaaacaagaagaacactatgatcttcagatcttcagaccaaaaaataagcaaaaacaatgttgaatgctattgtgcaaaatgaaagccatcaataaacaatatttgctgtgggtttttgcttgtacctaagttgatgaaacaaaggatatctctacttttgtggaagagagagaacaataatagcaataaacataatgaataaacacattttatagcctgatggaagatgaagatggtaattcctatagataaagaacagggtcacaaagatcaggtttatggaggagagttgcttgtaattagtcctagccctcgtcaaggaggtgagggaatggtcaagaaattagatgggagaggagtgttctagagatggaggggaaaggatgtaaatttgaaaatgtgcctgatgactttcaggaccagctgaagggtaaatagtgaaaatagcagggaaaggtgaggttagagaaagatgggtaggaatacaatatgaaaggtcattgtcaactttaattcttatttaggtgtgaaaactctaacagactctgagtgacacaaagtggcttttaacaagatcattctggtttctcagtttacagcacattgcaggaagctaggggcagagacaatcatttaacgttttatctacttttttgtataaatttagggggtacgagtgcagttttgttacatgggcatattgtgtcacagcggaatctaggcttttaatttaccttcatcagaactgtatacattgtatccataagtaatttctcatctcctaccctcctctcaccttcccacccagtgtttgctatttcatactatatgtccatgtgtgcaatgatttagcttcctcttataagtgattacatgaagtatttcaatttctgtttctgagttatttcacttaagataatggcttccaggccaggcacggcggctcacgcctgtaatcccagcactttgggaggccgaggcgggtgaatcatgaggtcaggagatcgagaccatcctggctaacacggtgaaaccctatctctactaaaaatacaaaaaacaaattatccaggcgtggtggcatgtgcctgtagtcccagctacgccggaggctgaggcaggagaatggcatgaacctgggaggcggagcttgcagtgagacaagatcacggcactacactccagcctgggcgacagagtgagacttcgtctcaaaaaaaaaaaaaaaaaaaaaaaaagataatgccttacagtttcatccatattgctgctgcaaaagacatgatttcatgttttatgactgagtagtattcgtctgtgtgtgtgtgtatttcccattttctttatccagtcatctgttttagacacttaggttgatgccatatctttgctattgtgaagagtcctgctgcaaacgtgaatgcaggtatattttatacaataattttttttagcggggggattagataccccatagtgggatgctggattgaatggtagttctatctctagttatttgataaatctccatactgttttccatagatgttgtattaatttacattcacaccaaatgtgtataagcattcacttttctccacatccttgccaaaatctgttattttctaactttttagtaatagccattctgacttatgtaagatggctatcttgtggttttaattttcatttctcagatggtaagtggtgctgagcaatttttcatatgcttgttgttgcactgagttgcttgtagattctggatgttagtatttttcagttgcatagtttaaagatatgttcacccaatctgtaggttgtctatttactctatgattataacttttgctgtgcagaggctttttagtttaattcagtcatatttgtctagttttgttttggtttcatatgcttttgaggtcctagtcataaattatttacctaggccaatgtccaaaagagtttttcctaggttttcttctagaatatttatagtttcatttgatttttgtttttaattacgtttatgcagtgaatcacatttattgatttgtatatgttgaaccatccttgcattcctggagtaaaacccacttgatcatggtgtattttattttattttatgatgtgctgttggatacagtgttttgttgaggatatttgcatgtatgtttactagaaatactgatctatattatctttttgtgtgtgtgtgtgtgtgtgtccttgtcttgctttgtatcagggtgatattggcttggtataatgtgctggagaggattctttactgctcaattttcaagaacggttttaataggcctggtatcagttctttgtatgtttggtaggactcaagtatgaatccatctgttcctgggctttgtttgtttgtttatatatttgttagtacagatttaacctcactacttactattttggtgcaaaagtaattgtggttttgccattgaaagaaacagcagaaaccacaattacatttgcactaacctaatattctatttgggatttctatttcttccttctacatgcttgaaaagttacatatttctggaaattcattaatttcctctaagttttttagtttatgagtgtagagatattcatagtagtctctgaggatttttagcatttctctagtatcagttgtaatgtcttctttttcatttctgattgtgtctatttgaatcttctctcattgtttctcgcttaatgtagctagtggtctatcagttttgttcatcctttcaaataatttcttgtgttgttgattctttgtaatttttttggtttctttttcatttagtcctgctctgatctttgctatttgtcttctactagctatgaagacactttttagtttaagttccatttgtcttgttttgtttgtgttacatttgctttccaggtctcagtcataaattctttgcctaggccaatgaccagaacagtttttcctagattcttttctagtatttttatagttacaggtcttacatttaagtctttaatccatcttgagttatctttgtatatgtgagatgtaggggtccagttttatccttctagacatggcagtccaatattcccagtaccgtttattgaatagggtgtaattctcccaacatatgtttttgtcgactttgtcaaagagcagttgactgtaggtctatggcttcatttctggattctctgttctagtgatctatattttgatttttatctagtgacaaaaatctatgtgttgattttatttagtggttaacacatggatctatgtgttgatttttataccagtaccatgctattttggttactatacctcatagcatcatttgaagtcaggtaatgtgatgcctctagattttttctttttgcttaggatcgcttcggttattcaggctcctttctggttccatattaattttaggattttttttcctaattctgtgaaacattacattgtaattttaatgggaattgcattgaatcagaagactgctttagtcagtgtggtcattttaacgatactgattcttctgattcatgagcatgggatatttttcccatttgttcatgtcatctaatctgccatcttgaagggaaaaaaaaaacccacaacattttaaatgaataaaatgaaggctgaaataacaatgtgaactcaggcagatactatgtgggttcttaggtttttataaaattgcaaagtaagtaaattaatatccaatgctcctagattttccataaccttttttcttacttctcctgtgcacatttctctttgtcagacttaatcttagcaaaggattcaatacccacacattaagaatatttctttgactttttaatgagttacctgcattttaacctggaggaacccacaggaataaatttcaaatggttaaatgtcaagccttaaaaaccatgaataattatttttggctaggaataaaatttagatccgtggtgaaccccagtaatttctggctcttgggatttttaatgggaataatttattataaatgtttctctccatcagaaaattaaaaaattttaaaaggcacagtatttttgtttgaggcgagttgataagtctactaatttctctaaaaatgtcatcgaattattacacagaaacaagtagttgccaggcaagaatcaaggcattagagataaaatctgatttacataccgcacttctctctcctcaatgtgctcatagtataaattggaggcaataggtaagtaaacaatgggagggtgttggagagagatctatcatagagggaagtatctatgcttatgaccgtttatctaaacatcattctcatctttgattctgtttaatcatcactacgattcaactcaatgcagtttcttttcttatttctaagaatagtactatattctgtctgtcacacaggctctttcacctggaattgtcactaacctctctcttttcctcactttcaactttaaatttggttctagaataattccttggaatttaataaaagcatattcaattaaattgaatataatattaatgtatggccttttttcaaaattttttcttcatatcattttaatgactcctgtatactcataaaagtttaagtttcaaagcattagcttgtaattttttacacatacatacccaaatatgaagataattttaataccttatataaataaataataaaataaataaaatatatttattttcaataaatgtaaatattatcttgatatttattttgcactcacagttattactgatttaataacttgatatgaaacatccttgttttcagaagtgtactgtgagtttggatattgctgctttttattgccacaaaagagtacataagcatttagcagccagagcatgaagcccatagggtgactgtggcaacagagtttctaatataaagtcgatgtaaaagtatgcaggagagaaatagaagaaaaataagaaaaataattaggccagacctcaaaaataatgcttatataaattagatgtgataaagtgataggtaataaaacttcaagggccaaacaaattaagaaatgaatgatgtgaaatggaatcagctcaggggagcaatgacaatggatggaaccaaagaaagaatacatttatgaattacagagaaagaactttagattaatgaagaggagattttatcatatcaacagagcaattgagatgagtggtccataaagctttatgactttagcatgaattctggtggaaagaaatattatagtagatcatgttaatctaattttactatccttaaatgtaatggcttttaaaattgttagctgaacaattcaaggtggcaatttgctacatcaatataagcagtctcttgtgaccttttaggaatactgagctactgattagttaagtgacagtgatcctttttcaaaacaaatgctatatagagattttactaatttccctacttaattaagaaatgatatttatttcccctaaggacaaaaattttcaatggtactgacgatcatatattagatggtaaagtggattactgaaagttagtgccactctaattaaaaatttgattcatcccacccaagacagaaatggggactgaattttatatcccattgaataaattaattccacacacaagttttaagttcctaaagtctttaacttcagctgtggctctaaaaaaatcaacatgactctaatttataaaatataataacgttaaaattttcatatgattgtgaggatagagttaggtaataaactaaataactacattgtttaaaaatttacaaatgcataggagatctgtaaacattaaaatatgattgaatttttcaatagataattgttctgatgtttgaaatgttctggaagtgttcatatagaggagtatgctgtccaatatggtatttaccagctattgatggctactgagcacttcaaatgtagctcatttgatgaggaaattaattttttaattgtatttactttcaattaatttaaatttaaatactcatatggggctagaagctccaatattgggcaatgaaagtctagaactcacatcttaaatttgatttgattgttgaatacatcaagtttgtaattaatgtagctgctgggaggtattgctacaatcagacaatcagaggactcaaagtttgcaatagagatttaaggtaaactgtgagcaagacacttttagtgatgaatttctaattaatttattaatttcagtactgagttcgctctataattaagtcttaatatgcatattacttaaagttaattataaatactaattcttggttttatcaatcacaaatgggtgtagggggtagaaaatgtgaataaaaatattggagagttaatttatatactagtcttacactgagaggtgaatagtttatgtttggtacagattagctacatttagtcaaagcaaatattgtagaaaaataaacatagtgcctcttttgaatatgtaagtatttttagtgacaatttgattattcaaattgattatttgaaaatttgattatttgacaatttggattttagaaatctgtagacctgaagcttcccttgaaccaggattaattaaagacaatattgccaattaacaccagacagtataactggtgttcttgctgtgcttttatgtatgtgctctaggcagagcttttactagcttacacatctctacgcagatttttaagcctttcaagaattttgccacttctgagctgagctcagagccaaaggagagctgaattttagcactttggtggaagcagctttcatgcccctcaggcttatacttaaatctgtctttactctaggaaacttcatagagctctcttggcctctgtgcccctttagtttctaaactacaagggaacccagccctttcatccttaaaaaagacacttttaggactttacttatcatttatttatttatttttttagaggcagagtctcactctgtcacccaggctggagtgcagtggtgtgatcttggctcactgcaacctccacctcctgggttcaagcgattctcctgcctcagccacacgagtagctgggactacaggcacctccattaataactactaggactttaagccttttcccctagaacaaaatcctctggtgttttatttttccttgacttagattaatctcaattttacagtttactactcaaagtgttggccttggactagcagcatagcttcactctggagcttgttaggagtgcagaatatgaggccccacaccagacgtactcaacgagaatcaacatcttatgatccccaggtgtttcataggtacataaaagtttaagtactgtatgtagcacacttcttcttgtttgctccataagaatacaaaggtattttattaatggaatttgtttttatagtacttccttaaatgagccaaacttcatgatcatcaaccagtatatgccccgtttttccattccagatcattctttacattttatttattaacttttttaaaaaaattaagacaagtacaagaaagagccagacattcattcttcccttgtcttaatgtaaagtataagtgtgcatattcattgtctcatctgtcctgcactcctctcactttagcagcaactctgtagaggacaaggatcatttgtttctataggtaggtatttggtacctcttagaatattatctacctgtcctagaaaccatatagtccattccagttttaaatttttttttgagacagatattcgctcttgtttcccaggctgtagtgcaatggcgcgatcttggctcacttcaacctccaccttccaggttcaagcaattctcctgcctcagtcccccgagtagctgggattacaggcatgtgccaccacacctggctaattttgtatttttagtagagatgggtttctccatgcttgtcaggctggtcttgaactcctgacctcagttgatccgcctgcttcagcctcccaaagtgttgggaatacaggcatgagcccccacacctggccttaaaatgttttctttaaaaacttaaattttcagctgggcacggtggctcatacctgtaatccaagcactttgggaggccgacatgggcagatcacctgaggttaggagttcgagaccagcctgaccaacatggtgaatccctgtctctacaaaaacacaaaaattagctggatgtgttagggtgcgcttacaatcccagctactcaggaggctgaggcaggagaatcgcttgaatccgggaggcagaggttgcagtgagccgagactatggcactgtactccagcctgggcaacaagagggaaactccatctcaaacaaaacaaaacaaaaacttgattttccttattatctaaaaacacagtaagtttttcatgaaaatctcagtgctaagcattgtgagattcactagctattctcatgcagatcttaatgtagggactaatgtctatcagatgcattcctaatctgattttgttaatagtttttttattgacagtaattcatcagagataagtactagtttccttttacatgtaaaatattcagtataattgtattgattgaattatagcatcaactattttaacaataaattattcctactctacacatccactgagtacacattatgagtaacattatggtaactgctgaaatatagaagtaaaaattagagttcttattttgtagtagcacaaagacactgaaaagcaagatagagctttcttagaaaaatattagcgttaaaaatgtgaccattacttgtcgtgaacctgggaggcggagcttgcagtgagtcgacatcgtgccactgcactccagtccggacgacagagcaagactccatctcaaaaaaaaaaaaaaaaaaagcagccattactaaacaaaaaatatgaaaaaaaagtactaacaggtagcacactttgctagattcaaaataaattttatagtatctgattctaaacagcatgttatagatgaattcttaaagagaatagttatataaaaaattctaatttattttggaaaattaaatttctgtcaaaacctgtaatatttatgaacagacatacttttcttttagcacgtcaacagagttgttaggttgtcttaatccttcactggctacctgcactttcccttcaattcgtcaggcacctttgaggctgtccttatatcttcatcaattgtcttcaacaaaatggatgagactatgaatagaagctcattgtcatgaaagtgatatgagaaataaatttgctgagtaaaagattataaattcacattaattgattgttcaattttcttgaaaactgatgattattctgattttaatatgtttggcagattttaaattatatacttgtttttcaaaatagagcttggtaagagtgatataccttatcatatctttaaaagaattattttttattttaagtaattagtgtcctaatctagccatatatacaagaattcagataaaaagtttactggttgaattaatctacactatcatagaactgtgaaaacatgcaataaagttagtttttttctttttttttttcaagaaatgctttagcaaaccaaaacttgttttgcgatagccatctctcctatatatctctaataaaagagcactttttcacatatttttaagtagctattccattataaacaccttccctcaatttgaaatcaattaatattttaaatactggagaaaaggcaaatctaatatatatcttctaaaatattttttacatagtagcaaaacctctgattatggctttaattttaaaccactcccatttgcctaacgctgtcctgattccaggattgaaatttccacattctaggaaactcctcagttgcagggatacttggatgattggtcaccatcatgtaccattttattgccttaatattttaatattcaaagtgtaaaaatgtgtcttatacaggaattcagagctccttgggatgtctatagtgataactttaacattatttgctaatgccttctgttattttaaaacccattaattaagcacctatttttaaagcattttttatgttaaaaatttcaatagatcatgctctatgtccttaaggaactcatagcttaaccaaagagcaaggcatacaaaataataaattataaatatgaggttggaattgttaaaagaaagcaaatttcttctaaacacagaagacttagacacttactttacctaggagaaattaaggaagtcctccattagtcctaattaaagaagttgtggtattttaggagaaacaggagttaaccaaaagagaggaaaggaggaaaggatttccaggcttggtggtatgaaaatgaaggctgtactcagtgtttggtgagaaatttaaagccattataatataggatggatgatgtggacataatcatttggaagagcattgatgaccagaattgagcaataggatttaccctataggagtggtttgaaaaaaataaaaataaaaaaaaaaagtaaatgctcaggacttaatcagaatcacctgggaagattttacaattacagactgctgcaccacttccagcccaatcccccagagaacctgctgagcagatctgaggtgccaattacttcagttcatatatttgtaatgatcttcataggattacgatgtctgtggagatttagaacctccagatttcccatagagagccaatagtggtaattaagcatttgatttacatgattttatttgatttaaaaaataattctagaacatttttgtagagacagtaggccactaagatttctttgaatgatgcagttgagagataaggaactgtactgaggctttgtcaagggaggagaaggtagtgctaaatacaatgagaattttcaaaagttgagtacaatctattttttcagagtgtggctgccatttggtatccttgggggactggttttaggacctcttttcatacaccaaaatttacagatgcttgagtccctgatataaaatggtgtggcacttgcatataacctatgcatatactcctgtatactttaaatcatctctagctcacttataatacttaatacaatgttggtgtcatgtgaatagttgtcataatgtattatttagggaataatgacaagaaaaagtctgtacatgttcagtacaaacacaattaaaaaaatattttccatctatgaattcatggatatggaggaccaactccatatgttttacgaatatttgttatactagtttctgatacagttgatatagtttgaatagagtacaaatactgcacgttgaatatcagtatataataggacaaataatgagactatttttctcatgttttccactgtatctgtttatttcttttttcattattggattgattcatccacatagtaagtaatttttaactgcccaccatgtgccgaacagtgctaactagatgaagtattcatttattgttttttggaaaggattgaaagcaactttaattaaaatacaaattattgtatttagtattcatttataataaaaatggtatattttcaaaaggaccatacatttcatacaggtattgacattaaagtgttctacttaccttttctttgcgaagaatttagaggggcatttataatataaattgttaccacttttctgaaggacaacttacctgtgtaacaaaaacacttaaagtgtgcaacacatagtggatatttatttctgcaggtagttaggtataacagttgctgaagtagtattcttaccacgtgtatgctgtattgttggactgccatgataaaacaaatactatgtcatttgtgcatatcttttttttttaacaaaacaaatttatacagggattttaggaccacaaaacaattgctggtgtgtcatgaagaaaatatattgtggaaataatatgttccatctgtggttttcttttttaaatgtaccaccttaatacagaactgcatctctaaatcaaataaccttaagcaataaatagagacttgctttcaagtattggcaaataaatgccttttttttttttacaagaacaattttttcctagttgttcatgtgaatttaggataaaaacatgcagcaacaataaatcccttgtggtattaattcttaaggtttatcacaaatagtattagagataacaaaatatagtcaacacaagcttccagtttttcctgtttatggcttaataataatttggacataaagatgcctactttatcagcatgttattggcccatattttatatttggggaatgataagaattttttcataaataatagaagataatatttttatgttatcatgtctgtcatgtactttactatattattgctgaagacaaaacactttcttgaagaagttttatttaatctatacaggatattatatttcagtcttcttaggttttccaaagtaaaatgaaacaatttttacatttctacaaggatatatgagcttttaacttcgtaaaagagaagggtatactacacatgatgttcatctgttcagcagcaaaaaggtcaagaagctaaacaaatatgccctcaagtctgaaagtgaaaaatagatcttgtaagcaagagagacactaaggtattacattagagataggtagcattttggaaccttagctgcaacacactatttgtaaaatgtatttcccatacgtcctgatggtaattgttatgcattttagttacacagatagtgttttgatatgtacagaaaaaaaatgtttatcatttaaaagataccttattccataatatatataaagaaagttgttattatagtcattaccaggtacaaatcagcaaaaaacacttatgtcaatagagtttcaagaagtactttaatatgaaatgttttaacattattctgatttttaaaaattgatacatttgttgagtggtatttaaattttgtgatattatttaattgtagaggcaatgagttatagagatgtcgaaaacaaactctttaagaattgtgaatatacaactatgatttcttaaagtttgagactttataaaagcagtggttccaaaaaaagtgcataaatacacatttacacgtatgtttacacataacttggtgggaatcacagatgagttgtaatttacccatgacatcaataaatacattgtatcttatccatgacaccaatttggaacctagaatagaaacttctataaaagtatagaagatttgttttacttccttatatacaagtagagtattgatcctaattttgatttattaaagaggataactttgtggtttaagattatattttgatggtgaataatcatcaatattaataaaataaatgaaaatatgaatcttgactttaaaatttctgtacttctcataaaacttctgagtatgtatgaaaaaatgtttggtttttcatgataaaagttttgtgaatatcaagtttgaaatatattacagacatttgctactttgtctcctcaccttggttctgtgaaagaatcatctggaaaataacttggaaagtttaccttcctagtataaggaggggaatagtgaaatacgacaattagaaaacttgtgttttattgctattctgggcactaactattattattattgttacgtttttgtctgataacaacctacattttttccagatctccatctatgcattcacaaggcacacatgtctttcaagattatcctaaatataacttttatctgaactccctctgttttatatttcactttcattcttcaagagaccaatttcctgcatgaacttgtcctagatgaagctcattttcataaatgttattttcttttgtaattagactgtatacgggcatctaatcactagcaaaactgcagcacttgaaaaccaagattatactgtagcatttgactagctttagaaaatatagtagatttttattggataatgaataacttactggttgagagagaaaattgtctgtatgttaacaaaaaagaagtataaaacgaagaaacgtttcactaagtcactcagtataccagagacaataaataaagtgaaacgactcaaattctataaaaggaaattcctcttccctcacaaaaaatgactactattttttcaaacattcattagaagtggatagtacgttctacttgtaagtacagaattattttaaaaattataattagcaagtctgctagtcattcatagcatactgcatttgaacagtgtttgaaaagcagaaatggtttggtccaaaatatattgtagttaatatacatgtgaattacattagttttattaaaacaacaatgaattaacatttgcaaatcgatctttggtttattttagcatccaaatatgtgttgtattttctatccactttgcattaaacaattgtacatatttaataatgtataaagagataaaatgtaaacatattttccccaatgttaaacagtcatgcattagattgtgcatggacatttttactcaatagtctattgggtaaaatgcttggtaattatttccttagctatatgcagactttataaaagtgtaaatttccctcttatactatgtttttaacactttaaaagaaacatatatctatgttcttcaaatattatttctctaatctttggaaatataatttttttacttttatttctggtttggagtgtaagtgcaggtttgttacataggtaaacttgtgtcatgggggactgttgtacagattatttcatcaccccggtattaagcctagtaatcattagttacttttcctgatcctctcccttctcccacccaccgcattctgataggccctagtgtatgttgttcccctgtatgtgtttgtgtgttcttatcatttagttcccacttgtaagtgtgaacatgcagtatttgattttctgttcctatattagtttgctaaggataattgcctccagcttatccatgttcttgcaaaagacacggtctcattctttttttatggctgcatagtattctatggtatatctgaactacatttttttaaatccagtctatcattgatgggtgtttgtgttgattctatgtctttgctattataagtagtgctgctatgaatatgtgtacatgagtctttaaaatagaatgatttatattcctttgcatatgtattagtctatcttcatgttgctataaagaacttccccagactgggtaatataaaggaaacagattcaattgactcacagtccagcatggctgaagagtccccatgaaacttacaatcatggccgaagttgaaggggaagcaaggcacctcttcgcaaggtggcaggaaggagtagtgctgagcgaagggggaagagtcccttattaaaccatcagatctcatgagaacttactcagaataatgagaacagcaagggggaaaccgcccccattattcagttatcttcacttggtctctcccttgacacatggggattatgtcctattagccttattctaatgcctaacagcatagattagttctaccatttttgttgtttcaaaacatctagatgtctatgctgttagacattagaatagggcttacttggggcaagtataatgactggaaggcacaaagagcctcaaggatggtcaaatgttctggtttttcatctgggtgctggctatgctagtgtacttattttgtgaaaatactattagctttacaatatgaattttaaaattgtactttggggattatgggaattgcaattcaagatgaggttttgggtgagaacacaaagcctaaccatatcagggtagtacccagaaatgggattgctgggccaaatgttatttctgcttttagatttttgagggatcaacccactactcttttccataacagtggaactaatttacactcccacctacaatgtataagtgttcctttactgcatagcgtggccagcatctgttatttctgactttttaatagtagccattctgtctggtgtgagatggtatctcattctggttttgatttgcatttctctaatgatcagtgatgttcagcgttttttcatatgattgttggccacatgtatgtcttcttatgaaacgtatctgtttatgtcctttgcccaatttttaatggggttatttgtttttatttttggtaactttgtttaagtttcttatagatgctggatattagacctttatcagatgcatactttgcaaatattttctcccattctataacttatttgctcactctcttaatagttttctttgcgatgcgtaaactctttagtgtaattagatcccatttgtcaattttagcttttgttgcaactgcttttggtgtctttgtcgtgaaatttttcctgtgcctatgtcctaaatggtattgcctaagctgtctttaagagtgtttatagtgttgtgttttacatttaagactttaatacataatgagttaatttttatacatggtataaggaagggttccagtttcaatattctgcatatggctagccagttatcccaatttattattttgaagctagaaaacgatcattgtctctgtaattttagagaaaccgacactgtttttaaattatactttaagatttagggtatatgtgcacaacttaaaggttagttacatatgtatacacgtgccatgttggtgtgctgaacccattaactcgtcatttaacattaggtatatctcctaatgctatgcctccccccagcccccaccccacaacaggccctcgtgtgtgatgttccccttcctgtgtccatgtgttctcattattcaattcccacctatgagtgagaacatgtggtgtttggttttttgtccttgtgatagtttgctgagaatgctggtttccagcttcatccatgtccctacaaaggatatgaactcgtcattttttatagctgcatagtattccatggtgtatatgtgccacattttcttaatccagtctatcattgttggacatttgggttggttccaagttttgctgttgtgaatagtgccgcaataaacatagctgtgtgtgtgtgtctttatagcagcatgatttataatcctttgggtatatacccagtaatgggatggctgggtcaaatggtaattctagttcttagatccctgaagaatcgccacactgacttccacaatggttgaactagttaacagtcccaccaacagtgtaaaagtgttcctatttctccacatcctctccagcacctgttgtttcctgacattttaatgatcaccattctaactggtgtgagatggtatctcattgtggttttgatttgcatttctctgaccagtgatgatgagcattttttcatgtgtcttttggcggaataaatgtcttcttttgagaagtgtctgttcatatccttcgcccacgtggtgatggggttgtttgtttttttcttgtaaatttttttgagttcattgtagattctggatattagccctttgtcagatgagtagattgcaaaaattttctcccattctgtaggttgcctgttcactctgatggtagtttcttttgctgtgcagaagccctttagtttaattagatcccatttgtcaattttggcttttgttgccattgcttttggtgttctagacatgaagtccttgcccatgtctgtgtcctgaatggtattgcataggttttcgtctagggtttttatggttttaggtctaacgtttaagtctttaatcgatcttgaattaatttttgtataagatgtaaggaagggatccattttgagctttctacatatggctagccagttttcccagcatcatttataaatagggaatcctttcctctttcttgtttttgtcaaagatcagatagttgtagatatgtggcattatttctgaggactctcttctgtaccattggtgtttatctctgttttggtaccagtaccatgctgttttggttactgtacccttgtagtatagtttgaagtcaggtagcgtgatgcctccagctttgttcttttggcttaggattgacatggcaattcaggctcttttttggttccatgtgagctttaaagtagtttttttccagttctgtgaagaaagtcattggtagcttaatggggatggcattgaaactataaattaccttgggcagtatggccattttcacaatattgattcttcctacccatgagcatggaatgttcttccatttgtttgtatcctcttttatttcattgagcactggtttgtagttctccttgaagaggtccttcacatcccttgtaagttggtttcctaggtattttattctctttgaagcaattgtgagtgggagttcactcatgatttggctctctgtttgtctgttattggtgtataagaatgattgttatttttgcacattgattttgtatcctgagactttgatgaggttgcctatcagcttaaggatatattgggctgagacgatgggattttctagatatacaatcatgtcatctgcaaacagggacaatttgacttcctcttttcctaattgaatgccctttatttccttctcctacctgattgccctggccagaacttccaacactatgttgaataggagtggtgagagagggcatccctgtcttgtaccagttttcaaagggaatgcttccagtttttgcccactcagtatgatattggctgtgggtttgtcatagatagctcttattattttgagatatgtcccatcaataccgaatttatggagagtttttagcatgaagggttgttgaattttgtcaaaggcctttctgcatctattgagataatcatgtggtttttgtcgttggttctgcttatatgctggattacatttactgatttgtgtatattgaaccagccttgcatcccagggatgaagcccactggatcatggtggataagctttttgatgtgctgctggatttggtttgccagtattttattgaggatttttgcattgatgttcatgagggatattggtctaaaattctcttttattgttgtgtctgtgccagactttggtatcaggatgatgctggcctcataaaatgagttagggaagattccctctttttctattgattgtaatactttcagaaggaatggtaccagttcctccttgtacctctggtagaattcagctgtgaatccctctggtcctggactttttttggttagtaagctattaattattgcctcaatttcagatcctgttattggcccattcagagattcaacttcttcctggtttagtcttggaagagtgtatgtgttgaggaatttatccattttttctagattttctagtttatttgtgtagaggtgtttatactattctctgatggtggtttgtatttctttgggatcagtggtgatatcccctttatcattttttattgcatctatttgattcttctctcatttcttctttattagtcttggtagctgtctatcaattttgtttatcatttcaaaaaaccagctcctggattcattgatttttttaaagggttttttgtgtctctatttccttcagttctgctctgatcttagttatttcttgccttctgctaacttttgaatgtgtttgccttgcttctctagttcttttaattgtgatgttagggtgtcaattttagatctttcctgctttctctagtgggcatttagtgctataagtttccctctacacactgctttgaatgtgtcccagagattctggtatgttgtgtctttgttctcattggtttcaaagaacatctttatttctgccttcattttgttatgtacccagtagtcattcaggagcaggttgttcaatttccatgtagttgagcggttttgagtgagtttcttaatcctgagttctagtttgattgcactgtggtctgagagacagtttgttataatttctgttctgttacatttgctgaggagtgctttacttccaagtatgtggtcaattttggaataggtgtggtgtggtgctgagaagaatgtatattctgttgatttggggtggagagttctgtagatgtgtattaggtccgcttggtgcagagctgagttcaattcgatgtccttgttaactttctgtctcattgatctgtctaatgttgacagtggggtgttaaagtcttccgttattattgtgtgggagtgtaagtctctttgtaggtccaaggacttgctttatgaatctgggtgctcctgtattgggtgcatatgtatttaggatagttagctcttcttgttgaattgatctctttaccattatataatggccttctttgtctcttttgatctttgttggtttaaagtctgttttatcagagactaggactgcaacccttgcctttttttgttttccatttgcttggtagatcttcctccatccctttattttgagcctgtgtgtatctctgcacgtgagataggtttcctgaatacagcacactgatgggtcttgactctttatccaatttgccagactgtgtgttttaattggagcatttatcccatttacatttaaaattcatattgttatgtgtgaatttgatcctgtcattatgatgttagctggttattttgctcattagttgatgcagtttcttcctagcctcaatggtctttacaatttggcatgtttttgcagtggctggtaccagttgtccctttctatgtttagtgcttccttcaggagctcttttagggcaggcctggtgttgacaaaatctctcagcatttgcttgtctgtaaaggattttatttcttcttcacttatgaggcttagtttggctggatatgaaattctgggttgaaaattcttttctttaagaatgttgaatattggcccccactctcttctggcttgtagagtttctgcggagagatcagctgttattctgatggacttccctttgtgggtaactcgacctttctctctggctacccttaacattttttccttcattttaattttggtgaatctgacaattatgtgtcttggagttgctcttctcaaggattatctttgtggtgttctctgtatttcctaaatttgaatgttggtctgccttgctagattggggaagttctcctggataatatcctgcagagtgttttccaacttggttccattctcccagtcactttcaggtacaccaatcagacgtagatttggtcttttcacatagtcccatatttcttggaggctttgttcatttctttttattctttttttctctaaacttctcttttagcttcatttcattcatttcatctttcatcactgataccctttcttccagttgatcgcgtcggctactgaggcttgtacattcatcatgtagttctcatgccatggttttcagcttcatcaggtcctttaaggacttctctgcattggttattctagttagccatttgtttaagttttttttaaggtttttaacttctttaccgtgggttcgaacttcctcctttagtgcagagtagtttgatcgtctgaagctttcttctctcaactcgtcaaagtcattctccatccagctttgttccattgctgttgaggagctgtgttcctttgaaggaggagaggcgctctgatttttagagtttccagtttttctgctgttttttcctcatctttgtggttttatctacctttggtctttgatcatggtgacatacagatgggattttggtgtggaagtcctttctgtttgttagtgttccttctaacagtcaggaccctcagctgcaggtctgttggagtttgctggaggtccactccagaccctgtttacctgagtatcagcaatggaggctgcagaacagcggctattggtgaacagcaaatgttgctgcctgattgttcctctggaagttttgtctcagaggagtacctggccgtgtgaggtgtcagtctgcccctactggggaatgccacccagttaggctactcaggggtcagggacccacttgaggaggcagtctgtctgttctcagatctccaactgcatgctgggagaaccgctactctcttcaaagctgtcatacgggtacatttaagtctgcagagttttctgctgccttttgtatggctatgccctgcccccagaggtggagtctacagaggcaggccggcctccttgagctttggtgggctccacccagttcaagcttcctggccactttgtttacctactcaagcctgggcaattgtgggagcccctccctcagccttgctgctgccttgcagtttgatctcagactgctgtgctagcaatgagtgaggctccgtgggtgtaggaccctctgagccaggtgcgggatataatctcgtggtgtgccgcttgctaagacagttggaaaagcacagtattacgatgggagtgacccaattttccaggtgccatcgtcacccctttctttgactaggaaagggaattccctgaccccttgcgcttccctggtgaggcaatgactcaccctgcttcggctcatgtttggtgcactgcaccctctgtcctgcacccactgtccgacaatccccagtgagatgaacccagtacctcagttggaaatgcagaaatcacccatcctctgtgtcgctcatgctgggagctgtagactggtgctgttcctattcagccatctctccacccccccagaaactgacacttaacttttaggctcatttaatgtaaaaatgaactgctctgaactggttgtcaattcaaatatggttttaatatgaaattacaaaaacataagaatatttctaagaagaaactcactatgtaatagtccaaaatctaaaaacaactcaagtatacatcagcaggaggataaatatataaattatataataaccacttagtgaaatactgcaaatcaatgaaaatgaatcaccactatacaaaagatggatgaatctcacaaacgtcatgctgaatgaaagaagccagaaacaaagcgatgcttattttttgatttcattcaaaacatcagaaatggcagaactaatctatgctgttagacgttagaatagggcttacttgggggaagaataatggactggaaggagacacaacggaggctctaggacgctgaaatattctgctgtttgttctgtgcacttgctatgctgttgtaattattttgtgaaaataccattaaactttacatatgaattttgttcttttttgcatgtgcattatacctcaataaaaaagttgttttaaaactggaatatatcaccattttctaccatgcatcatttaaacataattttcatgaaatgcaatagtgttatataatcactatgtagtaatcttaatgcatattggtttaaatttgcatattttaagttttgaaaggataactgtcaggaaattgaagtatatactatcagtgatgtttgtaagttttttatcatttttgttagtgaagaactaacatgtttatgctgataattgaatatactgttttatattacaatgtgaaatctactttcagaaaacttgatatggaatgaatgtttcctttaaagcttttcagaattaaaatattgctttattgttgtaatcttttaaaaagatgcaaaacaattaacatcagatttttcataaagatacaaattcaagtgaatagtactaataccatatttaattagaaatcaataaaaaaatcactttattctttataaatactttagaatacttatttctattctgccattttctttgttttattttctgttataaaagccaaccaaaaatgacaaaaatataccaggaaagataaactgcgacgtaactggggagtagatacattatacacatactactttggcaatataaaaggaggaaataatctgttattacagatagctccatgaatattcaccagtgaagcacataatgatcatttccacagtagcaatacagagactgcgacattgaaattattcagtcctcctgtaaactagttcaaccattgtggaagtcagtgaggcaattcctcagggatctagaactagaaataccatttgacccagcaatctgattactgggtatatacccaaaggattataaatcatgctgctataaagacacatgcacacgtatgtttattgcggcactattcacaatagcaaagacttggaaccaacccatatgtccaacaatgatagactggattaagaaaatgtggcacatatacaccatggaatactatgcagccataaaaaaggataagttcgtgtcctttgtagggacatggatgaagctggaaaccatcattctcagcaaactatcacaaggacaaaaaaccaaacaccacatgttctcactcacaggtgggaattgaacaatgacaacacatggacacaggaaggggaacatcacactctggggactgttgtgtgttgggaggagtggggagggatagcattaggagaaatagctaatgttaaatgacgagttaatgggttcagcacaccagcatggcacatgtatacatatgtaactaacctgcacattgtgcacatgtaccctaaaacttaaagtataattaaaaaaaaaaaagaaattattcggtcctctaaagtgagggtctgctgatttttccatggatgtgtaagaaatcgtcaccatttctgaaattaagttttgtttgttaagaagaaacagcctaactttttagatagttttaaaaattatcttccaaaacactgctgcatggacaaaccatagagcactaaatcttgtagatagatcggtccatgccatgctgttgcatgaggttatatttttctagttacattcactgcatcatagcctggagaacaaaaacacagcatgacaacatatgccatgtctctaaaccatgcatctttaagagtctgatattcagcctttcattcatttaccttccttgttagcctttcatttaacactgattaaaatacttcaaatgattaattattgcacatttttgcctgatttatcacagctcagcaataagatcctttgttgtagcttcatcatattaatgtggaagctgttaatgtgagataatattacaaactcttctgtttctgacctgcttttcttagttcctatcttctttacctgagatccatcacttaaaacagcctttccccaaaggtaagcagccctctttaagagtcttgccacattttaacatatgaattaatctaagcaagggtccagaataaaataacacgtggtgtctttgctcaactaggttagttttccacaccttcctgtaacattatcagcagaagtcattcacacataaagcaacgacctcaaaattaaaaagttactttggataaaattcattttattgtgtaatctgggtattccttctctgtctctcctttcacccccaccatgggactttaaaaaagtaagttgtaatgctgagatttctgtgtcaaggttaaagagtgaagagaatcatttcagagattagaggtgtcactcatgtcaagaaacattataagagatctctggaggcatgtaccaacatattaaattactacatggaaaaataaattgaaaaagaaaagccctgaagtaatgaaagctgactacattttcaaagcaactactattttaagaagagtatatttcctttatccacaaacaaatacaaggcaaaaactgggtgtgtaacaatatatgatcttctttatgatatttacatgttggttgtgtcacccaaactagatcaaatgatttttaaaataacatttatattggtaaactctttcaaaataaatgtagaaattttctgtggctggcttctaggtgtggaattagggaagcaacatgtattaacttgaaattcctacccaggcattcacttgaaaggtacccaaagttatatttgatagtaacatagttttaaaagcttctgctttctgttttaactgatttgcttctacaccactccatggacatcattaagcctttttatttagaattatgacattgcttttatttcattaatttcactagcacaggttcaaagggacaagagttagttttagatgtaatatataatgtaattaaaaagttcccatcatttgtgtgtttttgtagtcactacttactaatgtaagtagtctgcacattccaattctgtttactacagaattaaagttgcaacatcaacagttgtctgagactgtatgttttatcttgaacaaggaaaataaggttttaatagttctgattgttattaaaagcctttatgaagtaacatttataaaacacttctaatggtggagattaattttgcccctcaggtattttggtccaagtaaataagaagcgactgatggtcccactaaacaaaataactacaaggaaaatgcaggaatttcttttcttcttgttaatgaatattttgaagatggttaatttacggttatgtagacattctgcaatcagctaagatgttaagtcacatgttttatatctatgaaagctactattttgtagtggtgacaatttgttgtgtgaatcagtatgtacaatgaagagtgacccattacatacaatagaaagtggtggtagttcaccatagaaattatctgttgctataataaatttcacatattctttgatttttaatgatttctaaacaaggcatataaatatgctatatacatcatattaccaaagacatcctttcaagtataactgctgaaaaagagtctattgaatgagttagtaaataaatgattatttatttgcaagccttttggtaaaatagcgttatttacacaatgaatttcattgttttggcattgtaactgtgtcttattctgttttgtgctgctaaaagagaacatctgagactgggtaatttatagagaacagttctggaagctgggaagtccgagattgagagaccacacctggtgagggtgttcttgcagcatcatatcatggcagaaggcataacatgagttaaggagcaataactaactcattcccatgataatggcattaatccattcataagggcagagtcctcataacctaatcacttcttaaaagttccactctcaactgttgcactggggactaagttcaacacatgaactttaggagacacatttaaaacatggaagattatatcccaaccagctctcctttaaaacccccaaatctgatacttacctgattgataagagtatttaaaataataaaatgagacaacatctttaaaacatctttctagtattatgaacttggagataaaccaatatagtccaagttgattatagctcatattccagtatcaacatgttcccagcactaaagcaattattttctacagttaaagagaagttttatttcataagagaaatccaaagagtaatacccctatcttagttgttgagggatcctgtaaagaactgtgaatctgatgttttatcttacttgctataatagcttacaggttagcctgccagttctatggatgctggcagaacttcttgggacaaagagaaaatattttatttttcacaggaatcatagccagtgtgtcagcattttcttgtgtttgtgcccaagttccaattcccacagggtagcacaaagagagctagatgctacctgtacacagttgggttgcaataacaaaaaaagagaaacctgatcctaggtacaaaaaatcatttataatgggtagtaagcatgtctggacttagtttactggacagtaaccatgcctgacctttgctctagtgagaatcactatctatatcttcagtgttttttgctatacagatttgagatcctttatccaaaagacagagccatcaagagttgtctgagagtgtgcatttaattttgaacacggaaaataaggttttaatgttgcagattcttatggagatatttacaagcctttttgtgaagtaatatttatacaacacttctcaatgatgaggattaattgaaaaatctgaacgatttcagatttttgcatttttttggatgttagaatgtttgcattatacttaccagttgaggatctcaaatctgaaaatccaaaatccaaaatgcttcagtgctaatattctttggatgccatgttggtgctcaaaatgtttcaaattttacagcatttcagatttgggtttttggattcaggttgctcaacctgtataagcatctttgaaaacttaatccagaccaaaagggctaccagtgctttgtttccaagactaaggaaacttgagaaaccaacagagaattgtctctcaacagaaccagatacaggtgcaatagaaaaaccaccagtctattttattatccttataaattcccactaactacagctgtttagaccaattgcttcagcaacaggaactgaaaatggaaacttatttacagagtaaaaagtagagggctggaattgtgtgcatccagtaatataattttcatataatttttatttagaaagatttaagtcatttcatgatatttagaagtagatatgtagagaatgtagtcaactcagcaataatctcatagaaatacaaaatacactaatagagtttcccatgcatatttaggttctcatacacggagaattaaatacaaagtaataaaaaatgactataaagtatacagtgaatatgctgtgccaatgtagttctgcagcataatatatccataaattttcttgcctttattgaacttacataatttctcctaacatttacttgagatgcattcttgtgatttatttaaagaaatgatatttgtggccaaaaattggaaagtgatatttcgctttagtacataggtaattaaccactgaactaaaggtctgatcatttatccactttcacattaaagtgcaaacactgaacaaaacataggtaagagatgtttcccatttcaagtggcaaaatttctagtgattttgtggtttacagaattcagttgaggtttgtatagtcattcacagagcaaaatattcaaagtagttattttttgagaaccatctttggcaacatatagcagtttttgatttccccatctagtaaaagcaatgagctaaagaagtccaccttccaccccacccccaaatgaagcccaaattaaactgttctaagtaggcattgaattcaacatattcattttgcttaggattaatttagaatattaaattaatgtgatcagtatatcttctttttatgtttatttcattttctttttgcctattagaaatactttaaaaaggcaaactctgtaaatcctcaatctttaaaggagccacatcagcatcagctttaaaagaacatctttttttttattgttaaatgaagcacctgttaatattattgttgcatgaataaaactgtctcttcatagctctttatctaaaaaagactgatttgaatgaaggtaaacatatgtggatacagatttccttgattttttaatacattcataattttgtttctttttttctcattttatataacacctatattttgattaaaaaaattatttcttctttaaaagatacattaaaaaacctaacttataacaagtgtaagtaatttttctagttgttaggttataatgttttaactttagtttttgtatagtaagtatggatgcatttttcgcaccacagagttgatcaaaataacagactgacataagagttggctgtctgataatattgtaacttgtgaactaaatgagcatgtaaaagtcatgctaacattcatttatttgataaagtcttcttaaagattttgagggcattgatagtacaaatcaaatgcacaatttaaaactgagatggttttcttatttactgaagatctgaacttggatattaaaatctctcctttgccatattctgcatgaaattatttcagtctcttaaccttactttttccatgtgtaaaatgatattattaatgtctaatttgtagattttagtttttaaaaaaggttaatatgtaaaagtgcttgatacatactgtttgcttaataaatatattaaacatacattcttttttacttgggttgtacaaaatcataatatcttaggtatgtaaaacactttttgagttctggcctaattcaatatttctggtgaaaatatgggaaactccttctccctccctccatcttggccttgcccaccacagaagaagaaaatatgtattgaagaacagtagcatttaattttcataactttttcgtaaatgaggataccggaagtcacacaaagtaaatgacttactcaagatcacatagacaggaaggacaaaggtaggattcacacccggatctgtctgaatccaaaggtgaattatgtttcatcatattatgctttttatcatagcttagagatttttctagcatggaacattatttagcaatatctgtgtgattaggcatctgcttcctaattcaacgttttcatcttcaactaaggtttattattaaatataaaacatttaataaaagtcaaaacatttgcttgttcaatttattttaatttatatttttgccttgccataaaaaatattaaagaaggcttaaatttgaatatacttgctatactaccttttaattggtgatatttcaaatttaataagcaaactgcactatgaagacaggatataagaagatttaggcaattggaaagattctttatcttgttacactttcggcatttttttttttttttttttttgccaattctcaatgtgaataaatttacaacatgtgaagcatcaaaagacttataaaatcttgagtcttgtctgaaattagcaaattaaaataaatatatgtgttgaaagaaaagtcctgtcttgcagatgttttggattagaatgaaaatggacacacacatacacatgcataattgttaactttcatttgaaataaaatttaacttagcaaaactaacaagaaaaaataaaataattgaatatctatattctattaaggaatgtaaatttaaacaaaaacattccacaaagaaaactccaggcacggaaagattggcaggttaattctatcaagcatttggggaaaaaacgaaaaagtaaaagcaacattacacactcagaaattaaggaaggaaacactttccaatgtgtttcatgaggcagcatatctctgatacataaacctgataaagacataacaaagaagaaattgcaggttttttaccactacaaacatagttaaaatccttaaaaaaattccaaagttgtattcagaaatacataataataaatcataatggagcagagtttgctataggattgaaaagttggtttaacatttgaaaatcaactcactaattcaccatattaatagaataaaggagaaataacttaataggcattaaaaaaaagcctgacatgacactcatttatgttttaaaaaggtaagactggaagagaacttccacacttttctgaagggcatttatgaaaaccttacagctagctaatttattgttacagatgaatcactgaatacttattcccagcagttgggaacaggcaagatctcttcctactcctgtactcaacattgcattagaattcttatggtagtgtaatttagcagaaaaaaaataaatatgatacataaatattgggatacatgaagtagaatgataatcatttgcagattacgtaagtgtgtttttaaaatcactaagaaattacaaaacaactacccaaggctacaagatagaagatacacacacacacacacacacagcattcggaatagatctagagtaaccaaaataacctggataaaaaaaaaaaagtttgaatacttaatatgatttgattattttttataatgctactgcttctagtaataaagtcatgtgttattgccgtaagaatatttcagcaaaacataatgagtagagatatttatccacacacgtgcagtcaattgttttttgacaaaaacactcaggcaactcaatggaaaaaagaaggcctttttaatagaaaattctcaaattactagatatttgcataaaatatgtaaaccatatgctttcattttatttcacacataaaattaatttgggataaatcaccaacctaacctaaaaactggaactgtaaatcttctcaatttggaagtaggcaacgatttcattggcaaaaaataagaagcatcaagcatgaaaaaattgatgacatttcttctcaataaaattgcaattaagcatatgaatagataagaaaaagagtcgggaaaagtaatcgatatttaataactgtcaaagaatttttatccaaaatatttaaacaacttttatgagtaaatatgaaaaaaacaacacattaaaaaatggtcaaaagacttgggtcgtcaccttaatgtgagtatgaaaaatatgctcaatgctaatatcattagacaaatgcaaattaaaaccacaagataaggttttgcacaactacaatggcttttagacacacacacatacatgcacacatgcacacacattaacaataccaaaatttggcaaggatgtgaaacaattgtaaactatagctcccatacaccacgttttgtggtaggaaaaatgtatgtgaaatagtacaacaattttagagaagtgtatttaatatctgtcaatcctaaaatcaagcaaccccattcccagatatttgcccaagagaaatgaaatcatatgtccaccaaaatacttacacaaaactattcatatagcacatttaattcatattagccagtacctgcaacagctcaagtggcccaaaatagaatggataaatacattatcttatattcatacaatgaaatactacactgaaaggcaaagcaacaaaaacgaatgcaggcaaaatgtggatgaatctaaaaaagtctttattgagctaaaaaagtcagatataaaaagtatatatcatatatatggtatattctgtatgtatgtgatctgatttatacggaatttgtaaagtaggcaaactattgtgataattgaaattagactgttgttgcttttgggtagaagtgggaatgattgaaaaggagtgtatgggaaatttgggaaataatgggaaaagtcagtatcttgatttgagtagtggttacataggcttataatacaattagcaaaacctatcaaatactatacttaaaaacctctccattttattttatatacattataattcaaatacaactgataagaattatagaaaatgtggacaatatgtacaattttatacattatatatatatacacatatatatatgtaatgtttcccttaaattttacctcttaatcggattactgtggaaatatattcttaaaagtattatttgtatgtatcagttgcaaatctgacttacattattttaagtggtgtaagatattaggagaagtttgttatctaatgtaccttgatcactaatttatattacaaaaagtaatatgttccaatccatatttcttattggttaaatcagttctactgaaaaaattttaaattctatgcttcacaaacaaaacagagagaaatgtatttgaatactgaaggctacactgtgtctatttccaaggggctaataagatttaagacttcaaagattcagtcttgtggtcaagaataagtgatgtggatgcctaagaaatgataagccatgccaggagactggaacataaatttgaggctgaatgactgcaattttccaaacatattttctgtttatcacaaagtttcatagtagttccataacttttccctccactcggtctctttaaaattctactgaacttctgagtaaaattgagaataatttggtccactgaatactatggcaaccctcccaccaaaataaataaaatgaaaaatttttctttcttttccttgctgttttctaattattttatctttgattatgcttcaaaagccccctattttctcggaaatggaatgttgtatatcttcttagattcactttgtttgtaaaagggaggaatatctgaaagtagaaggtaattatttacattagaagcagtgttttttactctctatgaaacttcctgcaaatataatacttaaacactctataaaagattgcaagtatacacagcaagtttgtaaatttttattttaatatctctaaagaatgagtagattgtaattttgtatttgataaaaattattgaggcctgaaatgcttttttcctactttagaaatttaaatgccattttcataatattgattcttcctacccatgagcgtggaatgttcttccatttctttgtatcctcttttatttcattgagcagtggtttctagttctccttgaagagatccttcacgtcccttgtaagttggattcctaggtattttattctctttgaagcaattgggaatgggagttcactcatggtttggctctctgtctgttattggtgtataagaatgcttgtggtttttgtacattgattttgtatcctgagactttgctgaagctgcttatcagcttaaggagattttgggctgagacaatggggttttctagatatacaatcccaaggtaatttatagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcatgctacctgacttcaaactatactacaaggctacagtaaccaaaacagcatggtactggtaccaaaacagagatatagatcaacagaacagaacagagccctcagaaataacactgcatgtctacaactatctgatctttgacaaacctgagaaaaacaagcagtggggaaaggattccctatttaataaatggtgctgggaaaactgactagccatatgtagaaagctgaaactggatcccttccttacaccttataccaaaattaattcaagatggattaaagacttaaacgttcgacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcagaagaaactagcatcagagtgaacaggcaacctacaaaatgggagaaaattttcacaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaaggctcactatcactggccatcagagaaatgcaaatcaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggcgcttcctcagggatctagaactagaaataccatttgacccagccatcccattactgggtatatacccaaaggactataaatcatgctgctataaaaacacacacacacgtatgtttattgcggcactattcacaacagcaaagacttggaacccacccaaatgtccaacaatgatagactggattaagaaaatgtggcacatatacaccatggaatactatgcagccataaaaaatgatgagttcatgtcctttgtagggacatggatgaaattggaaattatcattctgagtaaactatcgcaaggacaaaaaaccaaacactgcatgttctcactcataggtgggaattgaataatgagaacacatggacacaggaaggggaacatcacactctggggactgttgtggggtgggggctggggggagggatagcattaagagatatacctaatgctaaatgaggagttaatgggtgcagcacaccagcatggcacgtgtatacatatgtaactaacctgcacattgtgcacatgtaccctaaaacttaaagtataataataataaaataaaaaaaagaaatttaaatgctgtctacttgaagaaaatgtttatattgaaatgttaaacaaaagaaatgcacttttaaaattataaagtatattttgttatctctttaattttctttcaattgttacatttatattgtgatcttcacaaacgaatcattatgaaacacttttgacaccaatttgatctgttgactaatagttcaattaattaatagctaaataggctttgtttcctttcaaattgattaaatgtttgcatagtttaaaaatagaaaaaaattacactaaggcattatctgagattcgtttgtaaatataaatcacgccattaattatactgcctaattcatgataatagagttaaggggtctgttttatttaaataattttctgtggttttcaacatgatttaataaaaatattcctgaaaaagatcaacacatttcccattgtgaaaattttttcatgaaattattatctagtatttaatcatgtaatattagtagattgtggtttccagttgctttgagataattacttccttttaccagaaaacttcaacatcaaatttgtaggcctgttgtcatttataaggtctgttcaatcaaggtcacaattctgtcttaatttcatagtattgctgtaacttcaattaagagatttttggaagtttgcctcatcaatttttctgcctctggccatgataatacataaaattgtgaggatataatatttttaattacttacttctgagaatcctcagtcctcaaagaaacttagccaaatatatgtatgttttgtttgtttgaattttgttttttattatagcccccatagttggtatgaagtgatatgttcttttaatttgcatttccctaatgactaattatgttgagcatcttttcatgtgcttgtaaataatttgtatttcttttttggagaaatgtctcttcaagtccttggtccactttttaaaataactgtttttctctgttgttgacttgtgaaagttctttatactttctgcatactaggcggttatcagatataagatttgcaaatatctcccattatgtggcttgtctttctctttccctttctctcgctgtcttgatagtgtccttagatacacaaaatattttaactttgctagagtccaatttatttttctttcattgctcatactttcggtgtcagatctgagatattattaccaaatccaaggtcatagagattttccgcattctttcttctaagaattttatagttttagcacttatatttaagtctttgatccattataagttaattatttatatgatgtgaggtaggagtccaacttcattcttctgtgtgtggatttccagttgttccagcaacatttgttgaagagactgctcttgccttcaaaaaatggtcttggcacccatgtcaacaaccagttgaccataggcccctgggtttacttctgaacttccaattgatcagtatgtttatccttatgccaatgatccatatatttatatttatgtcagtatcaaattatctggattactggtgctttgcaataagatttgaagggcaaattaccctgttatattatttttcataattgttttagctttggggctccttgccttccactggattttaggatcagctttctttaacatttacattttagcaaaaaaagaaaaaaatcattgggatttctatacggattgcattgagcctgtagattgcttttggtagtattttcatcttaatagtattaattcttccagtgtagtttattttggctgattactctgactagaactttcagtaccaatgttaaagcacaagggcaaatgtggaaatgcttgtcttcttccttatctaagtagataggtttcaatctttcacctttaaatatgatggtagctgtgggttttccacaaatgccctttattatgttgaggaagcttcttttaattttcagacttcccattgtttttaagatgaaataatgttagatttttttaaatgctctttatgcatgaactgagaagaatttctgtttatttctctttgttttatcaatatggtatagtacattgattgagttttgtatgttgaaccaccctggtattgctgaaataaatcacacaaaatcatgatataggatccttttaatatgctgctggatttggtctgttagtaatttgtgataaattatcagttcttatttttagttgggattcttttcttatcaatagcataaatcttctttatggcccatctttctggttttgtttcacaagaatttcaaaaaaactattataaaccatctttcttttccatgcagtcaattgaaattccctgataattatttttcataagagaaataactattttccaagtatggcctactacttctatttctaaatctctttaaattgagatggttaaagtacagtatagtaacaaccctagctatgtaatattaagattagtgggaggattaatgtcaatatttctttttttttattatactttaagttttagggtacatgtgcacaatgtgcaggtttgttacatatgtatacatgtaccatgttggcgtgctgaatccattaactcctcatttagccttaggtatatctcttaatgctatccctccccccagcccccaccccacaacagtccccagagtgtgatgttccccttcctgtgtccatgtgttctcattattcaattcccacctatgagtgagaccatgcagtgtttggttttttgtccttgcgatagtttgctaagaatgatggtttccagcttcaaccatgtccctacaaaggacatgaactcatcattttttatggctgcatagtattccatggtgtatatgtgccacattgtcttaatccagtctatcattgttggacatttgggtgggttccaagtctttgctattgtgaatagtgccgcaataaacatacatgtgtgggtgtctttatagcagcatgatttataatcttttggggatatacccagtaatgggatggctgggtcaaatggtatttctagttctagatccatgaggaactgctacactgacttccacaatggttgaactagtttacagtcccaccaacagtgtaaaagtgttcctatttctccacatcctctccagcacctgttgtttcctgacattttaatgattgccattctaactggtgggagatgatatctcattgtggttttgatttgcatttctctgatggccagcgatgatgaacattttttcatgtgtctgttggctgcataaatgtcttcctttgagaattgtctgtttatgtccttcacccactttttgatggggttgtttgtttttttcttgtaaatttgtttgagttcattgtagattctggatattagccctttgtcagatgagtagattgcaaaaattttctcccattctgtaggttccctgttcactctgatagtagtttctgttgctgtgcagaagctctttagtttaatgagatcccatttgtcaattttggcttttgttgccattgcttttggtgttttagacatgaagtccttgcccatgcctatgtcctgaatggtattgcctaggtttttgtctagggtttttatggttttaggtctaacatttaagtctttaatccatcatgaattaattttggtataaggtgtaaggaagggatccagtttcagctttctacatatggctagccagttttcccagcaccattaattaaatagggaatcctttcctcatttcttgtttttgtcaggtttgtcaaagatcagatagttgtagatatgcagcattatttctgagggctctcttctgttccattggtgtatatctctgttttggtaccagtaccatgctgttttggttactgtagccttgtagtatagtttgaagtcaggtagcgtgatgcctctagctttgttcttttggcttagaattgacttggcgatgcaggctcttttttggttccatatgaaatttaaagtagttttttccaattctgtgaagaaagtcattggtagcttaatggggatggcattgaaactataaattaccttgagcagtttggccattttcacaatattgattcttcctacccatgagcatggaatgttcttccatttgtttgtatcctcttttatttcattgagcagtgatttgtagtttttcttgaagaggtccttcacatcccttgtaaattggattcctaggtattttattctctttgaagcaattgtgaatgggagttcactcataatttggctctctgtttgtctgttattggtgtgtaagaatgcttgtgattttttgtacattgagtttgtatcctgagactttgctgaagttgcttatcagcttaaggagattttgggctgagacgatggggttttctagatatacaatcctgtcatctgcaaacagggacaatctgacttcctcatttcctaattgaatgccctttatttccttcccctgcctaattgccctggccagaacttccaacactattttgaataggagtggtgagagagggcatccctgtcttgtgccagttttcaaagggaatgcttccaggttttgcccattcagtatgatattggctgtgggtttgtcatagatagctcttattattttgagatacatcccatcaatacctaatttattgagagtttttagcatgaagggttgttgaattttgtcaaaggccttttgtgcatctattgagataatcatgtggtttttgtctttggttctgtttatatgctggattacatttattgatttgcatatgttgaaccagccttgcatcccacggatgaagccctcttgatcatggtggataagatttttgatgtgctgctggattcggtttgccagtattttattgaggatttttgcattgatgttcatgagggatattggtttaaaattctcttttattgttgtgtctgtgccagactttggtatcaggatgatgctggcctcataaaatgagttagggaggattccatctttttctaatgattggaatagtttcagaaggaatggtaccagctcctccttgtacctctggtagaattcggctgtgaatccctctggtcctggactttttttggttggtaagctattaattattgcctcaatttcagatcctgtaactggtctattcagagattcaacttcttcctggtttagtcttgggagggtgtatgtgtcaaggaatttatccatttcttgtagattttctagtttatttgcatagaggtgtttatagtattctctgatggtagtctgtatttctttgggattggtggtgatatcccctttatcattttttattgtgtctatttgattcttctgtcttctcttctttattagtcttgctagtgttctatcaattttgttgatcttttcaaaaaaccagctcctggattcattgattttttgaagggttatttgtgtctctatttccttcagttctgctctgatcttaattatttcttgtcttctgctagcttttgaatgtgtttgctcttgcttctccagttcttttaattgtgatgttggggtgtcaattttagatctttcctgctttctcttgtgggcattgagtgctgcaaatttccctctacacactgctttgaatgtgtcccagagattctcgtatgttgtgtctttgttctcattggtttcaaagaacatctttatttctgcgttcatttttttgtgtacccagtagtcattcaggagcaggttgctcaatttccatgtagttgagtggttttgagtgactttcttcatcctgagttctagtttgattgcactgtggtctgagagacagtttgttataatttctgttcttttacatttgctgaggaatgctttacttccaagtatgtggtcaattttggaataggtgtggtgtggtcctgagaagaatgtctattctgttaatttggggtggagcgttctgtagatgtatattaggtctacttggtgcagagctgagttcaattcctggatatccttgttaactttctgtcttgttgatctgtctaatgttgacagtggggtgttaaagtctcccattattattgtgttggagtctaagtctctttgtaggtcactaaggacttgctttatgaatctgggtgctcctgtattgggtgcatatatatttaggatagttagctcttcttgttgaattgatccctttaccattatgtaatggccttctttgtctcttctgatatttgttggtttaaagtctgttttatcagagactaggattgcaactcctgcctttttttgttttccatttgcttggcagatcttcctccatccctttattttgagcctgtgtgtgtctctgcatgtgaggtgggtttcctgaatacagcacactgatgggtcttgactctttatccaatttgccagactgtgtcttttaattggagcatttatcccatttacatttaaggttcctattgttatgtgtgaatttgatcctgtcattatgatgttagctggttattttgctcattagttgatgcagttgcttcctagccttgacggtctttacaattgtgtatgtttttgcagtggctggtaccggttgttcctttccacgtttagtgcttccttcaggagctcttttagggcaggcctggtgttgacaaaatctctcagcatttgcttgtctgtaaaggattttatttctccttcgcttatgaagcttagtttggctggatatgaaattctgggttgaaaattcttttctttaagaatgttgaatattggcccccactctcttctggcttgtagagtttctgccgagagatctgctgttattctgatgggcttcccgttgtgggtaacccgacctttctctctggctgcccttaactttatttccttcatttcagctttggtgaatctgacaattatgtgtcttggagttgctcttctcgaggagtatctttgtggtgttctctgtacttcctgaatttgaatgttggcctgccttgctagattgaggaagttctcctggataatatcctgcagggtgttttccagctgggttccattctccctgtcactttcaggtacaccaatcagacatagatttggtcttttcacataggcccatatttcttgggggctttgttcttttctttttattcttttttctctgaacttctcttctcacttcatttcattcatttcattcatttcatcttccatcactgataccctttcttccagttgatcgcgtcggctactgaggcttgtgcattcatcacatagttctcatgccatggttttcagctccatcaggtcgtttaaagacttctctgcattggttattttatttagccattcatctaattttttttcaaggtttttaacttctttgccatgggttcgaacttcctcctttagctcggagtagtttgatcgtctgaagccttcttctctcaactcgtcaaagtcattctccatccagctttgttccattgctggtgaggagctgcattcctttggaggaggagaggtgctctgactttcagagtttccagtttttctgctctgttttttccccatctttgtggttttgtctacttttggtctttgatgatggtgacgtacagatggggttttggtgtggatgtcatttttgtttgttagtgttccttctaacagtcaggaccctcagctgcaggtctgttggagtttgctggaggtccactccaggccctgtttgcctgagtatcagcagcggaggctgcagagcagaacagcggctactggtgaacagcaaatgttgctgcctgattgttcctctggaagttttgtctcagaggggtaccaggccatgtgaggtatcagtctgcccctactggggggtgcctcccagttaggctactcaggggtcagggacccacttgaggaggcaatctgtccattctcagatctccaactgcatgctgggaaccactactctcttcaaagctgtcagacaggtacatttaagtctgcagagttttctgctgccttttgtatggctatgccctgcccccagatgtggagtctacagaggcaggcaggcctccttgagctgtggtgggctccacccaattttggccgctttgtttacctactcaagcctgggcaattgtgggtgcccctcccccagccttgctgccaccttgcagtttgatctcagactgctgtgctagcaatgagtgaggctccgtgggcataggaccctctgagccaggtgctggatataatctcctggtgtcctgtttgctaagacagttggaaaagcacagtattagggtgggagtgacccgattttccaggtgccgtctgtcacccctttctttgactaggaaagggaattccctgaccccttacacttcccggttgaggcgatgcctcgccttgcttcagctcatgctcagtgcgctgcacccactgtctgacactccccagggagatgaacctggtatctcagttggaaaagtagaaatcacctctcttgtgcattgctcactgggagctgtagactggagctgttcctatttggccatcttcaatatttctaacatattagaatctatttgattttttaaatctacataaactcgtgtactaacagttattttatttgtaaaacacttttttttcctatagtatgttggacttatcaatattttgaatatgtaagtcttaccctttggagtttactgtccaaagggcaaaccttatatattttaaatgtatagcttctaatgttctgattatagaacagttatgcatgggatataagcaacaatttgtcttccaaatatgtcatatttgccactgttttcatggattatatgaaacctgtgaataattgcttttgtgtatattgattcttcagttacattcagtggtggtaactacttgaaaatatttctgataactaagtttgaaattagattttaactgttcctgtaagtccctcattcagtgacttattgtgtaatgctattttattgcttctatacatcctatttcttatgtaatcatgcatgtaagatttaatcttgaatctttgaatatgtgaacctcactttattctactctcttgattgatagtttactgtagaataaatttgattggttgaaagtaattttctctcagagttttaaagtcattgttctattattttatggaatccaacattacttatgagaataataccaaccatttcaatgtgtctttgtaaataagctgtttttttttcccaatgggagaaacttaggatcaactcaatgtttttgctgctctagaaagtctagaaaaatgtggctaggttttttacaacatactattcattgagataccaagacaattaatactgtaagtcttcatctctaggaaattatgtttgattcttacaattgtgataattgttatccttcgttttctctattccagtgaacgaagtaccagtgatggtcactggggagggagttttaatcaacagcactaaggttcatggtagctgcttcagtttttcccaaatgattacttgaaaaataacttttgttttgttttgaaagtgggaagtttaaattggatgttagtgattttattgaggatgatggaagagtgcagttgatgagaatattttcatttgatcatcttattttcagcctttttactgtctgtaatttttgatttttcaggtctgcctcccaaccctctaagtgtattttaggaaagatctatgcccccttaacttcagtcctcttcataaatatttctggctgcaactacttgcactgtgttttattagcgcatgcctttttacatgccttccagaaatatgttggaatctctagtctgctaatgactaccaattgttcttttaattttaatagcttatagctcttaaaactgcctttaatctcaccgtttaggtctcatatgaggagaaaatttaaaaaattatattttctagtccatattcttcaaccgctgtttccttaaaatgattcattgacacaaaaaatggcatttggatatgcgaatggattccatcaaagccttcaaaatgggaggtctggcaaacaatttattttttcttacaatatatacctattcccaaaagttatttgactactttgtttatatattttgtgcttatttgactattctattccttagcctactttttctttacccactcttctcttgcctatctcatagcctatttcagaaatatgtttatgcagatttttcatctaaatcttttttcctgtcttttccagagtatttcttcagaatttcactttcttctgaagtagcttattcacatatttcctaaataccttttcttcccccccaaaattatattaataacttttatttaagttgtttgttttaaacctgttccattaaaaattccaaggctttgtttgtactactatgcaaactctactgcatattactcagcaatattggctttagctgattatatccagcaatgaatgcttcttcacctctaagacataaactgttttctgcagaaaggccttacatcagatggacagaaagtctcacaactttctgtaccttacagttatggttctccaaatgcagcatcgttcaaagtcacctgaagaacttggtaaagcactggtttttaggtccaatcttgtaatttctgattcaataggcctgcatgaaagccaagaatttccattcctattaagttcctaggtaattctgatactgctgatctgagagctgtagtattagaaccattgcctggagaaccactattccattggtaaaagggtaactcacatgtccttactctgaaagatggaaagatttatagaaagtccaaacaagtcaatagtttctgaaagcactaccttgtataattatgacatgctaataattttgtaggtagtcaacataaaagaaagatgtttgaggaggatataacagaaaactgggtttatttatatgtctgttggctttaccaatatctcacagtcttgggtaaactgatcaaagcacacataagttctaactctaatttttgcaaatactatagattctaaagagaaaaacaatgaaatgattatgaatctcatcctctttgtcagcatgcgtgtgtattgtctacctgtatgcccaatatttatgagttattatgtgctaatatgaaagaaatatttattaaatgtgctatgtttaacaaaataatgcagttcttccctaagcaatcacaaagtatgtatcattggctgaaatacaatcagatttgtcaattttccattttgtatagtagtgacatatgtgctacttatggaagaataaagataaattataaagggatttttattagtaaagaataaacttgcaaagtttcagatttatatttttttttcaaaaactgactatatcttatgctttaacttttaagaaatgttagatagcattgacaaatgtctacttcctgaaagtttgaattaatgaaaactgtttcttgaccatatatagccttcaaatagtcttcagaggtgtatatgggttgtgtgtgtgcgtgtatatgtgtgtgtttgtaatgatgtagtgaatacagaacactttttaaagtattagaaacaataaaagggtgcattagaatggatggcatctgcatcatatatatcacaagcttttaatatctgataatcagtatttttattatgtccagtgtgataataaaatgaatcctatgttgtttgttaattaccttttgtaaaatatcattttacattatactatcagcatttttatgccatcaaatatgcttctgaaaaattatttttattgtgtcatatgaaggtggcacaaatttagcttgtccctcaattaatgggaatttaaaaaaatttgttttctaagagggaaattgccaagttaaagtgtataaatatatttatggctcctaataatttttttataaagccattatactcctacctgaggtttcattttacattttaaagtatgcttgttacataaatagtctatggttatttatatttttaccaatttggtaggtaaaattataatatgttatatagttttaatcggcatttttgtaactttgtttggaatagaagtttttaacatccttttttgctacttgtatttgaaagtgaagaataaagcatttatggctttagtgggtataatctatcctgtcaaagcagaaaaataattactaaaattttgtaaaggttatttttatactattttcctattttaaatctaaagatatggggtaaatacatgcattattgttatagttacttttagtattttagatttacagacatttctctttctctttccttttttctcttctactttgtatgcccttaagaatgacttatttaaactcatttgtcaaaatcagaattagtgcataaatagttctatggataagaaaaactctgttttatatgtgatccaaaatgcaatatatgaatgttatattgcctagaataaacgttcttaattttttagggaatggaactcattatgaaacatacaaacatgtttacctgtttgacagtttaccataccagaatcgtttcttttgcaaattgaagtataatgaattagtacaatctctgagaacacagagatatcacatgagaatgaaatctacagcatttaactttcagatttattctttcacttattctaggtgtatatatatcatttgtaaagtgagtgactcttcactttttaaatctaggaataatatcagtttttttttcaggaagaaacttcctccagtcaactcattactaaatatttgtgtgagtgtgtgtgggctcgtgtgggtttgtgtgggcttgatgtgcttttctcttagttgaataacagtatcagtcctataagcatgtaatgatacaagaagacaaccaaaaaagatctggaggcatccttgttatacaattagacaaagaaaatgtgtgtgtgtgtgtgtgtctgtgtgtgtgtgtgagagagagagagaaggagggagtatttaacgagtagcttctaaaattttgagatgggatagattaaatggagctaaatgttgaatttataattactaaatatctatgtaattattaaagataaaatttaaaataaaaatagggcatagtctttttttattatacttcaagttttagggtacatgtgcacaacgtgcaggttagttacatatgtatacatgtgccatgttggtgtgctgcacccagtaactcatcgtttaacattaggcatatctccaaaatggaaagctaaaataacctttacattttaagaagtgactgaattttagtttatgattgactgtcttctagcggtagaattgacatagttcagaaagggagctaaatgtgcctccactgtgataagaaatgggaagaaaatagaaaaagtaattgctttagcaatgatctagtatgaaagtgatggattctttcaggtagaatttggtaggctttcagtggctggcacattcttcggagcactcaatgaggtcaaatatctcagtgtaggaaggtgtaaactgtttagaaacctgctaccatccaacaaattgaaactgaactgatgttagtgtagctgtgcactaaggcatgtttttctgtgtccatgagtatgagatgaagagggactatctcttaaagatttttctatctgatactcttcaggatctaatgagatcagccagctacagataaacaaactgatgctgaacctgcaattggccatctcctctcagctaacccatttgtctttagctgttctcacagagggaatgacagtgcatttatttagggcaaaagaaatacctatttttatataactatttgagaaaagaatcaagatgagtcaataaagatgtagcaaagtttggcttttggatccgtcctgttttgcttctctggccagctacacacgtttggggaactaatcatttactttgacagagtttcctgcatcacaccttctactgaattttctaaaaaagcaaaaagtattttgtcctccagcattcaaacaccaggtggtctaatttttgcctgttggctcaaaatatgtgtttggagattttctccctgacctgaatcgatcctctaactgacagagcaatgtaaatcttggacataaacaacaaagagtgtgtttctactggcaaagacagtgtaaattatggaggatttatgtactatggtaataaattaagttcctacaagtgcttttgtttgaatagaaatatcaaaatcccaaggcctgttgctttagacatatacgtgatttttttagtccaactttgattattagcttatatccctttactcccctgatgcttcattcatttcagaattagtacttggggaatctcctacttcagtcccagaagaaactgggttagtcacagatagttcttcatagcatgcttcttctcacagtggtaccaacgaagcatggcaatgcaatacattttgtcctccaaatcatcagccatgaaaattggtccttaattttgtctttactttccattatttatataaacctataagaaaagtacttgttttataagcttgatgtcatttcgtgtagtgtgtactagaaaagtattgccttccaggtaaaagagaagaagagtttgtttcttttttatagtagtacctaattgtatttcagttctggagtgcccacatattctgtagctttgaaaattacttggcaaatccattttcagattatgtatactgattatgatttttacaaggtttggttcttatttactttcagtaatttcctttcctgttagaaaaatctaaatattgctttgttcttctaaaggaaactctttaaccaattttctctggaggattcttagttttctgacatctttttgaaattaaggactagaaccacactatctattagaagtacatatattctatgtatgtagagataatgttttctgatgttttcactactgtttattatttccatggttgtcatcactacaacagaatcatccattttaaatgagccttaagttttctacttattaaatatcttgttttttgaataaaaggaacttaacaatagattttatgttgttctatataaaattgttctccaaaaattcgcaaaattttttatttatttatttatttatttatttatttattttgagacaggatctcactttttcacccaggctgtgcagtggcgcagtcacacctcgctgcagcctggaccttaagcaattctctcatctcagcctcctgaggagcttggactacaggtacactccaccacaactggctaatttttttgtattttttgctgagacagggtttcaacatgttgcccaggctggtctcaagcgatgcaccctgcttagcctcccaaagtgtgtgactaaagttatgggccactgtgcccatccaaatttttacttttacataggtaataccaccataagttcaaatattaaaaagcataaattcatgccaagccattagttttgcaccaaactgtgtgacccaaacacccaattcctcttccaaaattggtatagattcatatgcaaatactaattttctatcctttctaaattgaaattatatatgcattgtattgcacctttcttcaagtgtttaatatgttttggataacaatcttttattaatcttttattcctaaagagttccatattctttttatggctgtgtattatttcattacatggatatgctatctcacctaagtcttattgattgatagataaggctttcctaatatttttatattaaaaacaatgattcagtgaaacactgtgtacatgtcccttcacatatgtgcaagtataagaaaaaaataaaatctcaaaagttaaattgtttgatcaaagggtaaatgcattcatattttgccaaattgccctccaaaggatttgtaccaatgtggacttagcccggtgatatttgagagcacctgatttctacatactcattaagtgccctaacaaatttgtaaatctttattattctgataggtaaacatgttttctctcttaaataatttgtagcatccatacatgttattttctttgaactgtttacatatttttatcataatatttcattgtgttctttttatcaatcgtagacgacctttattcattgaggataatagatctctatgagattgctttattctgctttcttaaacacattcagaaattatgatcaaaacatgaatggtttgaaattattacaataactcagattgtttttgcagaaatatttcatattttgtgcttctcctcatgttttttaaatctcatttctgtttctacacaaaaggttcatagtctagtacaattatattaagaggtggtatttggtagctatatgaagaaagttgtgggtgatgaaatcagtgatagcatagtgactaaacataactgaattgcctaactcaaagtttaatccaatttttgaataagtcaagtagtagtatctttctcacctgcacatttggaattcccatgtttcaggcttcttttgtcattgtattttatttcctaattcagtaaaacctgtaattgaatgtattcgtttcctacgactgccataacacaatatcacaaatggagtggcttaaaacaacaaaaatgtactgtctcacagctcttagagcgagaagtgaaaaatcacggagtcagcagaggtatgctgccactgaaacatgtaagagagaaatctttgccacttcctagcttctggtgatggtcatcaactggcatttttttttactttcagctacattactccaatctctgccactgtcctcataaggcattctccctgtgtgtgtgtccacatttccctcttcttagtacaccaacagtcgtattggatttgggcccactctaatgatctcacctttatttgatcacgtatacagagaacttctttacaaataaggtcacattcagagggactgggagttaggcttcaatatattttgagtttggggaagccaattcaacctataacattgagtaatagcaggtaaccacaatgctttagtgatcttataaaaatgatgtcgaaaagtaagctctgtgttctagagtttgttttcattataaagattacattcactgaaagctctatgcatataatgtatctttagatgatagtctactataaatgttgatgctcttagctttagaaaaattcagtaaattctaaaaactttcttcaaattgagctgaactcatctgtgatctcactatttctgtgtcacaatcaatttgggaaataaacatattttaatattatattttctctttgttcatgacgggcatagtcaagtgatgattagtttatgtgattcattttattgcatttaatagaaattactaaccagaattacagctcaagtctctcgacagggaacaaatcacagcaaatgaatccaacaggaatcaatatgatgattcattagcaatgagctctcactgagagtcccaacaagctgaagacttcataccatatttttttatgaaccaaatgtcaatagcgaaattaactactaaaaagtatcacagaaatgtgctttattttaatatcatatttcacaattttttaaacaactgaaacaagtttatgtatttcacttttgcttctacaaattattttaaaatagtttccacatctcaaatatcatattggaataattattagaattttataaagtctgtttcccaaaatatttactaaatattttgtcctcataatctcactagaagattacattccattatatgatattttaacagttttctcattggtttaactgtggcatgtatgcacaaatacacatgcacatgaatccatgtgcagacacacacatatatgcacagcacaaggtcgaaagcacattaaaagatttctcaaatatagatatatcaatatataaatatgaaaaaagcatactatgtgtgtgtgtgtatatatgtatacacacaaacatatacacacacatatatatatacaaacacatacacacatatatatacaaacacaaatatgcacacatcaactttttggatatgacatctaattcaactccaaatttccccagttatactgtcatgaccttagaaatgaagtaggtagactgggggatcttgggataaggagtataacactgtttctgcagttttattttattttattttattttattttttgagacggagtctcactctgtcgcccagactggagtgcagtggagcgatctcgactcactgcaagctccacctcccaggttcgcgccattctcctgcctcagcctcccaagtagctgggactacaggtgccagccaccatgcccggctaatttttttttttaattttcttttttttttattattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaagagtccccagagtgtgatgttcccctttctgtgtccatgtgatctcattgttcaattcccacctatgagtgagaatatgcggtgtttggttttttgttcttgcgatagtttactgagaatgatgatttccaatttcatccatgtccctacaaaggagatgaactcatcattttttatggctgcatagtattccatggtgtatatgtgccacattttcttaatccagtctatcattgttggacatttgggttggttccaagtctttgctattgtgaataatgccacaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgggagatggtatctcattgtggatttgatttgcatttctctgatggccagtgatgatgagcattttttcatgtgtctgttggctgcataaatgtcttcttttgagaagtgtctgttcatgtcctttgcccactttttgatggcgttgtttgtttttttcttgtaaatttgtttgagttcattgtagattctggatattagccctttgtcagatgagtaggttgtgaaaattttctcccattttgtaggttgcctgttctctctgatggtagtttcttttgctgtgcagaagctctttagtttaattagaccccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccattttgaattgatttttgtataaggtgtaaggaagggatccagtttcagctttctacatatggctagccagttttcccagcaccatttattaaatagggaatcctttccccattgcttgtttttctcagtagagataggatttcaccgtgttagccaggatgttctctatctcctgacctcgtgatctgcccacttcggcctcacaaagtgctgggatcacaggcatgagccactgcgcctggactttctggagctcttaaaaaataaactttatttagaaagaaaacaaaaaacaaaaacaatttttggaacagttgtaggttcacagcaaaactgagcagaagttacagagatttcctatatacttcctgttcccatattaatataccatctgtcattaacaacatcttcctagagaacagtgcacttgctacaattgatgaagataacttgacacatcattaccaacccgggttcacagttaaagttagaactcacttttggtcttattgagtctatgggcttggacacatttttaatgacatatatgcacaattatggtattatgcagaatagtttcaccactcaaaatcctctggattctccttatgtatccctccctatccctaacccttgaaacgactagccttactgtatccacagtttcacctcttccagaatgtgatatactcatttatgtttcttccatgtcttttcatggcttgatagctcatttttttagtgctaaataatattccactctctagatgtgccataatttatcaattctccaacatctgtttcttccaagttttggcaattataaataaagctactataagcatcaattttcaggtttttgtctgaacataagttttcatctcctttggataaatagcaatgagcagtatggctggatcctacggtacgagtatgtttcattttctaagaagctgcctgtttttcatagcagctgtaacaatttgcattcccagtggtaatgaatgaaagttcttgttggttcacatcctccccagcatttggtattatcagcgttctggatttggctattctaataggtttgtagaaatatctaattgttgttttaattttaatttgcatttccctaatgacatatgatgtggagcatattttatgtgcttgtttgccatctgtatatcttctttggtgaggtatcttttaatgtatttggctcattttttgtttgttttctttttgttgaattttaagcattccttgtaaattttgtataatagccctctatcagatatgtcttttgcacgtattttctctcagtctgttgcttgttttatcattctcttgacagtatctttcacagagcagaaattcttaattttaattaagtccaagttatcaaatttttctttcatgaatcatgcctttgttgtagtatctgaaacgttaccatcaaacccaaggtcatatgatttttttttctatgttatgttgtaggagtttaatatttttgcattttgcatttaggcctgtgattcacttcaagttaatttttgtaaaaggtgtaaggtttatgtttagattcatttttctccaggtggttgtctagttgttccagcactgttttttgaaaaaatttccttttctccactgtattgtcttttcgcctttgtcaaagattggtatactgtacttatgtaggtctctttctggactcttttctgttccattgatctatttgtctgttctcttaccaataccacactctcttgaccactgtagctttataacaaacttttgagtcaggtagtatcagtcttccattttttttttcttcaactttaacattgtgctagctatactgaatattttgccacttcataaaaacttccgaatcatttagtagatatctacaaaataacttcctgtaattttgattggggttgtatattatttatagatcaaattgggaagaattgacatattgaaaatattgaatctttttgtccataaacataaaatatttatccatttattcagtcctttttatatctttcattagagatttgtagttttcctcatatagattctgtgcatattttgttacatttatatttaaatatttccttttggggatgctaatgtaaatagtgtgtgttcttggtttcagattcctcttgttcattcatggcatataggaaagtgattaacttgtgtatattaactttgcattctgccacactgctataatcacttgttagtttcaggaacttttgttgttgttgtcgattgttttggatttcctacataatgatatcacctgtgtacaaagacacttttaattcttctacaccagtaagtatacctttatttctctttgtataattgtgctaggactttcagtaaaatcttgaaaaaagagtggtgagagttaaccttgcctacttcctgatcttagttagaaagcttccagttttccacaatcaagcatgatgttggccatcagttcctttgtagatgtctttatcagtttgagcaagttctattcttagttgactgagagattttatgatgaatgactgagagattttatgatgattttatgatgaatttttggattttgtcagatgctttttctacatctattgatacagttttgtgatctttcttatttagcttgttgatatgatggaccatattaattgattctggaatattgaaccagccttgtatatccgggataaatcccacttggtcatggcatacaattctttttatacattgttggatttgatttgctaatattttgttgaagatatttgcatctatgtccacaacatatattggtgtgtagtttccttttcttataatgtctttatctgattttagtattcaggtaatgctgacttcatagaatgagttagaaagtattcactctgtttccaccctcagaaagacattatagaaaattggtataatttcttccttgaatgtgtggtagaattcatgagtgaacccatctgggccttgtactttctgtttggaaagttattcatttttgattcaatttgtttggtaaatattcacctattcagattgccatttcttcttgggtgagatttagcagattgtgtctttcaaggagtaggtctgtttcaactaggttatcaaatttgtggtcatggagttgtttacaatattcctttattatcatttgcatgtccattagatctgtagtgatgtgtcttctttcatttctgatgttagtaatttgagtccactcttcttttttttttttttttttccttagcctggctaaaggcatacagattttattgattttttttttttttcccaaaagactgacttttgatttcactgaatttctctattggcttcctgttttctactccattgatttctactctggtttttagtactactattattacttccagttactttttatttaatttcctctccttttcctagtttcctaagatgaaaacttagattattaatgttagatctttcttcgtctctatacaatcaatgttataaatatccctgtaagcactgctttcattacatcttacaaattgttatgttgtgttttcatttttatgtagttcaattttttttttaattttctgttaagatgtcttctttgacctgtatgctatttaaaagtgtgtttgtaatgccccgtaaccttcagcaatcccactgttgggtataaacccaaaggattataaaccattctactataaagacacattcacatttatgtttattgcagcactattcacaatagcaaagacttggaaccaacccaaatgcccatcaattatagactggataaataaaatctggcatatatacaccatggaatacaatgcagccataaaaaaggattagtccatgtcctttgcagggacatggatgaagctggaagccatcattctcagcaaactatgcaggaacagaaaatcaaacaccacatgttctcattcataagtgggagatgaacaatgagaacacatggacacagggaggggaacatctcacactggggcctattgggggatagggtagctagggtagagatagcattaggagaaatacctaatgtagatgatgggttgatgagtgcatcaaaccaccatggcacatgtgtacctatgtaacaaacctgcatgttctgcacatgtatcccagaacttaaagtataatttaaaaaaaaaggagagaagagaaaaaaaggggtgtatttgtttaatttctatctattttgaaaattttcagctatctttctgttatggatttctggtttaattttattgtggtctgagaacaaacattgtttgattcctattctttcaaatttgttaaaatatgttttatggcccagaatgtggtttaccttggtgaattttccatgttagcttgagaggcatgcttttctgatgttgaatgaagtacccaatagaggtcaattatattcagttcattgatggtgctgtagagttcaaatatatccttacttatttcctgcctgttggacctgtccatttctgatagaggggtgctgaagtttccaaatataatagcaggtttatctatttcttctttcagttatattagttgttccctgatgtattccgatgcaatgctgttaagtatgtacatattaaggactgtcatgtcttcttaaaggattcatccctttatcatgtaatgctcctccttatctctgatactatccttgctctgacgtcggctctgtctgaaatttgttttgatgattgttagcataatatatatttccccattcatttactgttaacttatatgtatttatatttagggtaagtttcttgcagacaaaatatagtcttgcttattgatccactctgtcaatcttatcttttaattgatatatttataccatgatgtttaaaataagtattgatatagttgggttaatatttatcttatttatgactatcttctatttgttgcctgtgatcctggttcctttttttgtcttctactctttccgcattttatgaatttaattgatcactttatattattccatttcatcttctttttatcttagcatatcagttatatatttttccttggtttcttataagttatttttagtggttgctctgaagtttgcaatataaatttacaactaatccaagtccaccttcaagtaacactatgctgcttcataggtagtgcaggtaccttacaataactccctaaaaataatacttaatatttctaacttcttaaaaaataataattaccccctccattctttgtatcattgctgttattcatttcacatatacgtaagcatacacatatatatgcatttttaataaaaacattgtttctgttattaatttgaacaaattattgtccatttgataaattaagaaaaaggtatttattttactttcacttactcattttctgatgctctttctttatgttgatacaagtttctgatctatttcagttttcttttctctgaagttcttcttttggggtttcttgcagggagggtctgctgacaacacatcccctcaaatttttttttttttttggtctaagaaaattcttatttctctttcacattttaaggataatttcacaggttacagaattttaggttgatgatattttcctcttaatattaaatatttcatttaattcttttcttgctttcatagtttctgataagtcagatataattttatcttagtgagtgctttttttctttctctctagtttctctcaggatttttgtttctttattttgattttcttcaatttaaatatgatttgtctaggtgtaggttttcttagcatttatcttgcttgctgttctctgaggttcctgaatctttggtttggtgtcagacataacttgaagaaattcttggtcgtgggtgattcaaatatttcttctctttttttttaattcttcttctgatagtctcattacatatatgttacactatttgcagttttctcacaattcttggatattctgtgttgttgatggtttttttaatctttttttatttttcttttttggcaataacaattgaaatatccttaagctcaggtagtcttctctcaaccatgaccgatctactaatatgcccaagaaaggcattctttattacttttacagtgtttttgagctctagaatttctttttgtttctgtctgagaatttccgtctctctgcctacattgcccatctgttcttacatgctgtctcctttatacattaaagttcttagcatataaactgtagctttaaaaattcccagtctgataattctaacatccctgccttatctgagtatggttctgacacttactgtgtctcttcaaactgtgtgtgtgtgtttctttttttagtatgccttgtttttttaatatatatctgaacatgatgtagtgggtaagtagaactgttgtaaatagacctttagtaatgtggtggtaaggtgtggtccttaatcataggtctggtcctatgattgagactcggtcttttagtgagcctgtgcctctggactgcaaccttcacaagtgcttctctgttccccctcccaccctcttttacctttaataggatagctagaatgggctgacgttgagtattttccttctcccagttggaaggctagagcctgctggagttgggcatttccctttcccaggtcatgtagactcgaattaacccccagtaggttaggttcaagttaaacagtttccccagggacagacattgtgaagaagaaaagaatagtgtatttcaaaatggttactttctcccttcccctgctggaagcatgaagggatttttttttcctctaatattcactgtgggaatctagttcctcaaggcaaaactcacataagtatgggcacccgcctatgactagatccccctagagtttttgactctcagaattttccacactgagtctccagcaagtcatcaaatacagttcaggttttcctatagcccagcaatagttcccacagaggtttctggtccagtaagttgcaattctccttacaggcgtatcttgccttagagacattgaaggttcagttccagatcacagccacaaagtgaatactgcaataaagcaagccacacatttttttgtttcccagtacatatcaaagttatgtttccactgtgctatagtctcttaagtatgcaatagcactatgtctaaaaaaacaacatgaataccttaatttaaaatacttcatttctaaaaatgctaacaatcttctgggccttcagcgtgtcataatccttttgctggtggagagtcttgcctgggtattgatggttggtgcctgattagggtggtggttgctaactgaggcaatttcttaaagtaaaacaacaatgcagtttgccttatcaattgcctctttgtttcacaaaagatttctctatagcatgccatgctgtttaatagaattttacccatggtagaacttctttcaaaattggagtaaatcctcttatccctgctgctgatatatcaactaggtttatgtaatattcgaaatcctttgttgtcatttcaacaaggtccatagcatcttcaaaaggagattccatctcaagaaaccactgtctttgttcctccataagaagcaactcctcattattttcattctcattttattgtcagattgtagcaatttggtcacatcttcaggctctacttctaatactatttctcttgttatttttaccacaactgcagttacttcttccactgaagtattgaactcctcacggtcattcatgaaagttggcattaaattctttcagacttctgctcatgttgattatgttgatcacctcccatgaatcacaaatgttctaaatttcatctagattggtgaatcctttccagaatattttcaatttactttacccagacccattggaaaaattgctatctatgacagctgtagccttacaacatgcatttcttagataatatgacttgagagttgaaactactctttgacccataggctgcagaatggatgttgtgttcacaggcataaaatcaatattaatttccttgtgaatctcgatcagagctcttgggtaaccaggtgcattgtcaataagcagtcataatttcaaagtaatattgttttctgagcaccagttcgcagcagtggccttaaaatattcaggaaaccatgctgtaaacagatgtgctgtcatccaagctttgttgttccattaataggacacagggaggatagatttaacagaattcttaagagctctaggatttttggaaaagtaaatgagcattggcttcaacttaaagtcagcagctgcattagcccctaacaagagagtcagtctgtcctttgaagctttaaagctaggccttgttttgtcctctctagctatgaaagtcccagggggcatcttcttccaatataaggctgctttatcttcactaaaaatatgttgtttaaatgagaacacatggacaagggaggggaacatcacacaccgggccctgtcaggcataggggacaagaggagggagagcattagaacaaatgtacatgggggttaaagcctagatgacaggttgatgggtgccacaaaccaccatggcacatgtatacctatgtaacaaaacagcaccttctacacatatatcccagaacttaaagtaaattaaaaaataaaaatctgttgtttagggcagccccctttgtcaatgctttcagctagatcttctgaataacttgttgtagcttctacatcagcacttgctgcttcctcttgtacttttacattatggagaagacttttctccttaagcctcatgaacaaacctctgctggcttctattttttcatctgaagctttctgacctctctcagacttcagagaattgaaaagacttagggcctttccttagattttgctttggcttaaagaaagatagtggctggtttgatctattcagaccactgaaactttctccatatcagcaaaaaagacttctttgttttctcaccatccgtgtgttcactataatagtacatttaatttctttcatgaacttttcttttacatttacaacttgctcaactcctcgatgcaagaggcctagctttcagcttatctttgctttcaacctgtgttcctcatcaagcctaatattttctaaattttgatttaaagtgagagaggtgggacgcttcctttcacttgagcatgtagagaccatttgcagagttattaattggcttaatttcaatattgttgcatctcagggaatactgggaggggggaattggggatgaagcaatcagaacacatgtggtgtttattgattaagatcgattcattttgccatcttttatgggcatgatttgtgtcccctccaaacagtaacatcaaaaatcactgactatagatcaccataagagatataacaacaatgaaaaagtttgaaatatattgagaattaccaaagtgtgacacagagacataaaaagtaagcacttgctgttggaaaaattgtgcaaatagacttgtttgatacagggttgccataaacattcaatttgtaaaaaaaaaaaaaaaaaaaaaaaaaaaaaaaaaaaaaaacacacaacatctgggaaatgcaacaaagatgaagtgtaataaaatgaggtatggctatatctgctcctgtctccaaaattttgagagtagatgtttaccttgcaatctcacttctattatgggtctaagaagagttgctggccttctgtgtgttcagctttttacttattgttgcaatggagtgatgatttccaagttcttacatttggggcaggaaattggaagtccaaatatagtattttcaaatgacagaagagcatattttcttcaaaaatatagccagtatcaatttaaaactcaaatgtttaaattcccagatgacgaaattttgtatattttctcttattctgatttgctgacttattcttttacaatatttatactgacaaccaagccctcctccaagtatagccaggagaatttagtcttctgaccaaattcttgttcattgattgaaatttataaagttcataccttttgccaaaaaccaggctcattcttagaaacagaaagacttacaggacaataaacttgccagattatgtggcagattcaggaggaaactctcacaatgtcttttgtgatatgaatctgtatctgaagaagtattcatggacttccacgctatgcaagacattctgacaggtactatggaagttaacagaaaacaaagggcaaggcctctgccctcaaaagtccattatttagttggggagaaaagcctgaaactgaaacatcaagtcatgacataagaaaaatgcaggatgttaaggagtagttgccttataaggtataaaagtggtatgataatacttgccaggagttcatgtgaggggtcgacccttcggccaaaaaggataaggtggaccacaaaaaggacaaagcccttgacctactttttggaagaaatataatttggatacaatgttatgctcatgattcacattatgctatctcacatccagatttcagtgggctctgatatagcttggctgtgtccccacccaaatctcaccttgaattgtaataatccccacgtgtcaagggcagggccaggtggaaataattgaaccatgggtgcagtttcccctatactgttctcatggtggtgaataagtctcacaagatctgatgttttcataaataggagttcccctgcacaaactctcttgcctgccactgtgtaagacatgtctttttctttcttcaccttttgccatgattgtgaggcctccccagacatgtggaactgagtcattaaacctctttttctgcataaattactcagtctcgggtatgtccttattagcagtgtgaaaatgaaccaataaaggctctgtgtgtctttctcttttgaaagtatagaaaataattagagctaactttaattagtaacttactatattaggtattatcctaaacaatacaatgattatgaggttgatctgatataggcaccgttgtcatgatcattttcggatgagaaattgagatactgagagattatgcaattctccttgattcacacaggtcagaagggatgagcataatcaaacctaggcagcctaattacaagtgtacccactttatatgtactctccacttaaggcaacaaactgataagggaggtcagtatgttccaattagcatttaaaatcagcatctccctctaataaatgtctaaattatattaaatctgggagccttgtgaattgtagtggattcattgagcaaactaattaagcatggttcaccatttgctggattgattttatatcacagaaatcaacctttcaaataattatgaaacaccaaattgaatataaactaaaccaggtaataaaaacacactccgatgcttcacagtaaaattcaattattattgctttttgaaactaaaataaattgggcaaagtgtttttgtatttagtctataggaaaatttcttgtttattattcatttgtttatcttagctctgtagcttttatttatttatatgtgtcatttttttaaaaaaatattttttaccagtaaaggaagaatcattaattctaggaaattgctggaaagcaagctctttattgtattctgtactacctgattttatgacttcagatctctcctgaagcatttcgtgagttctaatataaattcaaattcaactgtgatgtattttagttctataatgaaaataaagatgagctgtctttcaatttctggagttaattatctttgttgagttcaggattatgaaaatatattgtagaatgtggagggacaagactgtgcacaagcgagggtatagctattggatagctccaacaaaacatctttcagtgagcagcaataattctccttgaaatcttcactggccctccactccgaagtaatctctcctttctctgaatgtggaaagcggtgcaggatgtatctctattagcattctatcactacttaggttatttgcttacctcttattcataatgaatgtaagcatgagtgcaggaaccttgtgcgtctattttctagaacaccattaggcctgatgtctagagcatcaggctacaaaaacattttggagtataatttatcagtgcccaccttgcatagaaaagttttgatttatcaacatagaagcagagctaagtaataaaactatcacctatgttcatgaggctcagctagtgtgatgaactctggtgatagtcattattcccctaattttcacaacctctaaggtagatacaatctccattttacagattaacaaacataagttattaattttattaattaaatttgttggttaaaactcaggctttatttaaaaaaatagtatcactatttgttgagagacacagttcccaagtcatcaattttactattctggattgcatgtctggcctttgaatttgttcagtaataattagtgttgaacctcaaagccaagctattaggctacctaaatctagcaaaaaccacctctttttaaaatataaatatatgcagaacacatttatttactttaagaggatcacaaagtctagtttcattgatacatctcatgtttctcagtattttttatttattccttaatttatggaggtaatttagaaaacttaaaaaatacatcattcaatggctttaatagattcacatagttgtacaaacattgccacattgtaattttagaacagtttttctttttttactgcaaaggaacttcatgcccattaatagtcactcttcatttactccacccacgtcccctagccctaggcaaccactaatctactttctgtctctattatgtatttgtggtctttttgactggctgttttcacttactataatcaaaaacttgtgaagtttatttaaaaacatgtatttctatacagacacacacattcattctaatgatattacccaaagaaaaccattgttgtttattgtttggccatttcatattgtggtccatttccatgtgttcaaaaataaggctgtatttgatataacagagtttttacttaattacactgaacttgagattattcaagctaatataaggcaatagtagcataggttatgatcaagtcacttacatttacctttgggatatactatgtgtagttttgacagcgtgtttgcttaaataattatgttcagctagagtaaagtcaaattatttttgaattcccctagcacatgtcaactaggactagatagagatggatgtaaagtgtcatgtcaagcagaagtcaccataagattaaagtcttattataaataatccacaatgtgaacaatccaactatagataaagaattttgactgcatgttgtataactgccttattagatgctgaaaaatgtggacattaatacttggatggaaattgttatcatgattaataacaatgagttgtggcaattttacaattaagagaatgttttggggatccatgttatataatgagggtctttgtggaactttgataaaattcattcttctagatggaattacaactgataatcataatatagctaacatgtattgagtaattacattcccaggcactgctgtaatggttttacatgcactcagtaatttaatcttcctcataacgctatgagactcagattaaagaaagtaaatttcctatagaccaccagcaagcattggtggatgtgcaaaatttcttaattccatactttcgttttcaatgtgtttttgacataggataattagattattaaaaattgttttctctagtgaagaaatgctactattcctagtaccaatagaaacccttgtttccctttgaaagaaatatggagcgcctgaggactagataaccaaggttgcctgaggaaaggatcacaataacagtaggcaattctgtcccaagaatgagtgcttcttaaaacataaaatagttttaaaaatttcttaagatagaaaatgtattctcagtcagattttttaattttgactttggttaatcctaaaatttccgggctaacaatggaaaaatgtttcttaaaattctagccaaatgttttcatttattcaacagagttagttagtttgaaattcttcttgaatgtctcagtattgctcaatcaaatggaatctaggttagactaacaaatattgttgacattgagtaagaatgccatagagtgcagagatgtggtaggagctcagattccactaatccacaatattatgagtcatttaacacaaattatcgtcatttcagcagaaagtgtttgtacttaattgaagtaagtggtcccattcaaaatctttctttattcagtctcttcaatcaccaaagcaaaacaggatatatgcatctttgaataaatatctgatttattgtgtatctgttaatttatatagaatatattaatgttaaatggcaaaaactgcaattacttttgcgtcaacctaataatagattgtttaataaataatagtgcacatatttgtgataactataaagacaaaatagctaaaactaaatcgatgatatttgacctatgtagctaaattaagcctgtgtctttcatgtttcatacataaattctgagagcacatatctagaatatgatatcataaacatcaaaaatttgaaaatcactttcgtgttagtctttagaaatagtgagaaactgtgttttagaaataattttgttaaattccattagtgcactgatataaagctaactgatagaattatttccaaatatttatgtttagtcaggatctgagctacaattcagtaatggaaaaggaatcgttggtaatatgaaaatatttatcagtgtgtatttcataatattacagtgcttttgacattgataaagtaccccttgctttactacatgttgcttatcactggtaagtagtgtgttaattagcattgcatatatatatatatacacacacattgcatatatatgtatatatacatcgtgcgtgtatgtgtgtctgtgtgtgtattgttaaagctttttttaaaaaaaaaaatttgtacagaagaagactcagacttggctcatactcctgggctcaaatgatattctcgctttggcccctcaaaatgttgggattacaggcatgagccactgtgcccagatcatcttaaagctttaaactaaataagtagcaatgataggataagctttagaaataaatctctgtagggagcattctcataatgtgttctgtcttgattaaccactaaagaattttcttaatgcatattttaagcaggaagagcagggacataggcactttatacaaaaataaattacatatatttagtacagatttttatgttgcaatcaaatcctagatagttacacagaagtaataagggtgcagttgtcagttaaaattgctagtttttttccttttatttttagttgacatgtaataattgtacatacacagttatattttaatatatgtgtatatgtgtaatgatcaaatcagagtaattacatagccatcaactcaaacatttatcatttctctgtgtgtgaacatttaaaatcctcttttctagcttttcaaaaatatacactaaattattgttaatcgtattcatgctgcagtgctacagaacacttgaatttattccttccatttagctgtaagtttgtattcattaattcacctctccctacccccactcctcccattcttcccagtctataataaccacaattctgctccctgcttccatgagctcaattttctttagctcccacataggagtgagaatttgtggtattatctttctgtgcctgacttatttcacttatataatgtcctccagcctcatccacattgctacaaataatgggatttcattttttcaggcagaatagtattctattgtgtatatgtaccacattctctttattcattcatctgctgattaacacttaggttgactccacatcttggctattgagaataatgctgcaattaaaaggggggtactgtttctcttttatatgctgatttccattcctttggataaatacccaatagtagtggagttactggactgtaggatagtcctacttttagtttttttttctcagaaacttccatactgttctccatagcagctgtactaatttacattcttgtcaacagtgtataagatttctcttttcgcttcacctttgctagcatttttttttttttgtctttctgataacagctatcctaactggggtgagatgatatctcattatggttttgatttgcattttcctgatgattagtgatgaacagcatttttccctatacttgttggccatttctttaaatagattaagaagacaaaattttaagaagatatttagagaaaatgtagaaatatagagtaaaatatttgactgtgggggacatgaataaacgtaaaatataaaaacatggtttatgaataacagataatgtaacacaatttggtgctcttttcagtaaaatatatgtctgtatccaatataatttaagtgtactatgatcctagtaaaaatatttaaagatcttatttatctcagttttctagctctctcaggaaaataatttttttttttatttttaattttaagttcaggggtgcaagttcaggtttgttacataggtaatcgtgtcatgggggtttgttgtacagattatctcatcacccaggtattaagcctagtacccactggttacttttcctgatcctctccctcctcccaccttccaccctctgaaaggccctagtgtgtgttgttttcctctatgtgtttatgtgttctcatcatttagcccccacttataagtgataacatgcaatatttggttttgctgttcctgtgttagttggctaagataatgacctccagctctatctatgtccctgcaaaggaaatgatctcagtcttttttatggctgcatagtattccatggtgtaagtgtaacacaatttttttaatccagtctatcgttgatgggaatttgggttgattccatgtctttgttactgtgaatagtgttgcaatgaacatatgcgtggatgtgtctttataatagaatgatttatattcctttgcacatgtgccaagtaatgggattgctgggtcaaatggtatttctgtttttaagggtgtaaattaattcagccattgtggaagacagtgtggtgattcctcaaagacctaaggagaaataatattcaatttcttggaaagagggagacactctgctcttcccatctatattttcccaccttgatgtttaaatagaagagggataatgaaattatataaggaagcaggtgagtttggatcccatactctcataagaacagagaaatagttacaataggtggcatttatggaatggtatctatataaacatagtatgctctttgttttacatgccttaactcataagtcagtattgctaaagagaattcagtttcatagctgttgtgtaaatgagaaaatactattctacctctattatttattaattcataaaggggaagcaattagtttatatgccagtgaattaggtttcgactggaacaagtgtaggaagattaagagcaccagaacctgaaaactaaaatggaagtagccataccaatgtgagatgtgaaagtggagataatttattttataaggtaaactgtgataattagttacttctttatatttagcaaatattaaatgatacttattagtaattatttagaatactaaatcttatttttaaatgactgggaattgtaatacaccttctagacactttgcttttatcatgtgttgattaatgggatcttattaaactaaagagcttctgcacagcaaaagaaactatcatcagagtgaacaggcaacctacagaatgggagaaaatttttgcaatctatctatctgacaaaaggcaaaatccaaaatctacaaaacttaaacaaatttaccagaaagatacaaacaaccccatcaaaaaataggcaaaggctatgaacgacacttttcaaaagaagacatttatgcaaccaacagacataggaaaaaatgctcatcatcactggtcattggagaaatgcaaatcaaaaccacaataagataccatctcacgccagttagaatggcgatcattaagaagtcaggaaacaacagatgctggagaggttgtggaaaaataggaacgcttttacactgttggtgggagtgtaaattagttcaaccattgtggaagacagtgtggcaattcctcaaggatctagaactagaaataccatttgacccagcaatcccattactaggcatatacccaaaggattataaatcattctacgataaagacacatgtacatgtatctttattgtggcactgttcacaatagcaaagacttggaatcaacccaaatgtccatcaatgatagactggattaagaaaagatggcacatatacaccatggaatactttgcagccataaaaaaggatgagttaatgtccattgcagggacatggatgaagctggaaaccatcattctcagcaaactatcacaagatcagaaaaccatctgcatgttctcactcataggtgggaggtgaacaatgagaacacatggacacaggaagggaaacatcacacaccagaacgtgtcgcgggggtaggggggtaggggaggaataacattaggagaaatacctaatgcaggtgatgggttgatgggttcagcaaaccaccagggcacgtgtacatctatgtaacaaaactgcacgttctgcacatgtaacccagaactgaaagtataattaaacaaacaaaacaaacaacaaaaaaagtgttgattaacaggccgggagcggcggctcacgcctgtaatcccagcactttgggaggccgaggcgggcggatcacaaggtcaggagatctacaccatcctggctaacacggtgaaaccccgtctctactaaaaatacaaaaaattagccgggcatggtggcaggtgcctgcagtcccagctcctagggaggctgaggcaggagaatggcgtgaacccggggtgtggagcttgcagtgagcagagatcgcaccactgcactccagcctgggcgacagagtgagattccgcctcaaaaaaaaaaaaaaaaaaaaaggtgttgattaacatctagcttattatttatatatgtgcatatatataatatgttgagcaagtagaataaaacatttctgtaagacgtgaaactgattttatattaatacttttttttctttaaaactgtttttcaaaactctgttataatgggatacttctagtaggcaatcttcaattccttaagatacttggttagaccattgtcatcatggatggaacaggcttgaagagagagttgcaatttgccttcctaacctataatggccacaacattagtatcattacttatatgtatcagtacttatcaatgaaaaatacatctatgtcatttattgtatcatatgatgtataccacatcagaatcattacttgaattaaactagtggtgattcaaccttctctgtcacctcactttttctttttatcgtgagaaatttccatgaacttattttgcaaattaagtgctttttacaatcaatgattagactattattagtaacaacttgcttgtcataagttttacaacttatcatagcacagcagcatatcaagaaatttgagcactgcaactctaggttacaaattattatcaacaaatgtagataatgtcaagagaatacgaatttaatatttaacaatgaaacatggagtgttttgatagcaaagaaactaacattctcttctgctcctaaggtgtaggcagtctacttacaagcagagaagaagcaaatttacatgactatatgtgtatatacacagacacatatacatatatgatatttgtgtctttgttgtactcattgaactgcatacaagtgctttttcttaagccaagttttcattaattaatatactagattaaattagtgaacattaccatatataagcagagaatatccagttttcaattacttgtttttattcttctactcaatcatagactgttgattatttagaagacactataaatatttcaccttggtcataataaataatgatctggtcaagtaaaaataaaaattaactgatagctaatcttgttatagtaataaacaatggacatagataaaatacatatgtgaaaaaatgaataaacaaatgatgcagtgtgtagaaatacccactacaaatttaaatcattttcgtagtgaatatatgatatatatctcatgcatgtctgttgtacctatcaattcatgaatagtgagatacagagacagatacacatgtacatttatgcagttgtagcaattgaacctgtgctgtgtgtgttctataacaatattatattaagtgaatatagtcaactcttgattttatatatatatacccttttatgatcaattttaattttaattctgggatattttgccctaagtatataatacatttctggcacactattcccacttcccaacttgcctattgtcagtcagagactacaaggcaatttagtatcaccaaagcaaaacaagattacaaaaatgaaaaatctgccatttggtattatctctatacttctccctatattagcagagaaaattgacttgatgtctattgctgactcttccagaattgtggcttcagcatagctgagtgatttcatggatatattagccagttggcttgaatattttacagcaaataagcaaaaactctcagtattagctttttcattattcattatctttatgaaatcatacactcttacattaaagtaggaacccatgttacgacacttactttactcatgaagaaactgagactcacagattagcatccatgactgactaaagtacaatttataatagcagatctgagagtagaactcatttttttcatctctatgcaattcattcaacaatcaatcagtaaatatttatagaaagtaatatgtattgggctctgggaaactcatctattattacaagaatcagaaagctaaaatgtaagcaaatatatttggaagataattacgtattaaaatatgtactatgcaggaagctaacaaggtaatttgtaaaaagtgcgattaacaggagaagttgtggtgatgcagacctactgaataatgggagacattttccctaaggagatgacatttgatgggagaaccgaaaagcaaaaagtagtcaaccacaaaaatttctgggagaggtacattctacatcaaaggaacaggaaatacaagggttcaaggttaagaaagaacatggggacttcaagaaacagaagagaaattaatataactggcatattgtgatgggggcatagtagaagatgaaaatggagaagcaggcatgagccagatctttgaagcccttcatgccctggtaaaaaatatagattttattcagtgtgaaatgggaatcctctaaagatctttaagcatacattatctgatttgaattttatagagaatgttctgactacaatttgaagaatcaattgtaggaagcaggagtgaaaaccattgctgtaatgtggatgtgaaattaagacttggactatggggttgacaatagagttggagagaagtcaagatatatgtttggatttaaaatcaataggatttcctggtcaggtggatatggagagcaagataaaaggaaatcaagggtgatttccatatttctagtctgagcaattagatagctacaatgtcagttattgagaaggaaaagactaggagaaaaacagaaatgggagagttattgatacagaattattttcacagtatgtgaagatgctaggtcaagagaaaatgtcaagtagtcagctggaagctcagagacagggaaatcttgcacaagttatacatttggtagtattgctagacaaagtcctcattaagatcaccaagggatagtctatataagtaagagaaggtgattcacgaccaatccataggtattttgtaattaaagaattagagtgtgcctatggaaagggcacacatgaaaggaaaataagaaaggatagccaaaggtgttggaggaaaccaagacgcactgaatgtttctcttcattccttttccctttattgtcctagaacaattattaaataattactgaaacatttttccacagtttgatttcagtaattattaaataattactgaaacatttttccacagtttgatttctaactctcattcctttattcctgtttattctctttaagaacctctataagaggaagttcattattcttgtccattattgtagtctcaccttcagtgcagtatctggaacatagcagacactcaagaactatttggtcaagaaacttatttccatttttgctgctgttgtttttattcctactttgtttcttttctcaggttatcctgtttcaagacctctaatggtctgatctaggtctcaggggtcccctctggcttgttttctttccctagcaggtataaaacaaattatggatgttgttagttaagagctacacttaaacagattaaaaatgaaggagaaatttagaaaagagcacaattcatgatttcactagtaaaatattattttgtttctttctaaattatgtaaattatatctaaggctgtgtacagttgctcatgcctgtaatcctggcactttgggaggccgagataggagaatcacctggggcccgagaccagttgggctgcaacatagtgagaccctgtctctacaaataaaaaattagccagacatggtggtgcatacctatagtcccagctacttgggaggctgaggtgggaggatcacttgagctcaggagtttgaggctgaagacctatgattgcacccctgcactccagccctggtggctgagagagaccttgtctctaaaaaataaaaataaaaatgaaaataaaaataaattatactcgtgctgtccgacattataaccactaggcatatgtagctattggtcacttgatatgtggctagtacaaattgtgatgggtcattgtacaaaatattccagatttgaaggcattactaacaaaaaaacctaaaatatgtcattattaattgaatattatatgctgaaaaggtaatattctggatacatttaacaattactaaaattaattgcaacttctaaaatttgtttaatgtggatactagatatttaaaatcaaatatgtagctccctttataatttattataattataataaacagtatttggatagtactgttctatacttttgatacacagagcaaggaccttagatgatttaggtacgactcagtgtattggtaggcatgtaaaatctcaggtcgtttttcaggcctatgaataaaattctgtgttttaagaagatccccacataatttgaatgcatgctgaagtttgcaaaatgctgctgtatatattgttgctgtctccaaagagcaaggtgtgattttgccttcgaacaatgacatatccaacctcatttccgatgtaattcagactaaaatctaaaaactgcaaatcctacagtgatgcacagaaaggttaatatcaagtgtgaacccagcttacaagccatagttctgcattttcaactacaagggttcatgtgccatactttggaattagtgcaagcaaaagccagctcacattgcttgtgcattttgttacctagagagatttgcatttagcaaatttagctcagctggcacttataaaaaagccattgccagaatgcctgagaaatttagtctcttgtatggtacttagagtggtcagcaggaatgttagcagacaacatctcatttttgcaattaatctgctttatcactacagtgtaatttaaaagaattttgtctagcaggagtctttttatttgctgggttgtgattttttccaggttatatgttattcccatgctaatatttgccttaataataatgtgtggactttaatataaatatgattttgcagcagcatattaattacaaatatgttgcaataacttcaagaacccaatttttgactattttatctttacatttgatttattagttttgtagattcttgatttgtttagatagggttgggagagtagagttcctttttaaaaatattaagtctatgtaaacatagtcatgccatctacttatttgcacttgaggttcagaaaaaaaatgttatgagaatttaaaattttgacttaattaatttatttgtataatattttaccttaaaaataattgaagataattgtgatatatcatatagatcacatttcaccatttaatatgattcagtacttaggcaatggaagcagaatttagaaacctctctttattggaattgaattatattaaaagaaatgaaaaataagttattaacacatttcctagaatatgcatcccttatatatttgttgttatgtagtagaggctgtcatttatcaattaccctctgtagtagacagaactaggttttaggagtcataatttttatcatttgttttgtttttcacaatacaaatgtgcaaatgtcaaactcctagaaaaatacattattcttcatatatattatatcaatgatataaaaactgagaattattagacctatgtgcaatgtagaaaagcattgaaactcatttcaaacatagcataaatgtattcaaagcattattgaggaagaatgaataatatgggtttgaaaatgtggcaaattatcccaaaaatatgtagctacttacccagctggcatcatggccacacaaacaaaacactgttcccacattgtttcacttactttccatggcaagtctcaagggcagtcatatcttcattcttatattaaagctgaatttcagaaaagccaagcaaattacccaagggcaaataggtaactgaaataaaaaatataattcatttctgtctcatttcaatgttgataatttgctcattacccatgcctcaataccagtcaaaactcaatatttctgtatctttggtgtcattttaaaatacttccagtatgtatgtataatttagtaggaaagtttgctgaattatacctatatatatgtgtgtgtgtgcatacgtcttaagatattgacagtcccaatagaataataattatttagttcatttttcataaaacattaaaatcactgccaaagtcactgatgtaaacactttgtgacataataaccactctgttccttagatgtagcagttaatgcgtgcgtattattgatcattatctagttgtaacagtaaaagtaattgtacacttgagtaattcttgtaattattattagatgtattccatgtctacacttgtaaatgtggaaagcatcaatagttcaaaagttttaatcaagggcagagagattatatctgcggctaaccctcatttccaaggcctccatctctttatattgtatctttatggattaaaagttaatgcagtttctcagtgcctgcatcaccaacaaatcacatacagtgagttgaagctggatttgtgggaacaattactgttggttgtatttattatataaatacatttgatgattcccaacagttctggagagacatggtcttaataattcaggaaaatattgggaatgcattctctaaaaacacagctaatcaatacaatatagagactaataacaaaatgaataactttttaaaaattatttccattttaattctttgttaaactgggaaaacgcacatctatgcagatcaacaactgtaaatgattttaaattgtgcaatgtggaagtgaacgttgctgagtttgcccaggacaaactgtgctgacatatgggaaatttagtttatttcagtttttacagaaaagtatcttcacagtctaaagtactggtaaaaaaaaaaaaaaaaaaaaaaagaaaaagaaaaaagaaaaaggtgactcaggaatcaacacctatatgtgataagtaggagtctcatttttactcccctactcaactttctctctgttagatgtgataatgaactgtgaaatggtcaaaatgagaggaagaaaaaaggatgcggctaatttccaaactagatagtgtcaaattcagagttgtctacagtaacattagctcttgatatttgtgataaacatgtgatgttgcaaagtatataatattaccagttgaatagatgtagttatatgaatattacatgtaaatttcttttaatcattttagatttaaaaagttgaggtacgttcagattaatttatgaaaatgtcattttagcaatgacatattatttgagtgattaaaaattactcaaattcaattgaataacctacataagttctaaaatcatcagaataattcttcacacttcccattttatcagtttacacacctgatttggtcccaaattctgattcttctgctctgccctttcatcctcaccatcaatgccttagttcattttctcatcatctttcaccaggatttttgcaatagtcttctgcctcctctcaaacattctttactcatttgattccccacattgcctccatggacattcagattccacttattgtaaagtctgctttttcatagttctttggctaaggtgttgtgtagggtaataaagagagaaataaaataataatagatgttaagcagagccatgtattaaaagttgcagattattttaagaaataatttctacttttttaatttaacaaacactcattaagactcattaaccgttctcattaacctttagaggatacataaattatactatatatcctattctgaagacctccaagtagagaggaagcatgtattattgccaatgccaaaaaatagaaactatgtatcaaactgggtcagctctgattataggaagccaagtatctaccgtcaatcagagataggaaggaaaatctccctcatgtgaaaactaatggtggttttaggaatattcctatctgggagtggatggagaagagtgtatcaattaaataaagtgatttggcacacaaaatacaacaatattgatatataacagaatacaagaggatgggtaattaatcatgaacagaaatttatttcctacgtttgctcttggaaaatccaagagcaagttcccagcacctggagaggaactttttactgtgtcattacatggctgaaggtgaaagggcatgcaggagtcagttccatttttaagtgcctttttaaggttacctaagcccattcacaagaaaggaaccctcatgatctattcagctcttaatggccccacctcttaatgtcatcacattagcaatacctgaattttggtgaggacatattcaaaccacagcagtaatctcatgatgcatttacatcatttgacatatctcatttttttgtcttcaaattatcaaatattcttttataaacatatagtatatgattatgaaattttcataatttctaattcattttagtctcataagcaagaaggaataattcattattataatttcttatatatttcagttagaaccctttaagatggaaaacacctatagttagtgcctacatagataaattaagtagaaataagtcaagttttacagatttgccttatttgcctcctcttctaactccaactgtccaattagtctctactataagggcacactgaaataaaggtaggaaggctttactgtcagaactctgtatatgtttattttatgtcaatgctaagggggttcttttaggtctagtgaactaatagaaaacaaaactaaacttgaagaaagaagcaatagcctgtaataggacagagactgggattttgtgccgataactcaacatgtaactttggacagggtacataacctctttggccctcagtgtttttgattgataaaataagaaacttcaatttgatcatctgtgatgtttcttctaattcaaataaagtacagctataaatatttttcataatgaaccaaaattgactttcacaattagccagtttacatgatatataaaaacattgtcatccttctatttttctcatatgtacttgtctcttttttctaaattactggaaactcatactattcctctactacatttttcctctgccaccatagagttacatcagtctttgaacagaaacagaaagtgcagaaagcctgtcactaacgtgacctcctcacagattttgaattattacctcaagaagagggaaagttggaacagcttatatcattgcagaaagatattttacctgtctacatacaatttttctgtgatatagcttgtttactctttgttagagaaagactggcttgtatctttgtgtcttggacacagtacagttgctccatcatttgcagtacagctaatactcatttgggtaccatgcatggatacatctattatctcactttgttttcaccataaacctccgaggtagagatgaccattttcctcatttcgagtaaggaatccatggccaagagaagtgaatagcctactgattccattagctaaactaaagactatttgaatttcaccagatgtccttttctgttctagaatctgacattgcacattgtgtttggtctctggagtctcctccaatattcaacttctttttttttttttcccagtcttgacaattttaatgagtagtagtcagctagcttctttgttgagtctttttcaatattagctttaaaattaaatttggattatacagtatgggcaataaaatatcatagaaatgatattttttctctcactgcttcttggtaggactacataatattaacaagtcttattactgattgtattaaccttgactaactacgtttaacagtttttctttactgtaacactgtgattctcctctttgtattggaaaaacatatgagggggaagtttttgagactgtaacaacagcctgataccttgtttctcctcaaatgtttgctcactgatttcagcatccaatgatagtctcatctgcaacaattattaccgtggtttttgccaaatgatattttatttttataatttcttatatatttaatccaaaataagggtaattttttttttttttttgagacggagtctcgctctgtctcccaggctggactgcagtggcgcgatctcagctcactgcaagctccgcctcccgggttcccgccattcttctgcctcagcctcagctgaggactggcctcagctgcgactacaggcgcccgccaccatgccgggctaaatttttttgtattttttagtagagacggggtttcaccgtgttagccaggatggtctcgatctcctgacgtcgtgatctgcccgcctcagccttccaaagtgctgggattacaggcgtaagccaccgcgtccggccggtaaaaatattttttatatggtctcctttatctctagtcaacgttcttctctcccctcttctctcctgaaagcatgacaaaaaaatgatttactgcatgatttttatttccagaatgaatgaaggtaacatttttgatgactttgtcctttaaaggggttaagatattacactcttttcaatacccaaaggcgaactgtaacattcccacaaatttgagaaatattccgcttatgattgagtcagatgttgtcactcagccacaagttatcttccagagtttgaacttcctattgaagttatacatcaattatagaagctgactgaaatattgccatagattatatatgtgataggttctacatctgaggaggaaagcatctataatacattttcattaaagcagctctcaattcaccgtctgcttaattcctacattctcatgcatataacttatgagcagttttcaaaaaatgaaagaaaattgaaaatgtagcacagccaaggcatgcattggtggaacaggtaaaattgatttttatatttgcttggggacatggatcacttccctgaatctggtttgcattgatcagtgttgatggactatagattaaatgtcatacataagcccccattttcaaattcattatcctcaagggaaaagtatctgaagaaggatggactatatttataatccatgccaatatcaagatgaaatttgatacatctgaaagtgagaaactctaggaagaatactatttgtattaataagaggtaaaatattttcaataaagagtctattttttgattaaatcagccaataagtcaagaaaaagtgaaaaatatatgtgttgagggtctactttatacctctctgcacaatgagatatagggtttaaccacagaaattctttctatttaaatgttggtcatggtaggcacaggaaaacaaggaaagtggcaaatactgaaagtcagggttacttcctcccaaccctagaaaactactttggtagcacaccactggcgaatagtgtagcaatgttaactttctggtttccatgattgtgctaaggttgtgtaatttattaatataaaggaatgctgcctagggggtatatatgaactgtgcactgtatttgcaactttcctgtaagtctaaaattatttcaaaatacagacttttttaaaaagctgtaacagaacaggactaaatattataaatactgtataacaataaaataatttatatttttaagttcttatgttctgaagataacgtaaagataaataaagtccttgtcctcaaagattcattgcttaacatagttgagagctcttagaaaatgtggacagcttggtgagttgacagaaactgagtggtatagggtctttccttccttctttttgtcccccaaaagcctcaaacctgaaatattccaggagttaatagaaaaataatgtatacccttgaacaaagttttatgtgtgaaatttcagagtagattcttaacaaaggatggaaactgtgcaaatattattgtgtctatttataactgatttacattaattttcatttatcaagtactgattttttgccagctctcctggttcagaaaggaaattactgttatactaaacttacgagtaagaaatcagaatctctaaaatacggtgactgataaaatttttttttagtaatgggaaatggaactaagatttgaacttcctcaccattaaagaaggtacaggcaatgttgatagccacagcacaagacagaagggtaactcttcatgtaatggcttcactgagaaattgtagtgcagcctaaatggtgtacactcagtgaaattgccagaacagtgaggttcctttgtttcaacaactattatttataatgttgtgggggtgggaggaggggagagggatagcattagggagatatacctaatgttaaatgatgagttaatgggtgcagcacaccaacatggcacatgtatatatatgtaacaaacctgcacgttgtgcacatgtaccctaaaacttaaagtataattaaaaaaaaataaaaataagaaataaataaatgaaaagaaaaaataaatcctattgatgctagaaaaagtaattatagttttttcttctaatgagatgatatggtttttgaaatattttattgaatgaatttagacttagagattgtcatttttttcagaatattaaaacaaaaaatatatacttgtagaacttggcaaatgccaactctctctaattataactgttaaaatacaaatactatatggtaccgagaatgggagtaataaggcaatatttaattagatatctgctaatatcacatagatgttatgttttgtgcttcctcatgagatgtttgagggatttcagtgatatgacattttttcttcagtgcatattgtgttacagacttaaaatttacattaattgatcaattcaattatttatttattcaattcatttattcaataactattcatattggttatctatggctgtgtcacacattattccaaaattcagcaacttaaaaccacaaacatattaccttatagtttttttgagttaaaaatccaggaatggctcagctgggtgcttctggctcagggttcattacagaagctataatccagatatcagtaagggcttcagccatctcaaggctcaactggggaagcatcaactcttaagctcaaacaggtggtaggcagggttttgctcttcaaggactgttgtactaaggcttcagttccttgctgcttggtggctgaaaaccagtgtgaatcgctctctaaggcagttcactacatagcaactgatttccttgagtgtgggcaagtcagacagcaagaaaaaggaagcaagacaaaagccagactcttcttgtaatctaatcttggaagtggcatcccttatttctgctatattttatccattagaaacaggtcactagatccagatctcacttgaagagagaggattgcacaaccatgaatcagagatcattggggacaatcctacaggctgcttatcatggtatttattacattttaactggattacccaatttatagacacgaaaaagattgatcatggttttatggaatggcttaacttatggtccctatcctagaagtaattaaaatccctggaagaatatagaaaaataaatggataaattctaacaataatatgataaatagcataattgtggaataaacaaactgacaaaggaaaacatgtggtgtgttattcactctatttgggaactgtaaggtctaaagagaaaatggcataactgatacatgaagagaaacagcctcataattagtatcaaggtattctgtgtttcctataatattttaggtcaacttcaatttctaaacatataaacaatgatctttaagtatatataaaaatccctggccaggtgcagtggctcaagcctgtaatcccaggcatgggaagccgaagcgggcagatcacgaggtccggagatggagaccatcctgactaacacggtgaaaccccatctctactaaaaatacaaaaaattagccgggtgtggtggcacacgcctgtagtcccagctactcgggaggctgaggcagaagaatggcgtgaacccgggaggcggaggttgcagtgagccaagaccatgccactgcactccagcctgggtgacagagcgagactccatctcaaaaaaaaaaaaaaaaaaaaaaaaaataataataataatcccatagctattttatatgtgtgtgcatgtttatgtgtgtgtatatatgtatatgtacacatatgtatgtatatgtaaacatgcaaaatattccacaaaatagaatgagagggacatgaagttaatgcagcttttatgaaggaggtggtgactccttcaccgagatggcttatcatataagttagattttctcaaggtttgcatcccaataaaaaaaaggtacgataggttttaagctgtataagtgaatgtataactagtatttgatgtcattttactaattatcaacacagctgctctggtctgaaatttttaatgtcatgacagagctaattttaataaaaggtaacattttatgaccccaaataaattacacaccaatatatgcatctgctgcactaaagtaccataatattaacctgttaacaattgagccaaaatctttcacacaattcatcataatttatctgggtgacatatgactttcagatgctacatctctttactgaatgttttgaaaattgagctaagacaaaaacatccgtttatatgaaagaaagaaaaaacatacagaaatattgtaagattctaagaacatttatttaaaatgttcactttattaagaactaggcatcaggaattgaaagaaaaacctagatgggaggaatttactgaaatctccgtgttaaaaaagagagcatagcacttgtctggctttggaaaatactttcacagtaatcaaacaaaataaagacatttgatagcaaacacttggaagtggaaataggctaagttctttaattttttatgtaaccttctttatgttggtgtatagcaaaaatacatgggtccaaaatagagtggcattcatcttaacattttctgtgtgtgtgtgtgtgtgtgtgtgtgtgtgtgtgtgtgtgtgtgtgtgtgtgatatatgtatatatatatgtacgtagatatgtgtgtgtatatatatatatatatatgtgtgtgtgtgtgtgtgtgtgtataattttttttgagatagagtcttgatctgtcacccaggttggctcactgccacctgggttcaagtgattctcctgggttcaagagattctcctgtcagcctcctgagtagctgggattacaggtgcacgccaccacatcctactaatttttgtatttttagtagagacggtgcggggattcatcacgttagccaggctggtgttgaactcctgactacaggtgatctacccgcctcagcttcccaaagtgctgggatgacaggggtgagccaccacacccatcacattttctggccatttttaatgtgttagtaaatgctacgtatatttacattgcaaatattataccctgtatcatgataatttgaaatgactgaagaaaaaaaaatgaagtccaatactttcacagacacagagacctaaatgaaagaacaaaagatgacagccctagaaacggatttgatggtgactactgaaaatatacaaacacaatttccattgccctctagaaaagtaaaaacataagcatgatagctctaaaaaagacaagtctgaatgtactttagttcaaattattctagcacacatattgtagtattgttactaaagaatactataacaaaattactattatgaaaagtgggcaataatgatgataatggtagccatcttgaatgtcagctcaatatgccaagaattacactaaactctttatatattttctgcattacggacaatgactctgtgaatagggtattattgtttcattattttttatgaatttaaattacctgagatttatgaatattaagcattaacccaagtcacacagagaattggtgtgaaaccctgactttgtttaaattttaaagctcagaatcttgcagggctgtaataatcatggtttgcaatactcttgaagattcaataaaagggatttataaaggacatatacagactatcaggacactcttggcaaaacataaaagtaggccaaaaaaattactgtagtctttgtttttgaatctcagagtaaagcatagtaagctatcaaactgacgataagtgtgaaatcatgaattggaataaatgtggtgtaaatgagatatcattatctgacgaagtccacaccatagaaattaataaaccatctccgtgcaaataattaatgctgtttaaccacccaaagggtaaatagaatgtgaatcgaatgtctcaagttggttttatttataagcagtaaacaaagttaaagaatgttgctaagtataggataggcaacaattaaaaagcaaggaaaatgcttttctgagatctgctacacatttgtagatctgagtttcttaaaaaggattttatcgcttgccaaacgttgtagaaaattaatgaataaaaactaaatttaaaacaactaaaaagtatcaggagactgacagctgcacctgcgagtaatttaggcctgagtacaaatacacaaaagttaggaattaaatccaaatgacattttgaaatttactcttaaaccaaaacaaacaaacaaaacacattaccacattacaggatacataggagtgatatttttgaagtttttttaaatacaaaaatgtattttccaatactttatatcaacgtatgtgaggggaataagaggtacattggcaaaggtaaattgcactgtctcgtagccctgcacctttgtaacatttcaggaaagtcagtggggatacccagtaacgatgactccttttctgtacaaagttgcatcaggtagaagaaggcaaacccagtttaaagaactgggttgcctgtaagaccatgtatctttacattttcactatttatctcagaggatgagccattctcataaggtaaatacgggacttttccaaaccacttttatgagtgggtcaaaggttaaccacaaaatttaggtcagaggggggcattatagtgatgtctctgagaatggatgataaatattgtttcatggcaacttcagatttatttaccacaactcctcatcatttctaggtgcacaaataatgcaacaattctatgacccctggagcctcaaatgtgttgaattattttatataatagctaggcactgatagtatagttttgtagttttaaagtattatctggagttattttatttggggtattatctttataaaatgcaatgtatcttttccattttcctttatcttcagtattatattttgcaatttcatattgtgacttctatataataaggaataattagtgcacattagtgaaactcatctttatttgtgagaatttccatttaagcttggatcaaacatgctggcacatgactgcctttgattttacctgtaaaacaatagatttttgtagtccagtgagcaataaatgcttcctgcctctcctctatatttaccagtagataataatgaaatgtcacagacttgaacattattaaacttatatttgagatgcctttcagaatttttcacgtttcctgctgctgtctgccttttctcctctttgttgtgtctcataaatttttatgacctctttgcgttggaaatctgtaatttttcccagagctctgctaggtaccttctagcagtaataaaactcttgtcactttccattgcagctactttcagagtgaggcttactggcttcactctgcagcatattagataaaataatcaatatgctcaggttgaaaaattaaatgcagcatttgtgtatccatcgaattacagtgctttgagcttggaacagatggccttgcgagacatttgctagcttacttgagagtggctatttttttttcttctttttgtttgtacttgattttgcatttacaataataataataaaagaattgcccaagatgattggtataaaattcatttggctattcttgaaaaacaaagcattgtaagtaccaaaaataatagtagcattaaaaaaaaaaaacaaaaaactttctgttgaatgcagttactttctgagtaaatttacagtattctcttcccttacatttgtgaactttatgtgtgcttgtccctacttacctcacctctgtttcttacccaatgtgaacttatgtgtggatgtaatatttctattataaaactattaaataatagggaatacaaaatttttcaatattgtggagttatgcctatatttctttttacccaaaataaattaatgttaaaattaatctccatctcttctcccatatttctctttcaatctagtcatgatactgtgttctttacataggcaatttggagaggatggttaggtgtttaagaaaatgactgacccattgtttccacatagatctcaggtcactgattattctgtgaaatttggacaacctcaaagactacagagcattgaattaacttacttgttcaacactatttgttaagtatctattatgagtcaggtagacatttgttggagggtcctagatataaagcagtttataagacttgtgatcttaagagtgtggctataatttaaatatgatataagtcacatttatgttttcttgtatccttgttcccaggattgtttcagtaaagatctttaaattataaacattactgaatagaactgatttgtttttccagtcagcatatcatttcaggggccagtagaagcaaacccctgttctgttcctcatcttttatccagtgtctgaggatacaatgagattgtctttgaaggttgcaggtgtttgaagatatgtcctttgcagtttgaaggacatggaaaccaatccagaattgcatttaaataaggaaattagaatagatgcagaaatggaggaaggaaaaaagcaaactgaaacatagcaatgaggcccaaaagatgtagggctacataaatagatttaaaaccttatattccaatttgtttgttttataaactcagtgatcttaatattagacaacaaatccttagaatcatgtaacatgtttcgcactttaagttattgtttttgtttgtttgtttgtttgtttgttttgagacggagttttgctcttgttacccaggctggagtgcaacggcgggatcttggctcactgcaacctctgcctcctgggttcaggtgattctcctacctcagcctcccaagtaggggaatttttttgtatttttagtagtgatgggatttcaccatgttggccaggctgctcttgaactgctggtctcaagtgatctgcctgcctcggcctcccaaagtgctgagattacaggcatgagccaccatgcccaccctatcattgttcttaattcttatattttacaagaaaagctggctctcaattgatgttcaacacatgcaacatatagaactgggaccccaaattgatcaataactcaagttgatgaaaggccatgttttaaaggcaaacaccacacagtctttcacattggtgccaacgaaggcattttggtatattccctggatgcaaccaaatcctgtggtgagaacctggtgaatgagaacctatgctacagtgtatgttggagccagctcacacaggcatatttcccaactctgtttggtgacttcacatcgatagccagccacagtgggagtatttacactacagaaatcaataaattctgcaaacatgtattttttttttctaagaaagctggttgttaaacagccaacacacaactgtccttggaggaataaaaggtttgcctttgcctttctcacaagttctatttcagaattgcagccaaagcatatcatctcagcccttagctctagagacctccctcctctagtgggcagagacatttcttccttctcagtgtatacaaattttatgcttatcagtagaggtgagattattggctcacttttcctcacaagtggatacatctctcttctttattctctctctccctcctctaattctctcctttcatatgtgtcattaaaaatgtgtttgtgcatttgagtggcattgtgggaagatggagtgaggagggagaaaactcaaattatattgcacattggccactggcacacactgtgttagatgctttatatattctctttttaattatttttactatttgaaacccaaaaggatcataccattgtgagaagagctagttttctagaaaaagagatatggaattttaatatatcttgaaaagctaaagaggtgattttaactgaagtgaagtaataaggtagggccttgtataagtaagagtttcacaataccaaaatttatattgtaataataacattgtaatagtaaaaatgtaatagtattaatgtattcagttttttattctctgaactatatatggcattactttgatatcatttcatgtcatctggaaatgactactattgctacagtatgccaaaatatctgggcacaataaacaattatagcattttctctatcttttagacttctcagataatgctacaatatgttaaagtatctgggcttgattaaaaatgcaagcatttctcctatctttttgatttcttggttttggaagacttgatattctactgatcattgctattccatactgtaatgacacctgtcatgattttaaacagtttttttttttctattctaaacatggtaacatagagttatgtcattaaaacattaatcttggccaggcacagtggctcatgcctgtaatcccagcactttgggaggctgaagtgggtggatcacctgaggtcaggagtttgaaatcagcctggccaatgtggtgaaaccctgtctctactagaaatacaaaaattagccaggcatggtagcaggagcctataatcccagcaacttgggaggctgaggcaggggaatggcttgaacctgggaagcagaggttgcagtgagccaagattatgccactgcactacagcctcgttgacagaacaagactctctctctttctaaaaaaaaaaataaaaaaaataaaaaataataatcttatttcgatgtttgctactaaaaggtttttaattatttatttttatcatatcatattatacatatgtttgcccaagcactcacgtgtgtgtatatgcatgtatgtttctttaactcatggctgaaacagtaacacagaagacataaacctcaaatctgtgtctgggtctgtaacatggggaaacaggtcaaccttaacactacagtgtacatttgcattgcattgtacattactgatgtcttcaggagattgatgtgctgaaaatcctcattctacatgttggagatggggaatgagaagtcaggagccggaaaattctaaactcttttagatcactcagattccatctagtaaattacctttctctgagatattttcaaggtctgaaatgatagtgtacttacaagaggtcattatgacttctggcacccgttggagcaggcctaatgtcttgtagcaaatataagagtctaaatgcattgctataagtgtcaggctggcagcaaatgcattatgcttctccagttgaccctttctgctcctgtctctcacactcttaccagatagacagttagcaagcagcctgtcctatccagaggattatctcataacaaatatggctatttaaaagtgaaccatgttgctaaaactctgaaagccttgaaagaggtttatccatcatacgttaggtaccaactgctgtcttgatgattatcaaaaagcatcatcatgtttgacatcttatatctttaaaataatatttctatattcacttcaggtgttttgcctattaataattgagatgtagtaggtgatacagtaggagttatgtggcaacatttaggcttaacactaccacaacaaaatcattatgtgtcaaggctgtgaaagagctagtgtgttaggaagcattatccttgagtgaaaggagttcatgtctactcataatgtgtgagctgaaagtttgatatagtcagaagagtaagatacaggaacccaaggaacctgagctctgatcctaagactctctctaagtctgtgtaaccctatgtgataaaataacttggagtgggagagggttcctcataagatcagagaccctagtgcagcagtccttggagatataaattattaactcatgaaaagcaaggagacacacattattttgttttgatagtgttagaaagaaacagtttcttggaagaaattgttatagcacatccttaacctcaggtagctgagggaagttgaagaggatatggattgtgtctctgctgactgaaatgaaggcagtggtctggcctcacagcagtgaaggcctaatggttttaggaaacactgagaaaataattttatcgctctgattctcagtttcttcttttataaaataatggttttcaagtaatcctataggcttcagagtttgaagtcctgcattgaaattttagctttgtcacttactagttgtgtgataccagcacagcagttaagacccttcatgttgaaaaatatcagaaaatctaactcttagtggctcatggaaaaaattaaaagaacagcaaaacataatgaaatgtatttattactcacatatcgtgaattccaggaaaatttgtcaaatcacatatcagacatatcttatggagtccttcttggtggctcctaaaagctatggctttattttcccttaagttcaaatactttggaataattagactaacttgattcatatactcccctgaaccaatcctatggttatgtagacatttgggttgacagttcatactctactctaaaaactccagaacttgctcccttgaaattaatgaaactaggcaaacattgaaatcatttcttaatttctcataatcaattatttggaatatacattacattgaaatcatttcattattaaaataactatctttccttggttaccttttattggcttacagtattatttatttatgtattttgaactattttcactgatcttaatcaaagaaaattatattctctacatcataatgaaatagaagttctgaacatgttctttctgtgttttcctggattttcaaattaaagtatgagttgcttcgaaatttaattgaggctattgggactacagagttcttgcctttaagaaagttaagtttccaaatgtgtgtggtttcagttaattgcagtgtagtaccacatgcatgagattttatattcagaagggaggaaattgattttctttggcatgtttatagcaaatatattcagtattattgttcaaacaagctgaaattatttacagaatgttatatgtgtatgtgttttctgggaagagggtccatagctcttgtcagatttttttttttcaagagggtccatgactatagaatcattaagaattaatgtatgggataatttctttttcttctaaaacccaataagctcactttttaaaaatttgatggcgttttatttatgttaaagaggatcatttaaaaaaatattatttaactaatattcacattaattgcaatcatttcatggtaaagctatgcttagatttaaaatttcccttctagaatttatttttttggactcagagactgctatggtgatcaataatgatttgtagaaaattatgatatagcttgaggtcttttattttaaaatgttctttgtgacaatattcttggctggtccttattgtattggtgtctcaaactgttgctcaaaatttaagtgtgtttttaatgtactatttttttccataggaaatgaaagctcattgtataaaacttttaatacatagaaaggtaggaaaatagaaaatcatccttaattcttagcctagccactgtcaaaatttgcatgcgttattcttgtgtacttttctatgcagtgcaaacatgtatgacatttgtaattgcaccatgtatagaactttgtcttcatttattaattaatttatcaaacatttgtcagaggcttacaaagtaaagtaaccaattttcccagtttgcctggaactttcctgcttttaacagatttttaacaggatactcaccttctgggaaacctgttagtccttggcaaactgggatagttggtcaccctctgataaagataaagatgaataaaaacagactatagactatcaaggttagtgtgggagtaatatatattctaaagttgctatatcttatattttttacttattagtatttttcaggttactgcataattttattagtccttttataaaagtaaacttcaacaggttgaatgcaaaatgagttataaatctattcctttagcatagattttttgaatcatttcctagttttgctatcataaacaacaaagaaataaaatctctgatcacagcttcttttgaccgttatatatttttttcaagacagccataagatatataattgctgggattaagagcataaatttgttagattgctgatacatgctgtcgaattgctctccaaaaagattttactagtttatattttcattagagatatatttaaaatatgacaggattttattattctcagctagatacgaactttattcatcaggaacagtttgtcctatattggtcaaataatattctcccaggtattctgaaagagaattctaaagaataataaaaaggaaacttgtttgcatttttatatgagaatttcagttaaatgtaacaatctcattggagaaaaataaaaatattttgtatcctcagggctttaagaaaggtgcttccattggccgagatgcttaatgtatagtcttttgtgaaaaattctcgtacttagaagagttaataactcagtaactatttaatttactaacttgggaaataatatatgtattagtgagaatagtaacagtgttttgtttgtttgtttgttttgtcatcaaagacactattagccagggtctttacataattcttaacataataattatatttaaaataatctgacatcagattttcaaaataaatttaagacatgctgagaattattgaataccatgattggagctattagatgaagtttctgatataccttttttgttgttgctgccctcttgccctttctggcagaacttttattttactagaagaaaaatctatagcttattaaaaataatctaaccccaatatgatcaaataaaggtatcatcctttgattcaaagaagcatagtaacttataaaaaattaaaatgttattttgttaatagtgctctagcacagcagaataaccttgtaactattttatatattaaaaactaataatttgatttaatagcaatttacctataatatttttctatatatgtttcatactttgttaaaccataataagtatgtcaagtagtttttattttttatcaattaaatattccattaagggtacacatggacataaagatggaaataatagacactggggactctaaaattggggagggtgggtgggagaagggggttgaaaaactatctattggatgctaagttcactatttgggtgaagtccaaacctcagtaatacacaatacacccatgtaacaaaccatgtaactaaatataccctgtgaatctaaaataaaataaaataattttgagagaagcaaaaaagtaataagtagataaataaaataaatagcagtatttcattaaattagaaaatacaagagtaaaatgattttgctagtaattaaacatctagctcctgatgaaaacatatttatttggcttaataatgttatgtcagcaaatacatgtttaatattacacaatgattacaatttttcctccctatattcagcatacactttaatttcaaattaatatttacatatcatgaaactataatttatttaaaaaataaaaatgttatgtgtaaacacacaagtatataagctgtcttttttgttttatgaaatacaatcacagtaaacttcatttcaacacacgccctccaatttcattagtgatgattatataagcttatgatagaacaaggagagaggaaccaagtgtcacagttaggctacggaattttggttggattaatatgtaaatgaataatatgaattattataggagtcaaagctattgtactatctgctagaacttgctacttataggaataaataagatatcaaatactttgcataatagtgagtgttttacttgttaaatctgcataaaagcaaaattaaaattttcctgtatttagctggtactgtgaaaactatacaaagtatttagagatatttatagtatttgtattgaaacatttaatatccaaatgaatgatggtcatgggttaaaggaaagagagggaagcaaatgtttacagagaatctgccattatcagctgtgtgctgggtcagtaaattcattcaacatttcaatgaactattactagtctcaatgcattaacaagaaaactaaaattcacaggagctaagcaaaattttcaattttccatgctagtgaatggcatgtctgtctcatgagttcatattttattttgtatatcacaaaattataaaggatagacaccagggtaattattttaggccaattctacatttttcaattttttttcaagcagtgatcaaacaaaaaattttacacacttttttgtgcaggtatctaagtaattctgtaagctagtttctaagaaataaaatttttagaacaaggtgaatgttttaacttttcatatacgtggtacagctacattgtttttcccatggtcttaccaatgtacattcacatagtatggaagagtgactattttcctcaatcttacaaataataaataaaaattatgataattttatcctttttttctgctatatgtgaaaaatgacacctcataatttaacattttatggaaaaaattaattttagtatacaaaacaaatccaatattcgatttttattatagctggccaaattaaaattaaccatgatgttctactgtaatacaaaatatacttgctaggccaaattaataatgtagagacaaagaccttgtttaccgtagccaaaaaaaacatagttgatgggccgatgacttcattctggtcatgttttccatctttgttttaagtattgttgacactaaatatttacaggtctaaaccttctcggtgtcatacattcctggaaattagaaaataatttatcccatctgcaaagagtaaatttggtcaaaagagaaaatatcaaattaagtagatgaaaaatgattttctgctttgttttctatttttccccccggtacttgaaagtagtcaaataaaaaatagattcagagttgatttgttcatataaacagagccaatataaaattatgatgattagactatttcctatgatggctgtaacaaattaccacaggctctgtggcataaaacagtgctttattttcttacatttctggagatcagaattccaacatttatgtcaacagggctggcttcttttggaggctgtaggggagaatccatttcttcatcttttctaacttctagaggtcacctgccttccttgtttgctgacacctttcacacacgactacatccttttccttccatcttcacgtctcctaattgtttttatgttgtcagatctctctctgcctctctcttattagaacacttgtgattacattttggatccacctggataatcaaagacaatctccacatcccaagaatcttaatcacattggcagtgtcttttgctatataaaataacatccataggtccaagatgttagcatttaaatatctttgtggttattcagcctaccaaaatgatacaaactgccagtctatagaattatttatttaatctttttattcagtaaagttattctcaaagggcagattttacagggcaattttttgaaaaataaaacttgtaaaaggtttaattgattaattactgtttacagccatgaattcagacatgcatagtcatttaaacattttgatttctttaacatattttacaactggaaacctgtctaacacaaatggtcctactgctttatatctttttctgcctacatctatctaaattgagaaatatatggcatgaataagtatattcagtttccatggctatggctaaacaattactggaagcattttatatgggaataatttacatacatttgtgatattacttttcttatctctcctcactattttgagcaatctttgacttgctcttcaatcctagtttatggaaaaattagtctggccatgttaatagcggtgctggtgtcagggtaccttgaagaaatgtttgtttaggagttagagataaacagctgtgtctttatagaatgcttatgctaatgtgcatcagaaatctccaggaatatgacttagtatgtggtgtttctaaaactctatttaatcagagacacttttgtacttggagtttcaacatcttcagcaactagtgggccaaggaaatactgaacattaaacatccacaggactttacaattgtgaaatttgaaagtttctgaaaactaaaagtgtgttgactttttaaaaataaaagccaaaccaaaatgtaaggcttgtgtgtgggtggatttgtgtgtatttacaatacttagtgtgactattgatatctttgctaaggaaacataagaaaatatgcttgattatgggatgctgccccaagactttcctggtagtgttatataaaatgtggtatatgcaaaatattgccaggatttcaaatattagacatatcacattttaggagaggctgataaaagattatgaacctgtattacaagaagcacctgtattctttccacagtgaccaaaaaaagtcttttttttttcacctttagatttgatcatggtctaatgaccattatctcaagtgggtccacaaccctaatcaacaacgtgcctatagtttcttagagttcttcattttatttggaaaatagaagcaactggtagagtcctgcctccttttcccatcaccagcaccatcagcctagctatatctgtgcctatgcactttatttaccacctatggcaaagcctaaactatcttcatgtacttaaagccttgctgccatttgtacactgttcctgcaattatccccctacaagtgtgtgtgcacacacttatgaatcccgagtttctccttttctacagcatccttcccaatagcaggcaaaagtgttgttctacctcttattttatatcacgacactcttatatcaatgaagaccatgtactcttctaatgagtgtcacatcttccactccccctcagagcagaactcctaaatgagctgtcctgactcatattctctactccttcacttgtgtttctctcttcagccaactctagtccactgaaattgtacttatcaaggttgctaataatctccattgtgacaaattcaatggccagttctctgtccttatattatattagaatttggcccaagcaattcattagtcaatcatgaaagtatttttttcactttgcttcccattttagtttcagtttttggttttgtttctttgtctttgttttttctgtctacctcaaggcctatctcttgcatctctttcttacttctacatgatctagggacctagcctttagggcactcactgcttatgtgattccatctgttccagtgatttgtaaatttaccagtgtttctactgtgctccagattcactcattcaacacccatctcatggggatgtctaacaagaatagacagaatagacagtttcaaaataggaactgttgactttcctttataaacctgttcctctcttaattttttaaattttttatctcaatagataacatggtcattcatcaaaatgttcagtccacaaatttaggagttattcttgaatgataatttatcatatattctcactaactcactcaataagtgctgctggtgctgcctacagactttataccaaattctctgactttccactgtgaatcctgctactgtcctagtccacatctttgtagtatgtcacttagagtactgcaataacctcctgcttccccgtttcccagctttcattctttcagcagcagcaagcatgatcttttcaaaatggatactttcctcggaactctcaaataacttatcactttcaaatagaaacttatactcaaaataattgaaaacaggtatgcaaataaatacttttacatgaatgttcatagtagcactattcaaaatgaccaataaataaaaagaaccccaagtctttcaactgattaatcattaaaaagtcatagtatatacatgcaatggaatagtatttgaccattaaaaggaatgatacactgatacctgctacaatgtggatgaacatcgaaaactaagtgaaagaagtcagccacaaaaggttgcacgttgtacgtttctttttatatgaaatatccagaatggttaaatccatagatacagaaaacaagcctcctacctagcttataaatttcattatctaccactctccatttacatctcccattttaaccacgctggtctctttgcttatttttagtctcagcatattctaacttagtttatttatgattgcttttctatttgcttggatttctcctaaatcaaatcctagagtggcctattctagcatttctttaaagtagcgtcttaaaatatcacctctcacaaacaccttcccttccactctatccaagtctacacagacatctctaaaaaccatgtagattataagcagcataactacccacaaaaacatttttagcataactaaaatacattcaatacaacaaatttaaaattacctcagcaaagtatataaatgacacctgtaacaatagttctggctctggagcccacactgaattagaaagacagacagagactgtgcatcaggaggagagggggagacctagcagcggctgagagtggataaaatcagacccacaaatgagaatcccatagtgatactgagaataggtctaaggaaatattgagcacagatataagaacagatgaaatagaaaagaaggtgtttgaaattatgtgagactaaatataacagtcttgggaagatatggtttctggggcaaattagaagtgtatggaaaattctttggtggctctgtggctaaaggaaaaataaaagaatgaaaaggttaaaattaaaggccctactgaaaaaaaaaagagagtcactatatcagaaaaccgtataatatcaaaatataaaaacacccccaattaaataagtttttttttcattaactacacaagacaatgttcatgaagaagaaatctataaaggcaataaaattttctctgaccttccaccggtggttgcttgtttaggaaaaccttagtacctcaaaatgaacagaaaatcattggcaatacctatacaaatttatagaaagaaaaaaaaacagacagcaaaaattttcaactgatgaaatttctcttccttccaaaagtaagtaaaaaaacagcaaccaagaaacaacaacaacaaaaataaacaaaaaaccctgtcttaaatatatttttaaagaattacctggaaatattaaaaaattatatttctaatcagtgaaacaaaaaatagcaatggagaaagcatacaaagatgtgaaatgaaatctaaaaaggtcagaaaagagaagaaaaagaaaaacaaactcagcagcaaagcatcagccattaggtagctacagaagaatagattctaatgagtattttataaatggcatataagtgccactggggaaggaaatgaagaaaattcaaacaacacaacagaaaaaattataaaggttataactgaagaaagttttttagaaataaggatcttcagccacatgttgaaaagtcacattttggtaattcttaaatatgttctagaaaaatttttagttcttaaggatattttaaaaaaaaacctctggactttcaggcaaacagatcaaattacttacaaaggaaaaaagaaaattaggttgtcgtgagaaatcttcacagcaatagtcaaaataaagcagcagtaaagccttttttaaaaaatgcaaggaaagactatatgagctaaggtacctttctggcatcaagattataaagacatagttttaaacttaaaattattttgtgaatactatactcacaagagaatgagtatatctaacttagggattattaaataaacttgacaaaggaagatagtgaacactgaatatatttaatcgtagatcccaggctaaaacaaaggtgttaaaaggggtagaatgataaatatgttctgacaaattagaattttgcagttcaaactaatggataaagaaaataaaatgaccaggcacagtggctcatgcctgtaatcccagcactttgggaggctgggcccagtggatcacttgaggtcaggagttggagaccatcctggccaacatggtgaaaccccatctctactaaaaatacaaaaattagctggccatcatggtgggcacctataatcccagctactcaggagactgaggcaggagaactgcccaggaagtggaggttgcagtgagccaagatcgtgccattacacttcagcctgggcaacagggtgagactgtcacaaaaaaaaaaaaaaaaaaaaatccttgattttcatgtaggtaatagatggcagtcaatttaaagctcaattagtagcctaaataacggaaacaatggactaaatggactaagagctttgtaaaatcttaactttctctcaaagagctgatggtactctctgcaaaattcttctaaagtggcgtaaaaaatgagggtgactaaattcttgggaggatttctatattaaaatattgaaaattttaccataaatttaggaatctgttgaaattctgagcaagaaaacctatactgtatgtgcaagaactctgctgaaacagtatggtagagttgtaaaatgtatagaaacttgtatatgcctttgcaaatgaagtaacagcctttgaagtctccttagttcaaatcccaatctatatagttgaattttctttctttctgactttctcttcctttccttttctttttcttttcaaaatgaatgtgttttttaaactgttcctgcaagttgtgtctgtttgtaaatatgtggggttttcttcagtttttttgttgttgcttgcgtgttttgatggaagtggtgtttgtgtgttttgatggtagtagacatggcagtattgctggagatagttgatgtaaatcatctacttccaaatgcattttacaatgtggtatatatcaatttttgcttttgtgatcttttgcatcggccatagatagctgtttttcattttttttgcttaatgaagtaaaaagcaatataaataaaatttctccttccaaatgaatctcattcagctgcgttcaactatgaaagagctctcaaaaaagactactcattaattttcatttcaaaaatattttgtaaagtggttcataggcctttgttaatggcttgcctaatgtccttggatcaccatatgttctcttcacaaagtataggcccatagagaaataaatttccctcttagttttttaggttagattgttggaaaaatatcaataattcaaatcagatgattgtatttctaatcaaaattttttgggatttttgatggcatgaaaacaaagaaatgtttttaacttttttactgcattggcaatatatgaataaaagaatggagatgaggaaatgaaggaatctactgaattaactgcatgatcctctctatactttccctactgcaagagaaaacaatatacacatggccttctaatcacttggttggttccccttgaaagcagccctcagtagtttcttactacactgctatcactctgaacataagctggagacaaagggctgctttgtacggagtgaaaaataatcagggtctggtgagaggatagatagaaggatgctcaacaccaacctcaccatcaggaggagaccacagtcattccttttgtaataaaacatacaaagccagaacctgaatggaacgcaaggactctctttggagaaaaatcttccttattctctttaatgtatgacattttcataatcttcttgattttcatttttccttgtggggccaaaatcagtaatttgaattaaatctcctatttattctaacatatgtagttgaagtccattttatcccctctcccacaatatctgaattcaggaattttttattgttgtttgtttgtttgtttgtggtctttttgcccttagcagctagaagtggagaccttggtttctctgattctatttccaagtatttctggaagatcagcattctactctctcttctaagacagtgttgtcttatattaaaatttatgattttggtgagatgcttaagcctttaccccaattcaaggtggtgccctgattcttcaaagtcctcctgcctttactaagatagatcttctcaagtgctttacctttagttttccctagggctccctgctcattattttggcctctttctgtccataagtaatgttaattatgataatactgctaagatattagtaggaagtatcaaggtcctgtcaactaacctttattctacagtatttgaagcagtcagatggaaaggagaagagtcaagccattaagtgccacttttgatatgcgtagtaggaggttattcactttggtttatttgacagtaacttacttaaaaaaattttttttatcattttagatttctgttactggctactaaagagtcgatgatagatgattatatgatacagtttcattccaccatctttacctacatttttcttttaaatatttatatcaatcattaatatttttgagagagatgtgtgtatacatacacatatatatgcatatgtgtatgtgtacacaatcatttgctggaatggctcacagaacttaggaaaaccgtttgcttactagattacgggtttattgcaaaaggatacaactcaggaacagcggaatggaagagctgcactggggaaggtacatggaaaggggagctgagcctccatgttctctccaggcatcccatcctcccagcacttgcacttataatcttgacgccagaaaggtaccttagcacatatagactttccttgcattttttaaaaaaggctttactgctgccttattttgactattgctgtgaagatttctcacaacaacctaattttcttttttcctttgtaagtaattgatctgtttgcctgaaactccagaggattttttttaaaatatccttaagaactaaaaatttttctagaacatatttaagaattaccaaaatgtgacttttcaacatgtggctgaagatccttatttctgaaaaactttcttcagttataacctttataattttttctgttgtgttgtttgagttttcttcatttccttcttcaatggcacttatatgccatttataaaatactcattagaatctattcttctgtagccacctaatggctgatgctttgctgctgagtttgtttttctttttcttctcttttctgacctttttagatttcatttcacatctttgtatgctttctccattgctattttttgtttcactgattagaaatataattttttaatatgtccaggtaattttttaaaaatatatttaagacaggttttttttttgtttcttttttgttgttgtttcttggttgctgttttttttaattacttttggaaggaagagaattttcatcagttgaaaatttttgctgtctgtgttttttctttctataaatttgtataggtattgccaatgattttctgttcattttgaggtactaaggttttcctaaacaagcagaagctctcagaaactcatcttttgggggttttagagaggcctcaatacacaggcctgattcattatatcacctgccagtagtgataaaaaaattcaggccatttcttctccccagaggtgttgtgtgggacactggggtgtctgaaattggtaaagttctaatcacttggttggttcccctggaaaccagcccccatgcttgggctttccaggagcccccagcccccagcaatctcattagcatatgaaaatacttaccatttcagagattgcaagaatttaaaagctgtgtgtcaggaaatgggaaaagagaccaaacatatttcttaccatgtcacattgacaattattttgtatatttaagtttctcaggcatcacatcgagatgtatcatgttccaaacaagaaaacggaacacaataggagctttgagactgggagatggcttagtttttatccacctaaagttaattataacttctggagctgcttctggagttagacatatattgctatccaatagaaagaacagcactggaattctcactagcttgttttgtcatttaagcttcctaaatcggatctgcttctagcttcggttttataatgtacaatgatatgtactatagaacatagacaatacttaagtaccttccctttaccccatccctaaatgagacctgagccataggaatgatgactagcactgaaatagttggtcacctggaaactctgtgaactctgaaatttccccatattgtattatcaggctgaaaaaaaaaaaaaaaaacatgtatagtgacacctgtaagtgtacttcagataagaagagattaaggagtaatagttccctggtgcaggttttaccattattcttccaattttttcattctagatgaaggtaaaccaattggaacaccacttatttttgcacttccctctttgccctctcttcgttttgtctctccttcaaatcagcagaggcagaaatgtgtttttagtcaaaactgcagattcacatacacactcacacacagacatccatttattccttagcatcacccccatatactatacctaaggtctctctttgtctacattttgattatccacaccaaaataaaatctatgaaaacacctgtacaacagaattagtctactgaggcctagggcaacgtggtgtaaatctactgtgcatttgataggtggtggtagcttattgccacatcatgatggatgatgtgtatcatccagagctggactctggagttgtcccttgtgaacattaattagtaaggcaaaatggcttgagtttttggatcaaaagagactgtactaataaaaagagcaaaggatactataaggataaaaaaaaacctgtgctattaaaatctctacaagttatgcaaaaacataagaactgaatgaaattgcctttaaatagttgggttctttgaattgcttacctaaagttattcttactatggagaaataaaaacttactctgcagaaatgagaaatttattatagctgagccagattatacatatgcatgtgtatacgtgggaatatatatgacatatatctatgaatatatatgacatatatatataaaacatttatcattgaacatgacattgaaataattagaatctaaaactcctttaatatttaatatactgatggctttgctaaaattcatatgggatattttatgcataattacttaccaggcaggattaatatgaggattactatttatgtgacagaaacatttgtaaaccaccttgaccttctcaaagaaaggttgcactagtgattacagagtaatgtctgctttccttttaatcacaatctaagatcaggtcttcatttcacagtggtagaggaagttgacataacgaaaaacatctaaataagtaggtggatgatctcgagagatggtatggatgattatttaagagttttatagccttcttttgttggttgagtttttttaatctgtatttattgaggataactttatgtttattgacaccatatgttaatactatgtaaacacaggatgtcttcatatttagttaatattccatgtgcggaacttcttaaagatttcaaataagcctacatacactatccatatgttgctttttagcaagggtgctaaaaattgtaaagattttaacttagcatggggatttatgtatttatatatatatacccacacacacatacatattttagggggttatgtattaaatactattcctgtattagaggttcgtgcttgtcatcagtcagtatttttagtatacatgtatgtattgcctttactgtcaccactaattcatactttgtgactcccccttgcatatatcctacctatgtaaatctgtatttgcacaaagaagttactagaaattttgattacttcttaatcattcttaatcagaattatttaactaatccacttttaatgtttaaaattaaaggatatatatatatctcacatattcatttattttaataaacattatttgaggggcaattatgaactagtattttataaagcatattgtaggattagggaaagaagtggaagggagaaataaaagatgataaaatattgaataatatttacctggttctccagaagatcaaatttcatggtaaagactgaatccaagagatgtacctataaaacaatttatatgataattgaacaagcataaagtaagatatttgagcactttgtggagagaaagggaataaattaattctgctcatgtgtcagttgaaaggcttatagaaatatgggtgttctacatgctaaagtgttttagtttgttcaggctgctatgacaaaataccacagacttggtggcttataaaccaaagaaatttatttctcaagtttctggaaactgcatgcctgatcaccacccagaagccctacctctaatgccatcatcttcaggaatactatttcaaaatatgaatttaagaggaaaacaaacattcagcccacagcacagagataagtgggcattcttagcagagggaaatgtacacagataataatatgaataacacagagttatcttaaggaaaaatcacgtagtttgctggggctggaactacagcataaagaaccagggtggtaaattgaggctggtatatgaagaattattacatagagacaatccaggcccccacagaaaatttcagctggagtagacacatgagaaatttttgtttcagaaaggtcacttttgatgacaatactgaagacatgctgtgagattagcaaggaagataatttatgtagtggccaatataatattaatgagatttccatgacaaatggcttatggtcaaatgtaattgtgaaattctcagtcaatagaagcattttataaaagattgactaatgggtcacttggaattttaatatgttaatatgcactgcgatacacacacgtgcattaatagtgtctacatcattatcctaacttgttttgctgtaagaacaaagaactgtacgttgctcaaggctaatgaaatagtggatctggggggtctattccatatctatttaatacaaaagtgttattcactactctagattcatttcactggaaaaataaaaagatggtgagtgatattcttagtcagtggcagagggatgggaagaaagagaaaacttcaagaggtgattaaaataaatgaccaacagaatttgttaaatgcttaatgtaaggttcttaacagagaggcttcatgaggtaaacgaatctccctatgttgggtgtgaaaccatgcttccatacacattggtgcttcattctgaaaaaaaggtattttaacttttggcagctgtctgtaaccactaaaagattaaaacccattggtaatgggccaaaaatggaactctggcatagactagatagatctaaagaaggggaaaatggaaatgagagagacaatcttgagaaagcaatgttctgaagtcaaagcaacaaggaagctactatacagcaagggaatgaagagcacagatgctggagccacattgtgtgggcacaagtcttggtcctacccatagctaagattttgtttgggaaatttagctcttttatgaaagctatccacatttataatgcaaataaaaatagcagacaacctcatagggttgtagtgatcatcaaatggttttatacatgctaattgcttagataagtgctcaacacataggaaatgaaaatcatgaacaaggaccttcctggtgatttatatatgctattaatcctcacagcaacatcaggtggtgctattatgaattttcatcatggaacacaaaaactgtcatgaaaacttagtagacccacaattctgttttactcctaaactcaagctcctttaagtacactacatggacgtgacagactttcaaaacagggagtttggaacctggataatcttggcaaatcctacagaggaaaaatacaaaaagtagctactagatcagtgtttcttatagcaggcaaacctcaaccccccaaacaaaacaaaacaatttcataagaatggacttgttgatggcagattgcaatacaagataagcacatgtaaataacaaatacaaaccaaagttggatgaattatcacaataaaggggaagaagcagataggtagtatctacaaagagttaagataatgtgtttttttttggggagggggaagtgtgtgtgtgagtgtgtgtgtgtgtgtgtgtgtttaaatgtttacctttatgtgtgtttggaagatgagaggcttgagcatactagcatgttcagggaaaggaaccattgaaaagaaaaaaggtaataatactaaagaaagagggaataatactaacggatgtatcaaaaattggaatagaaaatatcattaaatagggaaggatgtctagcttcctaaaacaggagggaagttaaggaatgaagtgacctctattcacctctgaacccagggattcggtaacatagatcagtaactcttcctgagtgcttacaatgcactgtgcactattttaagcgctttctgtaaattaatttatgttgctttgaggtagctagtataaccaagaggatagtagagtaaagagaggtcctccagtggctgttctgggccatgaatttgacagttagtctttagaatccatgtactttactccatgcactgcctctctgcccatcccctctctgggcagttggaagtgggaggctggatcagcgtctttgaatgtggtggaatgtagaggtgtccaaagaaggagcaagggaaagaatctaacacatacagataggacaaagtgaaaatgggagcagcaagaaacaaaatagaagacagaaaactagcaaaagattatagaaagaggggaggcttagaaaaagaaaagataaatgaagacaaatgcaagccatattagatatcaagtcaagtgcattattaaaattcaactactttagtcattttgagcacacttgtttttagaataagttatcacattattaggtttgaaattttgtctattttttttaaatgactttcttgagtagctaaaaccgttgcttaaaaaaattctcttctatgatgcttctgtcacgttttggggtaattgcacagaaaagatgaattcatgttgagacagaattgggtggaaatgtctagttgaagggataaaaactgaaaattatcaataatgaaatttggaagtcttgtcaataattctttaatcccctaaacagattgtatcttttaaaacttatctacatttcaaaggtaatattttgtttcccatggggattttttaaaaaatttgggcaaaaccaagaataggaatgttattatacaaattactcaatagcaattttgctcatggacattgttaactatgtatgtaggttaaataatttttttcctataagaaaataaaatacagttttagattctaaatagccaatttgttgtatgtagttgacagggtagccttttttagtatagctactttattttcagcctaacctatatttaagtatgaaatttattggagaatgaaaagttaacttttgctgctgctactttcaaaaaaattttgtagaaaagagtattagtgataaaatacttaataatctttttctttctttctccgtacttcacctgagttctatatatatatggccacgcgcagtggctcacacctataaccccagcacttttgggagcccgattctagtggatcacttgaggtcaggagttcgagaccaacacaatgaagccctgtgtctactagaaatacaaaaattaaccaggcatggtgttaggcgcttgtgatcccagctattcaggaggctgaggcttgaacccagaaggtggaggttgcagtgagccaagattgcaccactgcactccagccaggactccagccaggacagagcaaggctccttttcaagaaaaaaaaaaaaaaaagaaaagaaaagaaaaaataaattgcaaataatatgtgcaccaagacataagacagtaagctttttttttttttttttttactcctatgtcagttcctgaacagtttggtagaacatctccttaatcatcaattaaccaacaggttacagaaattgagtgagagaggacttcttggaggattacaatctaattacgtaacaggaagaaaacacaaactgatttttattatgtcctacagtttttcactgttcagtataaattatactttttctcaaggaaagagagatagatataatggataggctatgaaatgttgggagatactgagaacaaaattttgctgcaatttatgaagaataattgttttattttaattttaagttcccagtgtattttgttgaaaaaaaaaaaaaaaacctacaaggaagtttcagttactcagggactaatcagttagctggccacttttttatataaaatggcattttcttctaggtttgcctttagttttcaccataacagtgtcattacttattacaacttcatcctgagtagaaagagaaacagaactagctaatatcagcttgtttggctttatgcttggtgagagatgttggcattgtggtttaaagtggaggttttatttattttgagtcgttattcatccatcactggttttcactaacgaaaagttagctgtgcttatctactgagagatcaattccattttaagagcaatttataaagcttgaagacagccatgaatataaaatagcacaattcaccaggtcttcacaaagaatactcaaaattgagtatatcaatttcaaaattgagtatatcaataatcaaaatctaattttaccactggtgtaaagagaaagtaagttaaaaaatcccaaatcctttctttgttggattaggttcctgcctttcttattattctttgctttcatctattgtatccagcaaagtggtatcatatcaatgaaaagctaaaactcctagtaacttgtaggagcacattgacataggtgtaaaaaagagagacttcaactcaaaacaaaacttttacattaaaagtaaaaggcctactcagaagtggaaataatctagatccacttcccttaaataccagtccttatcagaaaatgcatatttagtagtattttatttcacaatatgtgagttatctagctcaagaaggaataaagggagtctttagttaaatcagaggatgttgtgaaatagcactgcagtgttcataatgaaattctttatattcatcaatgtttttcagactgagttccaatatatattctctaggatctaaaagtctccatgatatttcatttataaattatgtcagtgttcctacacattcatatacacacacatacatgtacacatatacatactagaagaattagatgacagtcttacagccaaataccacaattttttttattacttacatttgcttctatcttggagccaaatgaagaataaatgtttttgttttcttgtcagtttgagtttttcaagctgtcttctaagaccatattcttggggcctgaagtttttcaagtttaagaaaccctgagataggtgactcttatttaaccaattgctgtgatcagttctatgaccttggcattaagacctgggtgaaatgatcaaaaatgatctacattttggttattaacatatcttccatgttcacatccttttcctttcagaattcgtagccttaaaaataataaaaaagggcagaagatagtcagactagtaggactcttgaggaggctctcctaccctcactcacatcacagctgctgctttcctaatggtcaggattacatgcccaaagccttagaaaattatcttaaaaggatgccttcccttcacctttttcctcttattggctccagatgctctcttttttgtataaaattcaaaacttggtcatcgttttaagagagatattaaagggtaacacattgtatgatcgtatcaaagtatcacatgtacctcatgtacagccattatacatccataaaaattacaaattaaaaaaacttttaaaacaatactttaaagaatagtaaatgatagcatagaggtaagagaatgcattgtggaatccgattgcctgtgttcagattcttcattctactacttattaattctgtgacactggacatgatatttgacttcttagtgccacagttcacaatttataaaacgggaatgaaaatagcacttactttgtgtgtattgttgatgaattcacaaaccagtaattaatcatatttgatatttacaagtaacaatctgaaactaaaattaaagttttattgaggtaatatttgagtgcaatgtcatattacaattagtatcatgtcttcatgaaaaaagtaatggtctatgaatttaccaaggataaatggctggtctgttccgacatccctatgaatttttcttttcagcctaatagatgacttttattttaatatttttagctgtaataaaattttaaaattctatgaaaaaatgcaaagaaatcctgctgttcatatacagttattaattaataacatgattgtatcactagattattaaaagttcacatacatatgccactgtggcaaaaggattctcattattgaaaagaacaccaataaatggtaaaaaaacatagttttgcataactttgctgatcatgaatagtcaaagactaatgtgggtttaaaatgtgggtttaaaatggaattatttttagtaatatcaaagaaaatctgaaatcatatggcattcagtctttcatattctggggaaaccttaagaaataaaagacttgtgacaacttttctttattacccaatgtctatatttaaaatgtttgtgtttctttaaaagaaatatatgggctgggtgcggtggcacatgcctgtaatcccagcactttggaaggccgaggcgggcagatcacctgagttcaggagttcgagaccagcccgaccaacatggcaaaaccccgtctctactaaaaatacaaaattagccgggcatggtggcgggcacctgtaatcccagctactccgtagggtgaggcaggagaatcgcttgcactgcaggcagaggttgcagtgagccaagatcatcgtgccattgcattccagcctgggtgacagagcgagaatttgtctcaaaaaaaaaaaaagagaaagaaaaatattttaaaaatcagtaattaataatcctgtcattaagggcaggcccattaataattgataattgatatttcagttatttttccaggtttatggaaattttacatataaaatataaatgcctgaaaaaataagttttgtattattcatgaaaataactggagcatttttagaatgcatcttatatactctttgtaagcattccagaaagcaatcttactggataatttatagataactgtctaaaactactttgctaaacaatggaaaaattaataacttagaagaaaatgaaattctacttcaaagaacatattaagagatctatattataaatgttaatagagttatttaacatatttctattataaaaatgatagatatttaattttaaaaattattaaaggactcagatttacttttgaaatccatctgctaaatataaaaaaataggaaattttgggcttatttttgtaaataaaaaatgaatgaaaacaaattttaaataataaataatatatattatataatttttatcttaatcttatatattatttatatattgtatatattatcactatattataaatataattatttataatatgtatactataaatataattatttataatatgtatattatgaatattataattatttataatatgtatattatgaatattataattatttataatatgaatattataatatttacaatatgtatattatatattatttttataataaattttaatatacttatataataaatattatttttaaataataaatattataacaatattattttgtaaatgataaaatttttaaaaaccaaagcttttatagcttcaactctggagagaggaattttatttacataaacttcatattacattggtgcaaacataattgcagtttttgccattactttcattggcaaaaccagaatacaaaattggcaagccagaaatacagaaaatatattattcaattaaatgaatgccctccaaactcttattcttgaatctaagatatttacaaaaatctttccatagatattctttcataaatacatgtttgtgtatatgtatatgcagatgtatctatctttgattatgtcctttttcatacatacgcatatacacacacacacaaacacacacatatatatatgtttataagtttgcataaatatttatatgtgggcatatataatgagggaaagaatcagctctttttttttaggataccaaaaatgctattttaaaactttctttaataccaactcaaacagattctttccttctatgcattctaattcgttgtgtggaatactgtaatttatttttttagtcatgtattggtatacatttaaattttttcacattgtcttgcaagctcgctattatgaacaatgttgtaatgaatgttttagatcataaatctttgcaatattttctaggaatacatttttagtcaagaaattcctagttaaagaaactacattttgaattttaacaggtattgctgaattatcctctaaaacttttaatcaaaatgttttcacaaaattgcatcttaatttaccctttgtcaacataatagattttaaaattttaatttgtattaatctacctttctttaattataagtatctatttagtcatttatttcctgtttgtgaactactaaagtattatgctcattttttcttattttgttcaacttttacttactaatggtaaaaacttgatataatagtaaatgttttctttgcctgctgcatgttttgtaaatatttccctcatgttcatttaaaaaaaattcacttgtgtcgtttttcaattcagaatttaacatttttaaaacatatattcaatactcttgttattatttcatcccaaatctacagtgatacacaaaggccagtaaagaatgttgacattgtttatgtataaatagtgaaccagtgccattgattttaggacatttaatgagaagattaaattgggtggccacagagaacatttgtgtgtgtgtgtgtgtgtgtgtgtgtgtgtgtatgtatgtgtgtgtgtgtgtgtgtctgtattgggcatgtatctttggataataactattagttaatggtagaaatagctgattttaccatttttaattaatgacatattgctggctgtattttcctgaatgatatgtatgtatgatagaatttctctagatgttaataattattccaagaaaaaaaatctgtagtgaaatatttcaagaaaaaaatatcataagatattcttctgttaaagatacacaatagatcatggaagatttgaagaagctctgcaataaggaaacctgtgtaactttgtttaatcacaatgtttctcaaatcatttacacatatgtccgttttctgtaaaacactttttgacagcacacaggaaattctaaaacagctaatagtgtggtattttctcacaaaggaattaaaatatgtaatttttaaaagagaaataagcaatacctgaaatgaactataatattttacagattatagtgaagcttaaaagtggggtctatgccttgaggacagggctaagacatatatatcacatataacctcaaatatcttaaactgaagctacttttacttttccttaaataagctaaaaacacgtcggaatatgatgggtgttacattttgtttcttgaatatagagaaataaagggtaaaatatttttaagactaaataatgttcacattattctaaacaaagaaataatagagcacctgtagctgtgtttcagcagcacctagaaacacttaactacacagaactttatatagttcactgaagtaggataaaatgttttacaaaacattactctagtgtttttccttggagtatcttccacctagcccattgttgagcaggaaaaagataaaagaaaatctctataaaaacaatttacaagtcatttcaaataagtctcttactttaactatctggtaggtgcaaaataaaaagccagatacggaattatattctgagtcttgttaattcaaaacctggcatttatttttgtaaatgtcataatttcaagtcttactaagatcatttttgctcccttagccctctttaatgaaactccaaaatgtattatgcaaacaggttccaatcaaatgaggcttaaatctttctcggagacaaatgcagagaaatttctgtttatgagtatgcaatagattttaatgttaggaataatattgattctcagaagttgtaggaatagcttatggggcataaattacatatttataccatagaatttattatgagaacttaaaaatttcaatttacttagctgtaaatttattgacttctagagatttaaaattttcttctgaagttaagcaaatttgcctgtaaaatgtgtacaaattttaaaatctttatagtttagcagaaagcatgaagactttcaaaaagacaggttttaaacattgcaaaacctcatgtattttacattattttatatattttaaaggttacattagttctacagtttggtgtgatggtttcactggcaaatgcacttgtcaaaattaatgactgaatacttaagattttcatatattgttgtatgtaaactaaatgtcaattttaaaaagtacttaggtagtattaattccttctttctgttcctaatgctcagcctcccacttatccactatcacactgaaacaaaattataaagattacattaacatggcattatttctttgtcagtggagattaaataacctatattttaatgcaacaaggaggaagagaaagaggagaaaaaagagaagaccagctgttttatctctgtgaagcagagaaatgataactaaaatggcaactggctttaattaatccatataagtgcatattagagtacattgcttaatgaaaaagtggcattcagcacaaacctagcacacagtaagccttcattaatatttgttgatggaagaatgaaggaagatagaaagtaaagaaagaggagggagggaagaagggagggagagaggtaaagagagggagagaaagaggaagggggctagaaggagaaaatttgaatccactccaaatgtgtttggaaacatttaagttctcagcatatttctctaaaagaaaagagacttctccataagtttatgccaaacagcatttcagacagatgtatcatgtttatattcttcaggattcaatattaacttggctaaacagatatttattaatcccatgcaatactagaagctcatgttccctattctgaacttagtaagattagccagtaatgtaggaccctataatattctcctcaacctatgatgtgtaggaatttgtttcatctacttttttctcacaacaaaatcaggtcctctagttgtcaattgatgatggtacagatggttgcttaaaatggatttaagccaggcaatatgagagaatttttatgtagattattattttaagtagtccaatttgtaacatttacctataataatatttaaaaattatacttttaatgttcctaccaccggggcaaacttccttccttgcagtaagtagcttaagaagaataaaaacagtgagaaataggctttaaatataaccattttcacttggtaactggctctaacataatagcttcccatgagataatgtagatgaacaagcatttactgaaatttgaaccatgatagatttatcaagtcattctatatttattttttaatgtgtattcctgggctacctccaagctttctagaataaaagagatgattttgaattttagaaatggaaccaagttaatctggaaaatattaatatctagacatcaatcctagtagttgtgtttgaaaactctgtattatattcattacttagaagagaacaaaaagtagggaaagttgataattttctaattcatttaaagatgtattataatttctttcactgagagaagtagtgtaatatcaagaaaatatttttgactaacaaactgtaaaatgaaggttgttttcttctctttttataatcactatcttccctttcagcagttataatcaattaggatttagcttggaattatggtctcagttataacccatttctgctttattcaaatgttttctgagatttgctttgtagcttaattttttatacattgagctcattataaaatatttatagggcatatttggcctcacacaatactcttagcatagagaaacctatgcatcaccagggaacaatttctgtttgaagataaacatatttctcatcagtacagaatgaattatatcggaaacaattttgtatcctgagcttggctttatttcttattactatgatttttaaaaattattttacaatgtgtgaacaaagaagttatgtatactttaatgcttgaaaatcagttccattttttttctcatccataagtattttcagatttactttgatggtacagaaatagaatcatgtagaagaggatatttttaataatttggagtgcatttgtgaggtgtgcgtgtgtgtgtatttttcagcattataattccttgaaaattttcttttagccatcatttgtccttgcctgatcattgcatcttgagtttttaatgctgggtggagtatatttatgaatacctaaatttaagaatgactactcactaagaacaaatgaaatgcaaatatcattcatttataatttaatacttacacagcatacattttaacctgcttactttttaaaaatacaaaaaaatgataatggcctgaaaaactgcccatttatagtaggtaacaccaagaataggcaatctgtgaagatgagaagaatgtttgtacagatgcgaagcatagatgttactcagaagtgagaggaagaaaggggaagagttagaaaattgcttttccaaatacattggcaaatcaactgtggaatgcgatcaacaccatttttttgtttgttttacatataaaatcattttcttcagttgtttttgaactatatgtgtggaagcagtgtttttttggtagtggtgatttatttgcttctctttggctgctatttatataggattacattattagttatttatcagtagttagaacagtcaaatttttagggtcaatatgcctggtgtgatggtttgtttcactgatgcatagcagttggacatactatttttcacactttattactaacttcaacattctcaaaggaagcattgaagagaaaattgaggcgggacagtacaatttcttagcatgcctagaaaacaaaagattaaagcaagtaatatatatatcacatggacaaaggaagagtgtactcctggttgtatactaagaagccttgtattgctggattttacagagtgtatccacagacaagttttattaatctttgcctacctgtcttgcattttcacagtgagaatattcaataattcaaagcacattcatatgttgttatctttggagatgagaggaagattgaataagtgttaaaatgtgcactgatttttacagtgaaattcagaaattgataaacattttttaacttcaaatttaaattgagatttagataacgatatatttaaacatacatgttagctcatattattttgctaaatgaaatacctaaatacaaatttaatatcttaggatacatttgatatttttccatggcaggttgttaatataaaagttatttctaaaagcaccacacatacctattaatatgaatagtaaatacaaatccaaatttaaataatctaaaatattattttattgataacattaaaatagtaatatttacatgtatttttaagtaatctcaatttttcatgtcatatctaagaaattagaagaacataaatccattatagtatctaattcacacttggaaatgttcctgctgcatactttctattcagtctcttcttgatttattcattcaacaaatactcattttgtgcctgtaatttgccaagtactgttttaggcatgagaacaaaatgaataaattagacgcagtccatgagctcttgaagcttataatgcaatgaggaagacaggatacaccaaaaattgtgtaagtagataaaagctagtcaggcactgacaggtgtactgactttgatagagtgataaagaaggtatctagaacagtaacttgaatgaattgatggtgcaagcctttagagggggtggggatgacaagcaccaagacagtagggtgctaggtgtatccatggaactgcaaaaccaacgctgcttgggagagagagagagtgccagggtagtaagaaatgagaccggaaagagttccaaaaggtaaattacctagcgcctttataaggaagagtgaaataataaatcatgcgtgattaggcagatgatgaaaccatggagtaccacgatagtagtgagtatgcagagcaaatctaatttggaatctttttttttatatatacgtacgacattttgatatgtgtatacaatttttccattagatcatgtgtaatgatcaaaccacagtaattagtaagccctacattcgctttgggtctgccattactgtcttaaaattctcaataatttttgagcaagggagcctatactttcattttactccaggcctagaaaattaggcctagaaaatgaggtagctggtcctgctttctgctcccacttagaggatctgtaagaataataacatttgtaaatgatgtactttaaaaagtgtgacttacaatttctgaagcccagaaaaattatgaagtgattacttaaggaaaattttcatgcacataaatacaagcagagcaggagaataatgagttaacacagtgatcttattttgtgaagagattaactgagataagtggaatttcttacaattttagattaacattatgttattaatcttcataaatatcacatcctgagttcccattacatggagagggaagcatttttagattattaaaatgaggcatagagcaaataaattataaactctccaaggaagtccctattcaagggttttaaagtaagaaatggcaaatagaaataaagaaaaactttatttttctttaaactttagtactgaattcttggtttaccatcttcaaaaaaaatctgtaataaaaccctaccctttcatctatgaattataactttttaaaaatatatttctttaccaacattttaatacagtagattcactaatatttgttaattttgaatttgaagacatatcgatctaatgcatttccaaatgtgagcttcttaaataataattgttgttccttttattgacatgatatagcagtattacattgtaacactacatgtaattgtgattttggtaatattaaactgtgtttgttttaagattttcctctgtagctataaatgatgaaatagaaagtaccagtaaaccggagtattttttcacactaaaaatatcatatttttaaaagttacaatatttacatttcaagatgagaaagtagggttaataaaaactgctattattagagtaatagtaacaaaatatacaatagcatcaggttttttttaatatttaatgaagtcttcctccaattatttatatgacaaaaatttaattcacaaaaagcgaattattggaatgattgctttgaaaaattgcctgattagcttcttctgcccagtctctcaaaagaaaatgtttaggtataactaacttactgggagagtgtgataaaaataaacatgctttattcatgtgccaggctgctctttcttagcatgcaaataaaactgcatgagggctaacagctgctcttagagtactgcatgtcccagtctgctaggggaacacagctggagaaatgtacagagcattttcatcattgaatcaaacacaaactagaaagccatttagtactacatatgtaatactattactattgaaaagtagagtttctgttctctccttttttctgacacccattttaagctgtgccccagtggttctttacaggaaagtttataaaaatacataactatttcatggtatttcatcttgaatttttttggaatacagaaaactgtattttttccttcctctttccttttctcccgctctcctttctttcctttctgtcttcctaaaagtgtttcttttctacctaccaaattttaaaccctgcttgaggcagtgaggaccgtatggtgaacagttgaggttgatgctcgtagagctgcatcttttttttttttttttctgagatggagtctcactctagtgctcaggctggagtgccatggctcaatctcagctcactgcaacctctccctcctgggttcagtcaattcttgtgccccagcctctggagtagcagggattacaggcatgcaccaccacgcccagctaatttttgtatttttagtagagacaggattttgccatgttggccaggctggtctcgaactcctgacctcaagcaatccacccactttggcctcccaaagtgcggggattacaggtgtgagacaccacgcccagctagagctgcatctttcaagaccgtaatagcatctacaaacagacctcttcaaatggaagacaaatgaaaatttataaaatgaaaaaactttaaacagaaacaaggagagggagaggaatggagacagaggaaggggatgagacagagagagaggagaagagtggtgagaaaaaaagagaggaaaggaatgggaaagagagaagaggaagagagaaaacaaatctcaaagctatttggggaagatgaaaaagaggatgtgaaatttcttgttatgagcatttattgtcatgaaattttaatgactattaaaaaatcctgcacccaattgctttacatgatccaatctccattttttttttttttttttttttgacatggagtctcgctctgtcgcccagactggagtgcagtggcatggtcttggctcactgcagcctcggcaacctccaccttccaggttctagtgatcctcctgcctctgtctcccgagtagctgggactataggcacctgccaccacgcccagctaatttttatatttttagtagagactgggtttcaccatattggccaggctgttcttgaattcctgacctagtgatctgcctgcctcggcctcccaaagtgctgggataataggtgtgagccaccgtgcccggccgtatcatccactctcctacggatataattaaaaatccacaatctttagaacttcagctgtcaataattcttcccctgctgcctgacaccacaagcattttgtaaatactttggctctaaataggtgatatggtttggctgtgttcccacccaaatctcacgttgaattgtagctcccataattcctatgtgtcgtgggaggaattgaatcatggggtgggtctttctcttcctgttcttgtggtagtgaataaatctcatgagatctgatggttttataagggggaatttccccacacaaattctctctcttgcttgccaccatgtaagatgatgtcctttgctcttctgccaagattgtgaggcctccccagtcatgtggaactgtgggtcaattaaacctttttttttttttaataaattacccagtcttaggtatgtctttattagcagtgtgagaactgactaaaacagtagggtaaggttgtaccaactttggggaagatagtagtgacctcttgtaactctacaattgttttggaccatttatatagttgtgaaatagttcaacctgaaaatttgccagcagattctgtgtatctcaatctagccatacttcaagagtagcaagcattataaacagactaacctaaaggaatgtgagaaatttcaagggcaccagcaacctataatttaataaagaagtaaggaaagcacaatctcagtgagacaggagaactttctagaatacctggggaaaactatactcaatttcaccatagctcacaagtcttgtcatcctgtagtttatgattatgaatgcaggcctattttcagctctaggacagccctgataatttcatctcaattataagttatatttcaaacatgaaaatagaaagattcagaggtcagggccaaaaccaaaggatgattttgagctgatttacaggagtcatcagagaaaaaagaagatagaactgaactatctaggtttattttgggcaggatcacaaaattgaatcttgaaacattaatgtgaggttccttttctgggggtatttatatgaacagcagattttttttaaagaaataaaaatatgatattgaatttttgcagagcaacctaaaagcatctttacacatttttctgaattaacagtctcttacctcttatattctaaggaataaaatagggatttcttaactcttatcttaattagaaagtatttattgatgttttctgtcaggaagcaaataaactaatgtcacttgagaactatgttcctgcaaagcaatccaatgcatttattgtctactttgtttttgcagatacagtcacagatgccttttctcttgttaagcagatgtctaaagaagaaaacaattatcatatttaggctgaaaagatagaatgtatacttcacataaattgaaaataaaaatcacatttcccagaaatgaccccaaacaatcaagcaatgaaagtagcctaacacccatgggatacaggacagctgagctacactctatgaaagaacagtatctgtcacagttcaaaaactcattcaggtctttctatcctgaaagctactataattcttatttttcttataaagtgtgatgttgctgttaattgacatcaagaaaatccttacaacttgtgtcaaatgacataaagtaacacagatttttgtgtcaaaaatgttatctaacattgaaatattttcacccaagtatatatactcaatatcacacacaacgatagacctatgcatattaatttgtccctgtggagagtttagcaatctgtgaagttagagggagcacagttcacacaagaccaccctcacttctgacaccaactacaaattcagggttatcccaaaactaccctcatgtttggtgatttgctagaaggactcacagaactcattgagagctattatacccatggttatggtttactacagaaaaatgatatggattaaaaaccaccgcaggaagaagtacctaaggcagactccaagaaaataccaaacatagagtttcggttgtcctcccctcgtgaagtcagaacaatatgactttcttagcatcagtgtgagactgtacacatggagtattgtgaatcaggaaagcccactagaacctcgttgtgcagaagttttactaaggcttctttgtggaggcatgattgctctcatgactgatcttaggaggtctagctatattaaccaaaatctttgccctacataatactgttggtctttctggcatggtcaacacagaccctgaatattatctcttccccttcctctctatctccattcctctcctctctctccttgtttctgtttcaactttttttcattttatgaattttcatttgttttccatttgaagaggtctgtttgtggatgcttttatggtcttgaaagatgcagctctatgagcaatgacctcaactgttcaccacattgtccccactatctcaagcaggtcatttatttattcattcattttatattaacttaccaaacagtttggggcctatgtgcctcatcttactttgactgacattggtcatagaaaaacacatagtcatagaatgttgtgattagtaggtaatcacaatatgaaaaaatatacatccaagatgaatcgtcagctctccctgaagggggtgacttccaagagggagaaaactttgaactgcctttgagctgatctgtctgtcaagctacctactgggttgatgttatatgagtgagtctgccgggctacccaggcaggtgaacaacatagggaaagaagaataaagcaacatgacatatttccagtaacatttaacaacaaaccacatttagacagatgggaagaaaactcagacaaaaacaaaaccaaacaataccacagtggttctcaaataatagaaggcaataatgtgggcaaggcagacagtctgtcatctgttgttacagagttgtttgtacataaaccttgtacgtcagcaccttattttttctaaaactaggctttggaactgcaaaacctgagggattaaaaacttggaatagtaggaaacaagccgacaatagtaagaatccaatcaccttgcacaatacaacgatatttcactctgcctgggaatgctttctcaggtgttatactgcccattgaacacgacttctacacggcacgtctgttgatcttgaactgttttctgtcccaactatgctttcttatatactcaccaacatgtcccaacaagtgtgtgacctttatttagtgcaggctagacattatattacatttcttatttcttccctgggcaaactctattcccctgaatatcaaggcacataactcactttgtccaatgtttcaacagaaaaaaatcaccagagaattttatacacagtatattaaacccaacttagaacataatgaaaaatgtaactttattctagtctcagagtctctccataaactttactcagtgggggttaacttccgttcttcctccatgaatacatggctggccccgtgcgtgttcagcatattcttggacagtatacattctttcagtcgttttaagaaacaacatagtcaccattcagcaaataaacttccagtacacgactacattaaaaaatagaagtagctataaaagaaaatatttcttctctctgtagctcaggtccgtgtgttaaagaaagcctaagctctctcccttcttttaatccctatcactgtctgcttttttttttttttttctgaggcagagtcttactctgtcacccaggctgcagtgcagtagtgccatctaggctcactgcaacctccgcctcctgggttcaagtgatcctcctatcacagcctcccaagtagctgggactacaggtgtgcactaccacgagcatgcctggctaatttttcgtatttttatatgaaatgggttttcactatttttgcccaggatggtcttgagctccttggctcaagtgacaggccctcctagacctcccgtactgctgggattgcaggtgtgatccactgcatcctgcctttaactagttttatcttgcattggttatttattgtttgagcaatgagttacccccacatttagtaggttactacaagaaagattaattttctcattgtttctgtgggtcgcctgcaaactgagcatggcttccctttatcctctagttctaggtcagggtctctcacaaggccataatgaagatataacctaggctactatcctctcaagtactggattgacaaggggaggattcacttccatactcactttgtggctgttggcaggcctcaaatcctcactggctattggtcagataaatcagttctttgccatatggacctctttacagggcagatcacaatgtgatatctggcttctctcaccacaaacaggtaagagagcagagcctgaaatgtaagcatggactctttaacctaatctcaggagtgacattccactactctgtagtgttttactccttggtagccagttattaagcccagcagaatctcaaggtgaaggaatatgacagcctgaatactaggagatgaggataaccagggaacatcatagaggctgccagccacaatctctgtggaccaggaagcttttaaaagttgattctttgcctagttttgatcctttatgatctttgggaaattcctgttgctggagacgtctcacctctggttaccttaatcaggcaatgagtctatatttcggtggtcatttagatttctcccttagcctttgggccaaaaggtggcaataatcttcttataacctaaaacaacctctctcctcctagtagtgtatacatggtgcactgaaaaaaatctatatcccttacctttacagatggtaggagtacaaactgatgccagcacagcaactctccaacttatatagtattaaaaatgagcatttacatatgatgccatataatttagtgtttggatctcctactcccctgccacccatttgtgcactctgtgctcttatttcttatggtaaaacaatcctgtatttcaagtaaacaaacttaatcagtttaatatagaaacaaatactctaggaaaattaagttttattataaacatattaatgaaaatcaaaataatttaaaatataataatggctttcagagaaaagtgtttttgctttcctttattatttttgctaatagtcataaaaagataaggaagttagccaataatgttatcagaaaacacagcaaagcttttagatgcccttaaactgtcaccaaaatcaagtgtaatttactttcttttatgtattactagcaatacttatgtcacatttttcagtgttcccatactatcagggaatgtgtatattccactgagctctgattatttggtagtggtgttacattttaacatagtatggccataaagttgtactaaaaaatagcgaattttttttattctgtatgaggaaataagctatttctccattcttttatctaaacacttgataacataggataaacattaacccttcaattaactaaatataacaattggcaaagaattcacgttaggaaaggtacaaagcagtaaatctacagattgttggtcctaggatatatagctcttctggtaattacagaagtctgtagtatttcttaatttttcagcacagttgataaagataatatggatagacactcaaattgtttttattttacttcgaagatcagcacatttttgaacatttagaaaataccagatttctctggcatgtaatttctctatttaaggataaaaaatctgatgaactctcaagtccctattaccttaaattccaaaattgttttaaaaatgttgagctagttacttcttgaggaaggagaaagaacaaaataagtatattcataaaccttctctattaaagttacacagactttaaagaaaacgtcaccctttgtcagatggatagagtgctaaaattttatcccattctataagttgcctgctcactatgataatagttccttttgctgtgcagaagctttttagtttaatcagatcccatttatctattttggcttttgttgctattgcttgtggtgttttcatcaggaagtccttgcccatgcctatgtcctgaatggtattgcctaggttttcttctagggtttttaaggttttaggtctttcgtttaagtctttaatctctcttgagttaatttttgtataaagtgtaatgaagtggtccagttttagctttctgcatatggctagccagttttaccaacatcatttattaaatagggaatcctttccccattgcttgtttttgtcaggtttgtcaaagatcagatggttgtagatgtgtggcattatttctgaggcctctgttctgttctattggtctatatctgttttggtaccagtaccgtgctgtttttgttactgtagccttgtagtatagtttgaagttaggtagcgtgatccctccagctttcttcttttttattaggattgtcttggctatgcagactcttttttggttccatatgaaaccaaatttaaagtatgaaatttaaagtagtttgtttccaattctgtgaagaaagtcaatggtaatttgatggggatagcactgaatctataaattattttgggcagtatggccattttcacagtgttgatttttcctatccatgagcatggaatgtttttccatttgtttgtttcctctcttacttccttgagcagtggtttgtagttctccttgaagaggtccttcacatcccttgtaagttgtatttctaagtattttattctctttgtagcatttgtgaatgagagttcactcataatttggctctctgtttgtctgttattggtgtataggaatgcatgtgatttttgcacattgattttgtattctaaaaaaaacaaccccatcaaaaagtgggcaaaggatatgaacagacacttctcaaaagaagacatttatgtagccaacaaacatatgaaaaagagttcatcatcactggtcattagagaaaagcaaatcaaaaccacaatgagataccatcttatgccagttagaatggcgattattaaaaagtcaggaaacaggccaggtgtggtggctcacgcctgtaatctcagcactttgggaggccgaggcgggtggatcatgaagtcaggagatcgagaccatcctggctaacatggtgaaaccctgtctctactaaaaaatacaaaaaattagccaggcgtggtggtgggcacctgtagtcccagctactcgggaggctgaggcaggagaatggcgtgaacccaggaggcggagcttagagtgagctgagattgtgccactgcactccagcctgggtgacagagtgagactctgtctcaaaagaaaaaaaaaaggtcaggaaacaacagatactggagaggatgtggagaaataggaatgctttcacactcttggtgggagtgtaaatttgttcaaccattgtagaagacagtgtggcgattcctcaaggatctagaactagaaataccatttgacccagcaatcccattactgggtatatacccgaaggattataaatcattctatgataaagacacatgcacacatatgtttattgggttactattcacaatagcaaaaacttggaaccaacccaaatgtccatcaatgatagactggataaagaaaatgtggcacatatacaccatggaatactatgcaactgtaaaaaaggatgagttcatgtcctttgcaggaacatggatgaagatggaaaccatcattctctgcaagctaacacaggaacagaaaaccaaacaccgcatgttgtcactcataagtgggagttgaacaatgagaacacatggacacagggaggggaacatcacacagcggggcctgtctgggggtgggtggctaggggagggatagcattaggagaaatacctaatgtagatgatgggttgatgggtgcagcataccaccatggcacatgtatacctatttaacaaacctgcacattctgcacatgtaccttagaacttaaagtataattatatatatagtatatatacatacatacgtatatacatgtatatatattacatatctgtcctcattagttggaatacagcaggctttactagtgtatctgaagtaaggaggaaccaggaagtgagctgttttgtaatggagaccagttatatctaacagagggcaacagtgtctataagactgtagcctattggatgggaagctatcttatgcaaatatgatgaatcttttaaattctgagttcaatgcagtctacagctaaactcaaatcccggctcatactaaccttggtccttgggcatgtttatgcttcagttttctcatctgtacatgggttaataacaatactcagcttgacagtaaccatactgcacagtgcctaacacatgtaagtgctcaattaacgtccatttctactttctgaaaatatatggtattagtgtgcaaaaagttgggctacataactcaaatctcctttgtatcttaggtaagaccgcttctttctctggattgtttcttctagtcaaatgcacaggaatttagttgatctcccaagttattttggaccttaaattctgttttattcttgttcattttctatgtagtttagatttagttcattggactgatttatgttctgtgttcttttaaaattcaggaagatgtgtataggatagatagagcaaatatataaacactcaatttcatttactttaatataaaaactaacaagtttctcattagttataataaccttaaaattgatgtgtttgggaagcaacctgcatagtcattaaaagcaggagttacagaatcacaaaaaaaaaaaaagaaagaaaacatcactaacaatgaaagcagtaactaataaatataagttgtttttaattgtgcaaacaatttgagatttgaaaagtatttctggaccaagatggtgacagaaattttagggcatcagtttggtcttgaagtttaacaagatttaattgtcagaagtatactgtaaagtgtattctttttcttcttcccctcttccaaaccacaataatgtaaagggtatgtggttattatcagtaagaacaattagaccagaattcatcagaatggatatcatattaattctgtcctggttaactgtgataatttaagtctttgtgtattttcacttgttcaatgagtcactgggtattttaacaatgaaaaatcggtcggaacagtgttacactgagaataagcactcttgaaatgcccaatacttttgaaataatgaatacctgttgttaggtaagaaattaataattattaagttcaataactcatctccttttagaaagtcccactgtatctgttataaaattttaagaaattttcgaggtcggcgaatttacaaggagctgtatttatggcatctttctggatcctacttttgcattctatctttctggttaagttcattagggtttccagcagtggttatcttggatctgaaacattgtcagagatcatatgaaaacctgaaactgtaaaataagggtaaaggaatggtagcgattgtaaaattaagaacaaaaatcagatttcacacaacagaatttgaaagcttgaaataatagagaattttcagtgtttcaataaataaataaaatattattagtgaagggaattaagagtttgatattatcttgatgaattcaaggtagctgaaattagcaaatctgattttgtttgcatactgatagtgtatcatctagtgggagaatcaggtgaactaaattctcagagactgatgtataaatcaaagtataaaaatattgtgttggtaacttacagggcactgcttagatttcttttttctcacaattctctcttaatgagatcttgcagaatggcgaacttctcacattttttgactggcatattccttctttaaacttgttaataccattacttaggttagtgtcaactgtcactggtttcaaggagtcttacaatctctgaaagttgacatttcagatttctaacttaattcattgagttgtagttaaactcatatgaggggaactttaattcttaacatgtagttaaacttatatgaggggagctttaattcttaacattaacctctcaaatgtgggtcactatgtacaaatgatgaaaactaactcatgttttaaatgatagcaatatgaatggcaaaagactaccttagcatatttttaataaaaactgctattgtgctcaaaactcctgaaaaaatcacattttacataatcagtaatgaaatagttaatatttctattatgaaatattctgatgtgtgaagaattgtactgagtagagccctaacttctacttggttggtgcaaaagtaactgtggtttttggcattactttagtgacaaaaatatacacacatatatattttgttgttgttgtttgtttgcttgttttttgagacatagtctctctgtgtcacccaggctggagtgcaatggcgtggtctcgactcactgcaacctctgcctcccaggttcacaccattctcctgcctcagcctcctgagtagctgggactacaggtgcccgccaccatgcctggctaatttttttgtatttttagtagagacggggtttcaccgtgttagccaggatggtctcaatcttctgacctcgtgatctgcctgccttagcctcccaaaatgctgggattacaggcatgagccactgcacccggccgaaatatacatcttaaaatatatattttaaataatatattttaaatctctctctctctctctctctctctctttctctctctctctctctctctctctatatatatatatatatatacacctatttaacaaacctgcacattctgcacatgtaccttagaacttaaagtataattttatatatatgtgtatatatacatacatacatatatacatgtatatatattacatatctgtcctcattagttggaatacagcaggctttactagtgtctctgaagtaaggaggaaccaggaagtgagctgttttgtaatggagaccagttatatctaatagagagaatcagtgtctataagactgtagcctattggatgggaagctatcttatgcaaacatgatgaatcttttctctctctctctctctatatatatatatatatttctatctctatatttctatctctctctctatatatctatatatatatgcatatatatatgcatatatatatagatatatagagagagagatagagagataaaatgagaaattacattcctagcaactattttagctcattaagacctatgtgaataaatcattgatatttttacatgaaagagaccataccataactttacttcactagatattaggccaagtagccactcttgaaaaaagagcaggcaggcaacaaagagaccagtattgcttactattgcagtaatacagtcatgagattatgagggcctatactttagctgccaattaggaggacatattttagaggagtgaaaaaagaaacaatagtttgagtgtctgattatagaagataaatatttttcccagcagataattcctttatctttgctaggcaagatatcaaggtctgttaatgaataagattaactagcataagagacttgagtataatgacaaagtttcttttatacctattgactgaaaatgaattatggatttagcaattaagtgtttgttggtaactttcaagatcattcagaaatcaaactgcagtttataaagcccagagttaagtgattttaacaatttgatacttgctgattgaccttctaccaggttttagataccattaacatatagagtaaaagagataatccttgccctcaataaacttatagatcataaggaagagatacagacacataaatggtgcaatacgtcatataaaacattacacaatggtgaaaatgtaggaaagagtagagagcacaaagtcagtctgcaatggcttcacagactatggccaaaccatctctaaaaggagaaatacaaattcatctctagaataaggggtggaagggagtttatttccgaaagtgtgatagtaggttcacagaacacataggtttatgtaaaagagcatggtgtgttttcttgaagatgaagtttaaaatgaggagtgatgtgatcaaatatcaaacatgtaattggaatctgcttatcataggtatgcaagagatagaacaatgagaacagttggacacaggaaggggaacatcaaacaccggggcctgtcgtggggtggggggagcggggagggaatagcattagaagatatacctaatgtaaatgatgagttaatgggtgcagcacaccaacatggcacatgtatacatatgtaacaaacctgcacgttgtgcacatgtaccctagaacttaaagtataattaaaaatatatatatataaaaataaaaaaagacaaatgtctctacccttaagtagtttatagttataagtgaagaaaaccttacatgaaaaagtaatgaagaaagtgatagtacaacaagcagtatagtagaagactactgtcttctaaatttccaaaattatttagataactgcagaaaaccaacaagtatttctcaatcttaacaaacctcactcatcaagactttaatcccaaaatgatcctttgatttagacatggagaaagcttcgtagagtttatacaaattgttagaatttgacatcttcagtttatttctcattaggcattgcacaatcttcaagaacagaaacttagaaacgttgttatatctttggaagatatttagcaatttatatattacatttgaaaagaatgggatctcgatgaggtaagatacttttagtttaaaaagcatcttttttttttccaaaaacacttagctaaaggacactattgtccattacgtttgcaaaagagatatttcagaaccacgttcaaatataggaaagaagaaatcttttttaaagaatgtagaataagcatttataaggaataaatgttcaaattgatctgcagtaaagttaaagtgatattagttttgcatcagtcatctatattaatgttgaaaaatcaaagagaaaataggagattttgttattgttgcttaagcaaccataagcattctggttatttaagtcactgtttcttgtacatactttctgagagtaacttgaaagtttttacaaggtgcataagtgatcatttaaatgtattcaagtaataatcatgtagatgataacctcatggcctggaagagattatggcaaccttgtgtatgcttcaggacatttgtgatcatggcaaggtatcattagtgtcctggacatttaaaatatgcagtgtatatcctaaagattcacattggaagctttctgggcattgattatgttatggctttaggacactcagaaaagattttaattaaataaatgctaatgaagattgagagaaaatagctcataatttaagctagtgcactcccttatagttatcaagaaactgtttcttgcatctagctccctgtgttatatttttgtgtaggccatgaagatagatgaacagtgatatttctgggatgctgctgctcataaggcactatacgcaagctggagaaaatctggcagagtgcagaatcgactatgtctaattctgtttcatgtatatagatatctcataattcaaaggttctacaggcaaccccgcagatagacagtaaactcttgccttttgtctagttggccttggtctatgttccctctttatcttttgtcttcatctctctttttgctcctaatactgctttggcttcctggtgcatctgctcatgtggtatctgcctagtttccctcagttttatggttttactcctttgtattatgacagcttaatatttctatatatgtatctatgtatgtattaatttatttttgagaccaaaataactttgctttcatccagttaacaaaggagctttagatattatagaagtttttcacattcccttttatagtaaagaaagaaatattgccatgaaacagaagacaaacaacaggggacatttaaatgtttgggaaaaatatgggggtaataattcaaatataaatacaggcttaaaacttacttttattaacctcactttgcccttggcatcttgtactttgaactggggcctgtccagcatctttctcatttcccactccagcgttacagaccaaaataccattctgtaaatgatttctgcctaccaattgataatacgaaactttattctctcacacttacttttcccactgtgtgtgtgtttataaacattctgaagaaatgaagatcattaaaatgaactgtatgccatgagtagttattttctaagccaagtatttatgggggctgtataatgttctaatgtttaaaatacagtatgatagcagtaaaatcaataattgagttgagtgggattaatcccccaaagtctttaaaaaaatgttataattgataagaatgtcaaccaaagatagaaacacttgtagaatgcttggaagtctcctagaatataaggtcattaatagaaaatgaactgaatatttgttgtgtatttgaatccaggtaataaacatttattttcaggaactttatatccataaatcacatcttcctataaccatgaaatgctcttctagtgttttcagtttctcacctgctcctctttccctcatgatattacattttttgcacatttaagccatgaccagtgatgaccaataacaatctctgtcggtcgttcttcaggcatctggcatctagcttttggaataaaaatgccaggattcccccactgaatttcttttaaagttcacattcttcttttacctaaagggcaatgtagagaaaaatagtgtaagatttcaagataaaagtgaaagctgaaggaatttcaacagagaagattctcataaccatcttagccaccttgttgtatgtatataaaaagtttagaaagtttacagaaacaaatttaattacatttcaaattctttttagtatctgaaagaatattctcatatattattctgtactcgtattttaatcagagtagttttcagtcaacaatccactgatcctcttttctcttcctgtaaggaaacacttccccatcttgccaactctaccttgtattggcaagtgttgtttctaaatcagattctttttgaatgcactaagcaaccattttcatactaagttgccatttagctttgcttttatgccttatgtcttgtatggaagctattaaaatttagttgacttcataagaaatatatgcccatactgatacaaataaatgaataataaacaggaaagaagagacacatttcccaagcagaagaatcccaaataatttatgtggctactcctatctcaaagaaaaggggcacttgacatcagccatgtaatcaatgtggacattagtagtaataaatcatgttgatagtatggacacttaatatgataatgtgatgtgatgaaaatggcacatctcttatgtggtcttccttctaataacccataactccagtcctgtcatgagaaaaataccagattaataccaaaatgaaacatcctacaaaacagctaaccagtactcctcaaaactgacaaggttataaaaaaataaggaatgtgtgggaaactgccacatccaagaggagcataaagagatattccagctaaatggagtatggtagcctggttggaattctggcacagaaaaaagacattaagtaaaagctatggagaccaaaataaactgtgaactttagttaacaataatgtgtcaatattggttcatcaattataacaaatgtattatactgatataagatgttaataatagcagaaactgactataggatatatgggatttttctactgtcctcttgatttttctataaatctaaactaaatatttagttgctgatgtactgttatatttggactgcagtgccattataccatcctttttttttactgtattcttacaagaaactggcattgctggcaataattcacttaatctctccacacatatatacacatacctcaaaaatcagaattattgtacttatcatagaattgtgaataaatttaatcagttcaaaatgatatttaacaacattagtccagtgttcctggaagcaagcattcacttcttcccacatggccaaatctttgttcattttctctagatggctagagaaactatctcttccattgattcctaacaccaagcacatgttacagttgaccccaggtagatgaatactctaatttctcccctaggtcactctgatgacttaaaaaacaaacaaacaaacaaaaaaaacactcatctaaggaaaaaaataagactctgagacctaagattgttttctaagccagttcaaaggtgaagttctgggtgttgaaggctccagggagagaaatggagtatatttttggaaactggaaattaaaatcacaaagtatattgatggcccataggctaacaggtcaaacagtgtgggttttccagtaaagggtctttgctgaatatgttagttgccccactcaggatgacggtgcccctgttgtcatttttagtaagtcacgtgtgccccactgtcagctggctagcagctcatgtcagatttcagcatctgggtgccagccagtctctattgttctgaatttttggcgcatacaggaagcactcattgtcatttcatgaggaggagtgcagtttttatcctttctctggttttcagctcttttctgctttatagcatacctatgcctttctaatttctttagttttccctccgtttttcagtgagggtcctagtctgcctggagagtcaggtacctgattctcttctcaggataccttctcaggtatctggttccctctctgtgggacttctgaacaaacttccgtctgtggcaaatcactgacttctgaaaatcacagttatttgacctaatgcttaaaagtgaatgaggaacttttcccttttcaaaaatgcttccttcgccccaaacccccataaaaattatttgtgtgaaagtaaagctgcagaaaatgttcctgtccacttattataaaattttcatctggataggtacataggataaaggagatacaaattacagcaagataggctagggaagagaaagcaaatccctaatttttttcttaatggagacttagactctatactttttgttaaagggaaagacagtagttgtaagttttatggtccaggcagccttgacatttccttttccggagcatgattttatctgaatatagttaagaatgtaataggaagaaggtttcaattcactaggacctagtatggcaaggaaaacacagagttattgagacaaatgttaaatatggcccctgggtttattaaaaggctttgatttccttggtggcctctgcttcagagcaagctctagcattctaaagtagaattcatctgggtgaatatgtccatattagaaggacaagttaaacagaataacatctctaataatactaaattattaaagcaataaaataatgggaattaagggctccacaaagcattatagaatgatatgtttcttcagattctgcactcttttattatagcatgtaaattattattctgttttaaaataagttatgaatttcaaaataatacattaacagtatggttttgccacctaacagcattctcatttatttatgtaacaaataaaaatgcaagaccctcataaacataattaaatatcaaattttctaggatatgtgcacgcagattcagttatgtccaaaataatgaaacattataatttttatgtattcacttttgactctctgttttctttgttcttttactaattacaattcaaaatattatttcattgatttgaacttcattagtttaaacttaacaaatgtgagtctgaaattatcccccccccaaaaaaattaatgcattaacacaaactttaggccacaatttttgtccaaagggaaaagtttccagcagaataaaataattaaatatatatttattgctattttaagaaaacagtgtttttttggaagtatatcaagggaacccagggaaatgaaaaatatttgttacttataaatggtataattaaaaatatttttcttccaattttttttgctcactaatataaatatatgtgattatcatagttattttacattttcttagcaaataatgctacacataaccaaaggtagtatttcaaaatgctacagtcttactcaatagagttccatgtttccaacccagagttcttatctttctatttatgctctgttaatcactagtaattactgcactttcttttcctatgttattattggtagaataaatttctgtgcatttaaaaaggccaagtacaagtgacattttatattaaagagcattcttcctgaaggtacaatgcatgatttcaacaaattatactgtagtaaatatttttaagttgttttatcttaatccagtcctagaaatatgtgtttattgttttctgaaagcaaagagaccattactggaaaacaaaaattgtctacatggtcttagtagctaacaatgtatagccctgcaaattgcagaagttcagtttggtagtggcatcttcatttaatattgttgcaatagccagtcaaccattaaataaaagttcctgaaatcctggtatctcctcttattcttttatttttaattaaagctgcagagagtcattgactgaaatgtcttctatcctcgttgcttttttaaaaaaatttacctcagtcttttatactcctccttaatcatgaatgcaaataaaattcaaagtgtaatcagcagctgctgaaagagagcactgagcaaactgggttgccgtggaaaccatgaagtcagtccttgaccagacaaagaataatacctggtgtgtgtgtgtgtgtgtgtgtgtgtgtgtgtgtgtgtgtgtgtggtgtatgtgtgtgcacatgcttaccaacaatttgcaaagaacaactaaaaatgtttcaaggtttattttccccaaactaaattgttcatttttagatatttacattacagatgaatgaatacattcgactattaaatttgtaagcaattgcctctcatttgagactggatagtcctgtcctagatgaagctacaggtatgacaaaagtactatcaaattgaactgagcacaataaatattgaaagccttccactgcaaacaaataaataattaacacaattatttggtctattatagctgtcattatccttgctttcacttctccaacaggcgttgcagcattttaattgtattttctcctgggaaagaattatctcctgctttaagctgctgggggaaagtattgttaagctttttaaatgctgaatataaaggtcataccactgagggattttcagctgtgagtaaacaaattcagaggaaatagtgctccacatcactcttattcaacacaaatgtagttttagactgactgcctcaatgtttgaggatcttaatttggcatgtgtaatgaccattgctagtaatagtatgatcggagcccaaaattattaaaactcattaataggcacatataaaaataaggaatcgttcaattctgcagctgtagttttattctacattgtaaataccttgggggagaaacgcattactgattaagaagaaataaaagcagttgcttttgctggtagagactctgaatttaagtttgggacatatggacagatcatataccaaatgccaaagcactgaaaaagtgtttcatctttccctctgtccccctttgccaagaggcaaagatggtagcattctttttgcacatgtcacctcagacctagacaatggctctttttttgtttcctttttatcagatgctctcttcatcaagtgtgcaagataggtcattgtgattccctcaactttacagctgagaaaaaacataagcattgaaaagttcggtaacttgtctgagatcgctgaagaagctattgatggggaagaatttagaatttaattctgaaaggagtatctttccatggttttacatttttcctgacttaatgaatctggaattatgtggggttgggaagaagatcactaattgattgaagttagcatatagaaatactattcttactgagctgtaacctgaaatgtttcgttaaaactgtacatgctgccacaactaacaaagagcaagagagaatgtggtcagcaatttctttgcctttttttcccgagttttcttttgcttgtttgtccagtttttttttctatctcattattttgtaggtagtgtttttgctttcatatctgtactttattgttatatcagtcactttccctgatctgtcttgaacaatcattgcaaattcattttgttctaatttgctttacttggcaattacgttaaaaatggcaaagtattatttttgtcagtctagaatataatcaacttattttatctgagtttttaaacagattatgaatatttctggagctttattgtttatatcacaagtcaatttctttggacttacatcattataataaaatataaaaatagttaaaaacatgaaaaattactgtgatgatggaacttatatcagattggccaagtttctcatctaagtacacttctactgtattcatcactatctgcttcatggagagggcagctgtttgtagcacacttacgcaactttaattgataggcagtcatgtatcacttaatgatgggatatgttctgagacgtgcatctttaggtgattttgtagttgtaggaacagtataaagtctatttacacaaacctacgtggtatagcccattattgccagggttatatggtggagactattattcctaggctaaaaacctatacagcacattactgtgctgaatactgaataatgtaggcaattgtaacacaatgataagcacttgtgtatctaaacatatctatatgtagaaaagtaaaatacagtaaaaatacagtattacaatgttacgggtcaaccactatcagaaatgtcactggttgagatgttagtggcatgactgtatatggcaatatacaatgacaattcttttaatatttaagttactatgattctgagcctgattctctgaattttaaaaagtttactcttctccttggcagccctcatcagatactccagaggaactccaaggcagtttcttcattccaaagggattagtctcagtttctattctggagtgtcccatcagtcatcctaagcgttttattcttaattttgcagttaatcagtgctgcatagggccacacaaaatttagggctgtcttagcagtgtggcaaagaagtttatttacctttactgtttccactgtcctagcagtgtctcacatatgtcagaggatatagcatcaggtaccatcggtggaagaaatgtactcccctaccaaatttttataggtagtggcacactcgcctcccactctactattactgaagcaagttctacagcaataagcaatcacagtagtcaatatcaatggttcttaaagcgttgtcccagagcagcagcatcacctggagatttgtcgaaactattaataccgggcaccttcccagatatgttatgtgagaaacactagtggtcaacaccaagaatatgtgtattactgagccctttagatgattctgatgcatgccaaagtttgggaatgatttgtctatgttgcattttttgaagtcttgttttgtgattattcataataagtgtgtatgtgtatgcatgtgaatttaagtgtgtgttctcgtgtgcacatgttggtgttcgtaggctgtggtcaccaacagttctgtctagttttttctggatacctaccttttctctccttcgaaggcacagacttatcaaagtctcattgaatactgaagggaataaatgaagacttagcttcccactgtgcactggcatgcattttaaagaaaaggttactttttcttagaaaaattggtgttaagagtcatatttgcatagctaaagagaacctcaaggtgacttaaccaaaacaaagataatgatgacttgacctcaaataacgaaatgccagcaatttaatctgctatagcacattaacttaatgtgagttagagagctatagctgtataaaaaggagtagaggagactggataatactgggaaaggagcaaagtcatggatgcttacacaacaaacacatggatgcttaccaagatcaattaacaatatgttatattccttttttgtgccacactctgcccatgtggatttctttttgaagttttgcatctcaatctattcaaaatatctcataactcttcactgccagataattccacaatttcatcctgcagtataggacctaattgctactactgtccaacagacccccaaggcagtgttagccatatattaaaagcattttttgtttgttttatgttatacagaataaatttttattaatggcctcaaattgttacctgaaagaggcagatggcaaactaaaccattttttcaaaattcctcatagaaatgctaaatgaaacaaacaagcaaagtatggatttttattaaaactatgaaaaaaattttaataactgaattatagcattcgcaaaaattaagatatgttaaaacaatggaaatttgaacttatttgtaattttattttatagaacttttggtagtatttttatattattgtaatattgtttaaagaaaaaaaaaactagcacagtaggaaataagtttaagggattattttgccagtctttctctgttagattgaataataaacttgccattcaggaaagtcattgtatatttgtataccatttgtgtccagcctggtttatatttgctgatttgttgacaaatttggagcatgtggtaaacttttctatcccaagacaaggactgcacacttcaatttaaatctcagattcaaataagtggcactctttatatttaaatgtaagcacatgctataccagttttataatgttaccacctcttccctgctttggtagagtctcttcaatattagctgattttatccattgttaagatggtgttttcaaagaagataaaaatgcattttgaatatggaaatataatttttcacattcctttgaaatctggaagagaaatgtagtaaggaatcaagttgattgaaaaaaaatcaaaagaaaataacaagtttaaaaatccaggatcataagaagaaaaaagacatttaatcttacaactagatattttaaaaatagataaaacaatgccttattttcaccttcattctatcattttcagccttttttacacacatggggacaagtactatgtcactgactattatctaatattgtgataatttttcttatcacaatgccaagttatcatccacatagtgaaaaacagatataaccttcttatggtttgatatgttaatgagttttaatatatactttaatcctttatttacatgtaagatggtaaagatgcagtttcatagtatcttttgttcctctttttcaattatttctgcaaagtaaagtgtaggttttttgaactatacccagaagagtaggctggaatcatgagaccttactgcacaaagttccacccctctctctgtggtctagcagtgatgaggttgctaggttgacaaagcagtgctgggttttccacactattatgtttcattcataggttcttcacttgcccacagaggttaaaaactaactttaaaaatgataatagatatacctaatgctagatgacgagttactgggtgcagtgcaccagcatggcacatgtatacatatgtaactaacctgcacattgtgcacatgtaccctaaaacttaaagtataattaaacaacaacaacaacaacaaaaacatataaaaaatgataataaattggatagcctaccaaatcaaaacttagtatttcttgtaagttttttcctcatgaagaaaaatataatacatttgacttaaaacaacctgaaagccttgaataattcactctaaattccaaattattttattgaacaaattgatttctactgttatatttgtctctggaagtaaaaaaacaaaaagcataaagtgtgttcttttgggtagcatgatcttaggacttttatatttaatttgcttacaaatacaagaatatgtatccgctgaaatttcttgctactatttagctacagtctgtccttgtaactcatttacaaactaaactcctttccaatagtattatgaaagaaccccctttatgctcccctcatctccaaaagtcaccttttgaattcacactcttagtttacgacatgctgcttttctgaattctttgctgccttaatgatgccatcatcttctgaactcattaaggtcccacataggtttctgtgtgttgcagtgacatctttatctcttagagcagtttggaaacctgcaggggtgtagaattgctacatatggactgttatgcaaactgagtatatcaagcctcacccaaactgaaaaggaaaagtattttgaaacataaaagaaacatatgttcgagttatagatgttgtttaatggaggtcagatctgcacattgattgttttctatcagcagcttagaggtagctgaccatggggatttatttatgagcttaagaggtctggaggaagaaccacactgatcattcacttgattataaagctcctgttctcaaaggaaataatagtgatcagaatcagccactgcgtgattgaagtaggaatataaatgaaggaacatggatttcactttaatgctgcatagactagaaaaaaaaataaatgaaagagtagcatatctgaagattccactaagcctgaaacaaggtcttctaatgcaataatctgaactttctaagtaaacaatgaggagaacccagattctaccaccctcaatttctaactaccctttttcaattataattaccttttttatttctaacttattgttcattaataagagtattaatttccagttatattcgtgcatgataaatatatgtttctcattgatttcaaactattgggtaaattacttttctaaggccaaatacagtgacagtgaagaaagcacagaatttcttgccctcaagtttctcacctattgcttagctactgaatcttgctgtgtttgcaatagttttaattcatgcattctacaggtaagataattagaatcaggtcattcctttcttttaaattttgccagattaaacacaagtatctgccacgaggatcattataatagaaaattgttctgagtttaatattctggacagaattttataaatccgaagtaaaaatgtttttcaattttataaaatattggtaatgagaataagcatgcaaataaaaacaagaaggaattaaaggacatacagctctatataattgaagagaaacttgcgaagagaccaaaagaaactggaaaagtgactgaagtgtgtgagtgtgtatgtgtgtctgtgtgtgtgtgtgtgtgtgtgtgttagaaagacagagatttcttagacatcttagtatatttggtcaatgtcaattacgacttcccaatatagaaatgggattacttatgcttgacaggtacatatttcagtgtccctgtttcagttagtaaagcttttaacaaaaagaaacataatgtgacctacagtcacataaaatgtaagagcatgtattatttagaagaaaaagtcgagagacacttggttccagaattctttgaattttttgttgttgttgttcattccctgatggtcacaaaatggctgcagcagcatcataactcacatgctaacatgactatgtttcaaagcaagaagaagatgagggtggccaggaaaaataaaaaagacataaagtaaaacatctctacgtatgcgttattgattttatcaggactgctaaccttgaggagggcttccttaagtctcattgactacaactgtgtcaatgaactcccctagcctcaaactagtctgggaagaagagtatttgtttattttagcctcagaagtgggaaacgggcaagggaaaagaatggaaggggaaaacattataatattcaatgaacagcacccgccagaattcttatctgcatttaatattaagtttatatttcaggtatgcagtgagctcaggtaggattgctaggcaattccgtcaaagtttcatttcttgtcaagatgagtgtgttcaaagatgatttttactcaattcgtcattcccctccatttttaggaagtaaaatgacattaaaagttgatgcaaatagtcatgctgtaaaattcagactttactgactttttttcattgtatatgttataccttcagttttattcttcaattttccccaaaataaagaaggatgttagtgtgcttcagtgaatcttgtgcattgaattgccagattcagtgaagtttacttaaaaccctgtgtggattattaaaatttaataatatgaataactggaataataaactaacaacaaaagctagatttaacttcatcttttctcaagcactcttaatacagtgtgcattaatttaaagaatcttcaagaagccaatttttctgaatatttgctgaccagtatgaataaattactaggggtcatagctatactttacagtaaagtgactatatttattaaactttgctcagcaattgcttttatgagaaattttaaatatttttctattttttcactattttcctactcattcactttagaattgggaatgtctatattcatcaccatttgtttttatttggacttagttcaactactaagaggcaatgagtttgccaaagaaatcgtggcttttttttagttgtccttccacaccattgaaattggtaatcagtaagctctctgctatgtgtgccgttattgcttaaatcactgtttaaggtagaatacttgttctacttcaggaaatagaaaagttctccaaactctcaatttttaagttgaactaacttttcttcctattacatactgaattttcttaaggcatcatatatgtacatttttaatgtttaaaaatatttttaagttatataattctaaaattattttaaatatcctaattaaaagtatctttcatttggctcattccaaataaatgcttttctttacccagtaaatttaatgcaatttcagtatattaaaataactgcattataaaagaaattgttactacttggttgcctttgtatcagaatgctagtaatacttcagcaaaacaggtgtgtattcaatctgttctgacgctgtataaccatttgcattgcacttgatcacatagtagaaagaagccaccttgcaaaatttcaccaaaaagtaaattctatctctagaaacaccaggagctcttagtaatttgagcttgctgaggggcaagtatgtataatgtaaatgtatcaatcaggttaatgcaaggagcactcttccatttgataacatttgaaatgcatggcagaaatacagaaacataattaaggcaaatgagtataaaatgttaatattccaatctggaagagaaaaaggtttcaagatttctccaacttttattgaagtctgaaatgagaaattcaaattatttggacaaatgagttgtttcatttcagacaaagggagagttcctaaattcaacatgactgacattttggactggatgcttctttgttgtgtgggcatcctatgcattgtaagatgtttgacagcaattccatcatgctcactagtggccagtaacatgcttctcagtcctgatgcattaaaaaatgtatgcagatattgtcaagtgtcacctgggggagcaaaattgctcctagttaagagccactggactaattgttgaatcaaattattttcaattttatgatgattgatttggacactttatgtattgttatgaaatatgttaacagtactatgtttttcattctatggatatgccaaatattagtttaacgtttttctgttaagaaagacattctaattaaacatatgttctatgccatatacaaagataaatgaaacataattctattactcaaaaagctttaaactttcctcactgtattttccaaatacagtgatctttaaaaaaaaaaaagtattctgagaagtatgtttttaaactatcaccttattactggataaaacaaggtcattaaatatataatcctgataccaattatattgatagtttctttttcaaattatctagaccactatcatctttactattttttacctgagttcattgtgcccacagactattttttttaatgtactcctttctcagagattttttttgtctgcttatagtttaaattaagatcaacaaaaagtttatgtttagtcaaagctcagctagatattttcatggagagagtttgctttggcatgaaatgctgtcgtttactggaaaacctccctgcgtgtgtaatttgacagcattttagactccccagttaatgaggttagcagcagcctctatcctctgggtctagtcaaactgaagctgtctcaatgtagattgtcatagctatgttgattcatttgcttttttggaaaaataaaaaattggacttttcaaatggtaaggaaatattctcctccgggtcctcccacatgtgcagatagtaggtttctgactgcctgctatattctgataaagtatttgtgtttccatggaaggaaatgctaattagtatttccttgtcaattttctagatatttggaatgatatgtttttccaaaagtcacatattttaaatgctagtatcagcttctgtaggaaaacataattatataatgaaatggaatagcatttatgttaacttgatgataattgtaatttcacggggccataagtgctcatagaaatagccaaagaaggcaggaaggattagatcattcttaattctacaatatgtgacttttcaacacatatatttttacttttgctaacttttttcctaatgactttgttttagtttgtttttcaaaaataaatttacaaaattttgcagaagccaatttggctagttaatttaaatgcaagtttgaaagtatgttatgcaacaggtgaaataaaatgctattaaaggctgggtgtggtggctcccacctataatcccattactctgggaggccaaggcaggtggatcacctgaggtcaggagttcgagaccagactggccaaaatggtgaaaccccacttcacttagaaatataaaaatcagccagacgtggtggcatgtgcctgtaatcccagctactcaggaggctgaggcaggagaattgcttgaccctgagaggcggacgttgcagtgagccaaaattgcaccactgcactccaaccagggcaacagagcaagactccatctcaaaataaataaataaataaataaataaataaataaataaatagccattgtagaaatatctcttttaattttatatattcatcaggtttttcttgttttttttttttttttaatgcctaacaaataccttgaaatttcagggggttacaataaaattatttttcttatctgtgagtgggctgggatttttctgattcaggctatgaagggccagctcagatgggcttcacatgtctcttatttggggaccagcggctagatagaacatgcttttctgatagatagtagacgtaccagagacaaggccaaatcctggctactagcattccattgactatagtaagtcatatggccaagcttaaaatcaatggatagaaaaataaactccaacaattctagtgatgggcattgcaacataatatgccaaagggtattgacgtacaattctatgaaagaagaaagtgaaggctgggaactgcttgtaccataaagggctgaattatcaaagcagactagcaactcacaatactaaacagtggcatttagtaatgatgggtaaaaggcacaagtgaaaactaagcagagatacagcagtcttctctagaatattccccatcctgtctggtgcagctaccaaaagtatctttttccacactagaacacattttgctttttaaatgacagctaagcacccagaaagtgtatgacttcttagacacttggctaccacattgaggtagacactacctgacagcttctattctccagtcaagtgctttcgaggaatccgtaaatgccaggttaattcacaaatagggcttacttacactaagcaatctagttagactaagaatagcctcaacctcaaaaacattcttagataagagcacctgtcctgtggctcagctaggtaatacattagaatatttataagaggtctgattaaggtggacattgacccctcccaggaggaaatgaggcagttacagacttgctgttaattcttttattcccaggagctatataattcattctaacaaatatcacttttaaagggatttgagcttaaggttttctcatttacataacctctaaatcttatacatctaaatataaaatatgctgtatctttaacttgggaatataatttgataatatatttttagtggtaagaatttcagttattattttcttttcacattttatatttaccaaaatttcaaaataagatggagaatgaggaagaagaggaagagaagtaatctagcaattataaagttgtcctcatatccatacaaagatatgaagagaatcatatttgcttatctcttatataatgtcttttctggctagatggtaaagatagttgttgatacattcaccaaagagcgtcattagacatgtgttgtgcactagttatactccctgtgataatgtgaatacaacagtaagaaaatatcaaacattttctttgactctgattcctcctgattttttttgtcttaatcttttcattcatactcaagaaagtgaaactagagtttgtcaaagtcacttcagggctaaaaagagagatcatttccattatgtattattaaaataaacctttagatagttttaaagtcaattcaacatttttaaactcttgaaagggaacgaagttgaccttgactctataaaagtattttctgtattcaggaaaggaggcagtttccatgtcagtgccacttactaaaatagtataagaattgtttctgatttaattattctcatttagatcttcactatctttaaaagacaatttaaaattgcatatatctatgaataaaacaagttgcctgaaaatattttatcctaatataaaattatctgttgtgttgaagacattactatttaaagagagcaaacttattttagtgaggtattaattgtagtgagatggctgcattctgtttcaagactcttatctggtaacagtgatgtttgggctttcttacactctctttattttgaaatacaaaactttctcgggcgaaaggagaaattgaataaatagtactatgaaattcaacatatgggaagcatttgcagtttagaattataatgatatcattttaaccttaaataaaagagattgacactaagaggtgtgcatgttttcactcacatctgataattctgtatatgaaggattctgtttcacttaacaatttgatcatctttagcacaatccttaatgggttttgcatagggaattgtgtgcagaagatacatactttataacaatcaagttttacaataaactttaggagtatttactcagggcagcaaatctgcaattaatttctcctaactccttgtgaaccaatctcattttcctcccacttacacagcctatacatggatatactcaaatgtatagagtaaaacataagaaatgatcttggctgatacttaggatgtgactaatggttagctgtcaagtgtaaaaattgtggatgatagtgttgatttttctaataagcattttcatctttgggactaaatattttattttatatagttttgaattttgaaatgaaaaagtaactgtcttttaataactggaatcagagcttacatctttcaaaaattttaatgtttctaagtagacctgtaagcattaatatctcctttttgcagacaaataaactgaattgtacaagtattatttaggaagttatatatccaggctgaatttccgtattgattaaaaaatatttaaattcaagaattgtattttattcaccaaagcctaccgtgtagtttctaaatatattttgtttaaagttaaaggaattatcttttctcaatgtcccacaatatcagaaatttaagtaacataagaaatatatgtatgtgtatatattatatttaataatattccatgtttaacatattacgctgttaatgttacatttacatgttacaatgttaatggtatacactatataacagtaaaacttataacattaatttattaaaatataatatatataataacataatattaagttggtgcaaaagtaattgcagattttgctagttttgcaccaacctaatactatctatttatatatttttcttcttgtattttttccatcactacttacagataataaaatcaagaatgcctttttttgtgtgtaactctctcctatgcattttctttttctgctttgaaatagtaatgtgacctactgcttggagctttggaaataagatctaattttataattttatgaattacaatagaattataattttagaaatgtaaaataaatttataacagcatttactagctccttgccaggacatatactaaattcaagagcttctaccagtgtggattgtttctctctccacatttaccagcttttgtctaggctttttcttccatgttgtttctccttaataggcaagcacaaagtcaggacagagtaggtgacactgcatgggtttcatcaaggtagaaagcatccttgtgaattactaactaaaagattgggtttaaccaaatttccagatctttttgcttgaaccagagattattgtgtttcacatctaaaacttgaaaggaaatgaaattggccttattttccaataattttctactgcatcccaaatagttggtgtcagtcttctacgtatattagcatatgtttaatgacatttcatgttaatgctttagttaagtttgttttcagtctaatcatccttgtcttaaaaatttctataatgaattgattgaagaatgtgcttattccaagtagattgttacttgtttccattatagatttggcgaatcattctgttgttttataaatggaaatgatactcttcaaaacttattcgtcattttaagaagagttactaaataagattgaggctatcgtgtttttgtgtttttcaatacaaagtaaaaacgggggaaatatagggaggaaaatgtgttaaaatttaaaaaatatttttgagatcatactagtaaattttgtttgcattttttacttattggtgagtagagaaaaaaacccaagtgagttctgtaaatcatgagatgatcataacctagttttaaaatttcagaaactgagagattatatttaaaagttatctcatttaaattctgattaaaaaaccagactgtcattgtgtgtcattgacattggtttcatcacagtgtcttagcaagatgtttcagggacatacacaatttgcacaagtttatttactcacagtaagagaaaatttcaagctgatagctttaattattttagctgattcctctgattgcactcatggaaaagccaaaagaagtgactgtttttactttatctctcccagtcataacttatgtgtagctctaaaggcatccccaggttggaaaacaagtttgatctctttctgaaaatgctactaaaagaagatatgcaagagatgtgagataggaacattgtaagaacagttaaaaacctaaaattcagaactaaagcttgggatgcaagaaggaattttcatggaattcattattttcttgaattacagcaccaaacacgggtttgcatgaagcaggtagctggtagtcatttgttgtatcaatagtgattcaaaattttatctacaactgttaacagttcatttttccttatggttctttaagctcctgtttagctgtatcccatctgcccttgctaaatacactagcttacacacagtctttctggattccgttgacttgaaaattcaaatctaaaaacaatggctaacatttactgagtgttcactatgtatcagtcactgctctaagatatactaactcattcagttcccatagtgatacttagtggtgtgtggtgtataatgataccatttccactttagaggtgaggaaaatgaaactcagggaggttaagtaacttccctgaagttacactgctaaaaagcatagaaccagagttaatactcaggcattctagtttcagagcatacacatgtaaccagcacaccggagtttagattatacactgaccaaatgtcattatcaaaatggtatttgttctccctttttataaagatttcatagaaaattaacatgtgatggtactaagatatatagagaaaagtaacacagtaatttcactacatctgttcatctcattactattaaacctttggtcactaaatagaccattatttgatgaggataagagggactataattactattcctggataaagatttgcctggacaaattaatattcaatcagcagttctctctgcctgacacagaaatgactacttttccatgctatttataattcctggtactctatgaaattcctcctcttaaattaatacattggtcctccctcgtttacagggaatacatccgagacttctggtagacgactgaaactatagataatactgtagcctatatgtactatgtacaaatttctttttctttttgtataatttcagaattatgtagaaatatttttatcttataataagataaaatactttttcttatcatagatcttagcaacctaagcatatgattttttttcattccttattaagtcaagaatttgccttttcacttaaaggaagcaccttacagtttgtctttggcatattcaaattgccagcattgctcttgcactttggggccactatgacgtaaaataagagttacttgaatacaagctctacttattttacttaataatggagacagtctgtcttataacccagatggctactatgtggctaatgggtaggtagcatgtacagtgtggatgattcacatcctgggagggaagaagcagcatggtgtgaggtttcattatgctactcagaatggtatgcaatttaaagcttatgaattgcttattcctagaattttctatttagtattttcagaccatggttgactccaggtaactaaaggcatggaaagcaaaattgtaaataagggatgattactgaattatgacaagcctttctctgatgactgcattacaagttgagctatttgcagtgaggttgcccagaaacctagaggtagtacatgttttttgagatggtatttccattaattcttaaattatctcttttgccaagcacccttatcatcttagttaattcaggcagctctaataaaatacctttgattgtgtaatttataaacaaaagaaatgtacctctcacagttctggaggctgagaagtccaacatcaaagtgccagcagatttggtgtcttgtaagggcccatgttctgttatggtggaaggagaaggaagctccatcaggcctctattataaggttacttatcccattgaagttatttcatcaggttataaggctctgccttcatgacttaatcacctcccaaagaccctacatcttaatatcatcaccttgagagagattttattatacgaatttggggggaacacatacattcagaccatagcacttatgattaccctattttagctcaagctaagatcaagaaaaagagattttcctcttcagttagaaaaaaaaactttcaagagccaccttattatttgtttaacaaatatttattaagcagggacactgtgcctgtaaaaaaaaataattaaaaactggtaccctttttaaaggacttaagagttaatgtgcctcttaagcaaagattatccaactagtttaggctaaattagttccaatcatattacagcatgtgtcctctttgaacctaagtaatatttacatatttaattatatgcctttttaaaatatttcacctgtatttgattaatgttgaatagcctagaatcttcaatgcaactgtaagcttctaaagagtgagaagacctggtattaccttttcttttttattcatttgggcatatccttaatagttgattgaatcactggttatagactttaatctcaaagtgattatgatcttcagtaatcaataactccaaataaattcaaatgcattttatgctaagctatactttagaatccttcagtttaaaaaatgtgaataatggtaatgcaaattatagtaaagtataactttgctgttgaaaggactttctgatacatgttttaatttgtgactagcaaaaaccttacgaggcaagcagagtacaatggtcactgtgtacaagtatgtgtaaagtaaagagtgatcatagtactgtatttgcctcatttgtgggggtgaaaggagattaaaaaggctttgaaatgaaattttcagaattatggaaaatatcattatgttattactgcagacagaacatttctttgcaattggaacatctaactctcgttaaaacaatttctatggatatcacttgtgaaaagagttcagggaactatgtcatagtagatgtaatcaattatacaagattactgtgtttcctgtaaagatatagggaagagaatgtcttcatcagaaatgttatttctagagactgcttctttgatatatatccacaagaaacataatttcctactcaaagtagcctttcctatttacaaaaaaaaaaattcagtaatctcgtgttagagctttacctcttttctattctgcggggaggtgtgggggaagagaaggtgttaaatgtgattttatatacatccatgtattatttcattattgcattgctataaagaaatacctgatattgggtaattgatagagaaaagggatttaattggctcatggttctgcaggctatacaggaagcatgatgttggcttctacttggcttctggggatgtctcaggaaacttataatcactgtgtaaggtgaagggggagcaggcacatcacatggccagagcagaaacaagagagagaggagggaggtgctacacactttatgtgaccagatctcccaaaactgactcactatcacaaggacagtatcggggggctggtactaacccattcatgagaagccaccaccatgaaccaatcacctctcacaagacaccacctccaacattcgagattacatttcaacattagttttgggtggggacaacatccaaactatatcaatccatgtaatattaatatataattatatattatatatgtgtgtgtgtataatatatatgtgcgtgtatgtatatatatatgcatgtgtgtatatatatacttagaagaaattggtttcattgtaaatggaaagcatttctctgaaaaatccataaacccttacacagtggggggaaaaatatccaaaataccaggacattatttaaaaggcatattataaatagatttcatcatactgctatcactgtaagcttacaagggtgtactgactctagtagcacccaacccccaacatagaaacagtaaagtaaaaatgtctgataatgaatcctgagtatgtaaagccgctttgaagaaacagaattttctcaggtcaaaaggtaaccaattaagttagaatgtgccaactggaggaaggactggtcagtaattgaagcaaggagaagagaataagagagaaatgtcgttatgttttctcctgagagaggtgcctgaaaaccatcttgtcggtcaatcactgcctttaatgcctgaagaaactgaaacccaaagagaaaaatgacttttgcccaagcacaacactgattcacatctaaactggaactaaaaatcaagattcctcacttacacttaggcctctagattatagagcgagcacatttactcatgccttttctctgaaagcaacagattctaggcaatagtaggaaaaatgggggcttacttggttgttggttgtttcagtttttaattttttcatgctgatgtcaatggttagaaagatttttctgttagcctagtgttttgattttatgtcttcacttagaagaaacattacctttttatatttaagttgcacacaaaaagtattagtgtcaaatatttaaatacagtccttttaaacttgcacaatactacttataaaaacatatcagagaaaggagtccacatgactgagtgaaaagctgtcttttgccacaaattttatactatatttttcaggaattatctcctttcacttcataattgctgctagcaggggccaagctaaccattaaatagtgtttctgacctcatgcactgttccatagctttgtaaagtgcatagacagttttttttccccagaaatagaaatgcttctgctactaagttgaaaggcattattagtgaaattagaatatgataacaaactgcagatggtaaaagattacttcctggcagagaataaatccaaatgcattttatgctaagtgaaatgtgattatcaaaaaattgtaataataatgattgattcatgaatggataactgtgatccagctcctgctgccaactatatgtcttaatcagatcaagatagaatcactgattaaagatagaagaaaaaagagaaaccataatgaattagaatgaatatactatattaccaaggtcatatgagttttgatagttgctataaaataaatagaatagccatttaagttcattttaaaccaaaatacattcttctgccaattttaaaattatctaaaatatatcttattacaagatcattttagtcaaataaaactttaggcacttttgaaatgaatgtttacagaataaacaggcaacagactgtacttgatatatcactactataaaagcttttgtggagtatgctagctatgaatttctagctatgaattaaatgttctaatttattacgttatactcacagtttaagaaatatttactgaactcttctatacgccaagcatatctgagtttttaaaaatgtgtatctttcctctcatagagcttatatattctagtcttattacaaaagaatatcaatattttcaaatagtgtgcatagggaatgccaaacaacacttttcttatgaagggcagattctttccactctcttcctcatactattgttgactccatttagggatcttctttatcagcaggagtggattatttctgtaaaaaaagtaaaatctgagtaacataaaatgagctactagggctaacaggacatgtatagtatatctaacctactttacaccatgtctgccctaatgattagaccacacctttcctgtttactcaattattcattcacgacatgttcattaggtgcctaaaacagaccaatctgtgttctaggtttagggcataaggcattgagcaaaacacataaagctcctgctcttatgtagcttatattttagtgaggaagaaagagtaaaaatagagaaatagatatataaaatacaatcaaatgatgataactattaaggaaaatattaagtaaggtcaggacataaagaataacagggatgctaatgagtggggctgcaggaactgaggatttgcatgaagaaataagatgaaggaatatctaggtgaggagtactccacacagaagaaatagaaggaaaagtgaattcacaaaacagggtaaccaatgagtgagccaaaatagagtgagaaaggctgatggaaacaggagtttgggttatattcatggccaggcagaagcttataaagggcctatgggccatgataagagagttctcatgaagagttatgatttttctttatgtagtgtgtgtgcctgaatgacaaagctgtcaatatataaaatattcataaaagaaaaaaaattatccatggagctattcagaagcagtgcactctttctaatcaaaactactacttgaagtctgtttaaatgtaattaaaaacagtgactgagtttataagcactggaaaacacaatgtcaaaaaaaagcactggaaaacacaatgtcaaatccagaagactgacacataaaggtaattacaatgcaacaagcacttaagtatgttataggaataatcaaggagcaaacttcctcctctgctttgaatgtaaaaagatacaaagcactttttcccacctgcacaatgagaaaaagccaaaaatctattaaactctaatttttttcaagctgtaacttttctcaaagtaaccaaataacccaacatccaaagagggacaagtactttcaaagagagacagaacacaaaacagtctgtccttagagataatctaggagtaagaggttactgtcttccacacaggctaggaagaatcacttgcaatttttatgaactcataaaggctaagtgtgaactactgtatttatttggaatagcagacacaaggggagtttgtacttatttgcaggctattgaagtactcttccagcaagtgctcttgagaaagttggtatcagaaggatatgaaacagagctctcctgagtggaactatggctgcaggggaccaggcatagtactcttgggctttaagcaataggagtttgaactctgcaggcccatttttatgtggattttttcaataaatatattggaaattttcttggaggtttgcaactatttgaaaaaaaaaaagactcacatatgaatggtatagcctagaaatatttttaaacaataagaaatggttaggtaggtcattaattcataaggtaaactggatactagtctattttatgactagatactagtctatcatttaccactataaaatttacacaaatctattatgggaagttaaaatgtatcaaaacttacacacacacttacagaccttacatggcaccatgcccagtctaaagaaatataaacaaatgtctaaatgtggcattaaattataactgcataaaattaactgtagtacatattgtactactgtgataatttcacagccaactccagttgcaactgtggtgaggtcaaatgttgcaagtaacatagtgtgagcagtttgtctctccagtaaattgtatcatgcagtaaaaagtaacctctcacagttcttgcatagttttcaccaagtttagtgcaatactgcaaaccttggataataccatgggacccataaaaagtgcgactagtgatgctggaagtgtttccaagaggcagaaaaaagaagccatgacattacaagaaatgtttaattgcttgatgtgtaccgtggactgagctctgcagctgagtttgactggcatttcagacagacaatttatcttataaacagataatgtaaacttatggtattgaagatatagtacagtactgtaaatgcatgttcccttgtgattgtcataataatattttcttttctctagtttactgtattataagatacagtatatattagtgtatgaaatatgtgttaataatctgttcacattattagtaggacttccaggcaacagtaggctattgatcgttaagttttggggtagtcaaaaattataggtggattttttactgtgggggttgacacttctaaactctgcattgttcaagggttgactatgtttttcccatctattcaccctttatccctagaaagtaaaagccttaagatcttggggaagggggaaaaatcctcttatctatggggtacatgcaaagacctattgctactggtaaagactcctgggagctggtcaggaaactgtcttggttccaggatctttcacagatataagccaaggttggcacattctgggaggcaggaaactctccagagaccaatcacaaatgaaaggtggtgtttcaaagatgaggggcagtaacagtgacaacacccttaggcccaagttgcacatgacctgtgtgaaacggaggctggaccaggtccgcgataaccttgtgcaaagtaacacacaacagatgtctaccacaggggaaggacccaagactcacagaggacagaggcacctccacttggtgcagctgtgaagggacaactaaaacctgagggagaaaaagaaacactgaggaaaaatctctggcaacacaggccctattctaaatactacaaagtaatagcagcctgctgctagaggaatccaaagcctgtggtgcactggacatagtgagggcaacaacaagacacatatccatatcaattcctgactagattgctacagccatacaccaacagcctggtaggaggagagtctgtatcaatatattctatttacctcagtctgcagtctcttacagcaatatgtctaaaattataagaaacattagaaaaaacaatccattgtcaagatgtaaagcaacaaaaatagattgagctatatcctagatgttagaattatcacagtgactataaaagtaactagggttaatatgttagcaggaaaggtgaatataacatacatgaataataggggaaattcagcagaaagaaggtaaactaaagcagtacatagagggaaatttataggactaaatgtctattttagaaaagaagaatggtctaaaattgacaatcacagcttctacctcagaaaaagaaaatcaaactaaactgaaattaagcaaaataaaggaaattgtgaagatcagagccgaaatcaatgagatagagaacagaagcaacaaagaaaaatcaatgaaaccaaaagctgtttctttgagaaaattaataaaagtgataaacctttagccagactggttgggatcaaagaagataccatataaattatcagtatcgtataaagagagctgacatcacttcaaatttcaggggaatattacaaacacctttatttcagtaaatttgacaacttagatgaagaaggcaaattccttgaaatataaacgttaccaaagctcacctgaagaaacagataacctgaatatgcctgtatatgtttttaagactgattttataaactctctcactactgaaactccgggcccagaaagtttcactggtgagttctaccagacttttcaggaaaaatgacattaattatacacaaactcttccagaaaattcaaaatgtgtgactatattctaacccatttactgaagccagcattatccttgcaaggataatttaacattcagaaatcaatcaatgcaattgcccatattagcagactaaaaaagaaaaaccatatggttatctcaatagatgcagaaaaaacttccaataaaatctaacatccattcctgataactctgaacagctctattcctgagcaaactctgttctcagcaataaaaggagactttctcaaactcataaagagcatagtccaaaaaccttcaggttatattattttcaattgtgaaaaactgaatatttttccctaaaaatcaggaaaaggggaagggtggctgctattactacatctattcaaaattggactggtggtaccagctggtgcaataaggcatggaaaagaaataaaaggcatacagattggaaagaaagaagtaaaattgcctttatttgcagatgacatgattctctctgtagaaaatcctacagaaaaggaaactagaagaagtgagtttaagaaagtttcatgatatgagattaatacacaaaatcttatgtatttccatattttctggcaatgaaatttggaaattaaaataaaagtaccacttaaaatagaatataaaagtataaaatacttaagaataaattgacaaaggtgcaagacatgtacactgaatactacaaaatattgcttaaataaattatttgaaaagctaaataaatgaagttatgtataatgcttatgaattggaatactcagtaagtattgggatgtcgaagttacctctcttttttttttttttttttttttttttttttttttttttgagatggagtctcgctctgtcacccaggctgaagtgcagtggcgcgatctcggctcactgcaagctccgcctcctgggttcacgccattctcctgcctcagcctcccaagtagctgggactacaggcacccgccaccacgccagctaattttttgtatttttagtagagacgggtttcaccgtgttagccaggatggtctcgatctgacctagtgatcagcctgcctcagcctcccaaagtgctgggattacaggcgtgagcaactatctctttttataagcacatagactgctgaagaaataaggtaattaaaatagcatggcggtgggagagtgtgtggaatggcaggaagatacaatagcaaggaataggaactagagatgagcatgaaaatgtaaatcagtgtcaggtcataaagaattctgcatgccatgctaagagtttgattttcacttgcagaagttgtatgatgacattggaagttttatgtttttaaatttttattttaaattggttttagattttcagaaaaatgcgacaatggtaaaaagaattctcttatattctttacacttttcctaatgttaacatcttatataatgaaagtgaaattatcaagaatagtcattggatattgatgcagtattactaactgagccgcagaccttcttcaaaattcaccaacctcttttttttttttttttttttttttaatgacagagtctctctctgtcacccaggctggagtgcaatggcgcaatctcggttcactgcaacctcagcctcccgggttcaagcaattctcctgcctcaacctcccaagtagctgggattacaggcaggagctaccattcccggctaatttttgtatttttagtagagacggggtatcaccatgttggtcaggctggtctcgaactcctgacctcaagtgatccacctgcttcggcccaacctctttattaatgacttttctatctgtttcaggatttttgcctaagatcccatatttcattaaattgtcattcctgcttagtctcttctagtatgtagcagtccctcagtcttttattgatgacctttaaaacatgggaatgacataatgcgattcaaaaatagatatgattgcttacagtatagatgattggagaaagtgctgtaaaatcaagccagcttaaagacagttttggtaattgagtgtgtggtgatatcatttgaattaaagaactggcagtagatatttcaaaaaagaatagttttgagaaacattaggagtaaaattaacattatgtgataaccaagttgagatggaggagcatgggaaacaaaagtgaagaaataatcgaagatgacttctgagattgggttgtgatattctaggtagatagcagtaactgagaaagcaatgtaaaatattattttgtcattctctatctttctcttacacaaacataaacacactgttccccacatctttctcaagatattattcttacttttatgggatataattttctggactatattaaatattctgtcattcatccagaaataatcagtttcaaatccaagaagttttataaggaacaataattttaataaatagaatttctataaaatgattaaaaagttttaaagacagacatataatatgatctgattatcattcttgccacaattatgtttaatcctcactctttgcttgttatgtttatgattatgtaggtgaagattaaattttacctataatgaccaaatatgacattctgcactcaccgagtttcctaaagtgcaattgctatatcttctatcagctgccaatcagttattaagtataggacagataaggtgttgttttagataaactgataattttataaatttgcaggctattgggaaaaggcctttctaaacacagtgttaagcaaaacagtcttaaaagactgacaatttcattgtatataattttaaaatttctgaaaagctacataactcataaataaatttaaaatacaagactaaaggcagttaaataaatgtggataaatagtggtgctaaggcatgtaaaggtctccttcatattaataacaaaaagacaaactccatcataggtcatatttcttgcctctcccgccattctaaccttgcaccactctctaccatgctctttgcactccagccacttggctcctctttctgcctttctggtatttcattgtctctgtgtcacaggatctttgcacattctatttcttcttttggaaacattttctttactctttttcgtcaaggtaacctccatccacttaattagttcctacttacccttcaaattgcagctctatagtcacttctgtagcaaaggcttccccaatctctagttgaggaaaaatgtttttgggctatcatagaataacgttctcttttggcctggaacctactcagtatgtcattaaacattcatatgaatatcttctgtctcacccattatactcttgcctattttgggccattttgcaccctgagtacctggtacttgcctgatatagaaatacattttatatatataatatacaggtatatatatgcacatatatatgtgttctttgaagaattgttactaaaataaaaagataaaaagataggagattgatctgaatttccttaaatcgggagctatgaaatctatcattgaaaaattataaagtaaatatgctaaatataattatattagtaaatatctgtatatttagtaaatatactaaatataattatatttatatactgtatatactaaatataattatatttatatactgtatatactaaatataattatattatatttatatactgtatatactaaatataattatatttatgtactatatatactaaatataattatatttagtatatttactaatttttgtaattatatcatataattgtattttgtatatttactaatttttgtcttgtattttaaattttatatataaattttataaaacttatgaaaatatataaattatatataaatatacatagtaaatatcaaaaaatatgtgttccagccttgtctctactacttaatagcaatgtaaacataagcctcaatttagttttgaaaaggggaataggaaaatattcaatttagccatgctgatcaaatgataaaatgtatgtgaaaccattttttaaactccaaacaaaataaaaataaagtaatatttcatcattatcatttttattacatcaatgatggtagaatcactttaggtctgattaaaagtgtactcaatactttctaggttcttctcagtaccattttgcagccttgttgaaattttcctttataaacacatggagctgaaattatttggagctaaaactatagagaatcaatgttttaataccaaactaaaaattttttaaaagagaatactattagggattcttcttctttcttttctttttttcttttttatatctaggaggctgaatttttctgaattttgtaataagggagagttaaaaaccctcctaatttttcatatgggcctttctgtttaaaaacaatgatttattttgtagttcttcatggcccagacattctaatctaagtcaggtttgaaccccaactctgccatttactagtgttacagattcactagtggtatgatggacaatgcatttaatgtcactgagtcagaattttcttacttgaaagttggaataataatagcttttctgcacacggttgttatgagatataaattgaaaaataaggtgacttataatatgtgccaggttaaatgtttaattcttctcaggtttggatcactaattataattaaaggttcacgttggctttagatgagtgaaaaaatagttgactgaaaattactcaactgagttcatttgatggctggtgatcaaccatttaagcacttctattttgtaagaaggaataaaatcttaacaatttttaattaaaatattttttctgtattttcacttcctaagtagataattatgattaacttggaccttgtaacactatttacatattaaggcaagctttatttggaagaatttgttccagatgattttatttctggcaaactacattgatgaggtcccaaatatagaccatcttctaaatgtcacatctcagatggttgctaaaaatcatatttgcaaagaattctaaatgtctgggtaagctgaaattgttttgtgttactgtattcctagaagtataaaagcaaatgtctggagctttttggtggaatattaaaaaagcaatcataaatagtatatttgtgatttgttaataaacagaaaaaaagtaattagattatatttagtcatcatagaaagaatacacaagtagtgaagttccactgcccagttatggtcattgttgagtatgactgaagattattgaaaaaataataaaaagtcaacaaatattagatgttctgcaacaattacttgaaagagcattgaagttacaatccgccaggctactgtttctcagaaagggttacacatcagaactattcaggtaacatttcataatgcaaatacatgactaccacactggactgaataaactagaaactctaggagtagacttagtcatctctctctctatttttaatctccacttttgattgtgatgcagggcagattttggaaagactatggtggacaaactgggagcactttgaggatagaacctgtcatatacattctctgatctccagggaagttccttggacgtggttgaaagttgattatttatattgatgaataagtatgtcttaatcccttctgtgctgctataacagaatacttgagactgggtaatttataataaacagaaacttattttctcacagtttaagaggctgggaagtcaagatcaatacactggcgtctggagaaggtcttcttgcttgctgtgtcatcctatggaggaagggcaaagagagggcaagagaaagccaaggggaggccaaacctgtcttttgataaggagcccactcttgctataatagcattaattcattcagaaaggtagtgcccccatgacccaaacacatcacattaggttccacctcccaacaccaacacattggggatcgagttttcaatatttcaactttgggggacacattccaaccacagcagtgtatgatgtaatgtgctaaagtcctgatgtgtcttaaaatcaccggaggaagttatatcgggacaaattggtaaatataaataagtcagaaaaaaaagatcacaaagaagatatatgttcaaaaaggatgatgctaccaaaaaatatttcactgagttctcattttcagtaagaggtaataaattttttaactctttatgcattttatttttaatcttgttttacttagtaagaaaacaaagactcaaaatatttagcttaagaaatgaaaatgttagtgtacatgaatatatcttagcttaaatggatacatttatagagcagaattaaattccataactgcagagtgaccacaaagggcaaaagtgttgcaattgctattaaaaataataaaaataatagttgtgcttttggcagttagtgcaggctccaaacatctttggtagtgacagaatctcaaacaactggagtcataaaaccagcaagcttttcaatatgatctgtatgtatagatgtttacgtatatgtgcatatatagtataaataaatcacaaggcttgaaataataataaagaactatgccattgagatgtcataggtttagattattttaatttaaaatagttgataaatacacgttctgatctttcaaattcagttctcatactatatcaaatgaactgactatgcattctatgaaactgcaactcataataatagtctcttaattgtcaagacatgaaattcttgcaaaaggtagtctgcgttgctaagctttgcttctgttcttactgcagccttttatttcctgaaatctcccttcagctgccatgagttatagcctatttttatactaaccttcatctagggccctgtagatccaaagcaaatcaatttctatctgccatgcttcaaccgacattttgttttggtaaaatagggccaaatgggcatcaaatacagccttgaaggggaaatggcaggttgctgtggaggcccgttcttatatgtgcacaactgcggctttgttttgagtcatccagtcccaattcattttacttgtgtgagctcttcctttcctcttcagtgggactacctcctttcaacaaacttgacaataaaacaatctcaaattgagctttcccctatttagagctttatctttacttcgctatgcaaaattttaaggatacaactacaagactccattgtttgcttgttgtggtgaaaaggatgattggttagagagctgggtcatctattttgttttttaagtgggtgcatttgtgatttcttgacaataaaggattgggccctctcagagggatgcgcatttataacttgcaggccaccactctcccactctctatgagaaacctgacaaaatgattttggtactttttcttattgagtctcaaactctcaaaatagtgttccaggatgccaatttaccaacaagtcatcaaaagcacagcaggtaaagccaatttcccatccttggactgcacgatctctaaattatcttttaggcctgacattatatgctttctggctgcaatttttgattattccgattttgattttgtaggaaaatttcagttattcttgctaatatgaatagcacgataggcaataccaaacagtaatccaaaaacaaagtttttgtatacaaaattaactggttttagtatctgcttagttcgtgtttaataggaagtaacagtgggttggaagaaacaagattttatgctaaagcaaatgtatctactaagcaagattaatatatgacttttcattttggaatatatccttctaaatctgaagactaaaacagacaattttcctgtcatgttacatgtgacagaatataatattgaaagtaaatttttccccaaatttcaatgtttataactgtataaattttgtggtagaagtatgtaaaatattatatttacttaatttcctgtaattagtgtaatctaaagattgactccaactgtgtaccccttaaggcactttcttattttgattttaaatgctacaaaccaaaatctcttctaaaaagtgacttactacttactatttgcttatataaatcattaatggtcatatataccaaaataatgaaataaaaatttgactactctttttgcattaattcattgaaattataagtatacacttatattattttctatgaaaattgaattcatgaacatgactagaacatatgatttttgctaaaattagacctcacaatgttatggtctaagaagcatccatccaggccaggcacggtggctcacacctgtaatctcatcactttggaggccgaggcaggtggatcacaacatcaggagttccagaccagcctgaccaacatggtgaaactccgtctctactaaaaacacacaaaaaaatcagctgggcttggtggcacaggcctgtaatcccacctactcaggaggctgaggcaggagaatcacttgaacccaggatgcggaagttgctgtgagccaagatcacaccactgcactccagtctgggcaacagagggagactccatctcaaaaaaaaaaaaaaaaaaaaaaatacatccttgatgctttcacatttattggaaatcagtataatctctttcatgaggcaatgcttgaaaaatatgtctcaaataattattcattattttgcatgtattggttggcttagcattaataaattaataataataaatttatttgatgatgatatgcttatcattagtacagcacttttaagcttgcactttaaatcagccttcattaactggccagttaattatatacaagaacttaccattaagttttcctttaagtttttaaagaactatgtaaaacaatttataataaattttgaatcttaagaatgttatacctagaatgcctaaaatctaaaataaggctgaaccagttataaaatgaaaataattttttcattgatttcttcactgatttttgaacttatttttaattttttatcttcaaagtttgccattatgaaacattacctcttcactcttttttctgtgtatacaatttctttacatttacttataatttatatttgatctagttttaagtacattttgaggtatgcacatagaagagttaaagtgaaataaaaatagattgtaaccatataataggaattataaattgttgatctaggaaccagaatgagacactggctacaatgtagtatttgaaattatttgatttgaccataagctttcttactgtcaaggaaaataacaaaaacatttttgtttctccagtttatggaaaggggcaatgtcatcaagtttttagatatcagaatcattctgttttcagtggccagaaatgcttttctccaaaccttcatctttctgtttattcaccggtttacatattatctactttttgaaaccttgtattatgccttcagtagggaattatcttttctctgaattataaattgataattacaaaagtttatctaccactaattgaatatctatcatgtgagaggcaaataacagacactgttttctctaatccttgcaataatcctgcgagattcatgctattttaccctctttacagatgatgaaaccgagccaagagaagccaagtgatttgcacaaggtcgcatagataataagagcagaattcttggaataccaatagtgctttgtaatttgaggatctcctcatatcgaatgttcctttctaaaacattttcatagctatataaaaaatctgtaagctttatccatccagtgcttctcaaaaagggaaaactatgtgaaacccactgacattttgaatattactgtgctttcttgcagcctgtgaacttatgaatcaaggcatcttggccctggtcagctccattggctgcacgtcagcaggatccctccagtctttggcagacgccatgcatatcccccacctcttcattcagcgctcaacagctgggaccccaaggagtggctgtggactcacccggagcaacaggaatgatgactacactctctcagttcgcccacctgtctacttgcatgatgttatcctaagagtggtcacagagtatgcctggcagaaattcattatattctatgatagtgaatacggtaagtgtttataatttgtttaggttttgtaagctgatatttgcatgagaagcaaattcattaaatcttaaaagtttcaagggtcttactcattgttatttgtggttttcttgtcttgtcatatttttcttataaacatagcaacaactgaaaattgtgttaatgtatttaagtccaacattttggtataaagtcaactttaaatataaatacctgtacctacttaatgcttagtttacaaatgtttctagagagaatctgattccaatacatcttgatttttcaactaatgggaatttagtcataaaaacaacaccgtctttcttccctttcaaaaaaatgtatacctctctataatgcagaagatcatattggataaccctagaacactgaaaatttacctctttctattatttggctaaatgaaatctgaaaaatcttgcttacacccttgtgtagactttaatacctactcagtacttaactccttggagtcactaaaattatatcaccatacagttcatattatatgttgtctacagtaggaagtctcacaaaagtactaagtagtaaaaaaaaaattctttaatcttccaaggtaaaacacaaagcattgtccctaaatttatcataatttgagaataaaatgctttgtctcagtatatttactggtacttcattaacaactaaacaaaataatatttttgtttacatttattttttctgaatttatctaccttttttctaactgaccgatccccaatatcttaatctatagattccctcttatttgtggcagaaataaaatagagatgagtatgatcaaatgaggggaaatgaacagatcttgataaagaatgcctattttgaaacatgtgttttcttagaggttatgtcttgagaaggagtcttggaaaaatttcctgttcagtaggaatgggttcagtttttacagttttctgaaaagaaagtcagagaggatttcactctctgtagcataacttatttttctttgcaaataagtaaataaacatcttaaaaaatgctttcttgtcctaagctacccagcaatgtgaacgatattggagaacagttacacaagagtcgtccagaaagtgccatcaatagaattgagaacaaacaagttggcagaaatctaggaatcaacaaataagaaagagctcctgtggactctcagggagggagagcaagtggcagttacatttagccctaaatattcaatggttgcatggggttttggcagccagagtcttattaaacttggtgggtaggcttcagccaaagtctgtggcactctctggaaacacactcctttgtctccaagacggaaatccttatttttgttgcttaattcacgttattaaggggtcacagaacaaagtctaagagactgaaatgaataaaataaacaaaaaggatattaaaaataattggctcatcagttaaagtaaggattgaactcaacacaagcctgaaattccctgataggattatttagtgaacataataaactctttggaatcaacatgctgaataagactgttgattttcttacagtcagattatttgtggcctttataacttaaatggtattttctttttttacttaaatgatattcttatgacctctgatcaaacatatattgaaataataaatttaaaaacagtaactttatttaagcggggagaacaattttcagttagtactatgaaagtgatttatttatttatttatttatttatttattttttgagatggagtcttcctctgttgcccaggctggagtgcagtgtcacaatctcggctcactgcaacctccacctcctgggttcaagagagtcttctgcctcagcctcccaagtagctgggactacaggcacgtgccaacacgcctagctattgttttttttttgtatttttagtagagatggggtttcaacgtgttagccaggatggtctcgatctcctgacatcgtgatccacccacctcggcctcccaaagtgctgggatttagaacagaaaaggaacttttgattaaggcattttctcaacattaaaacaagaatattactctttcattataaatgaccatgaagaaagaaaattccttgttagtttgtttccaagtcctacatatattatagtcaggtaatttgtataaaagaagacatttttattacgggtgagataactatattttgaaaatatatactaaataaatatatagtcacagaatcatttatgcatatttgaaatttcttattcttttctcctgagtttttatttgagtaaataagatggaataattatgtaatatatgactgggtcatttgttagatctgaggtttgctttaggaattttatttttgggataaacttgctttttcacttatttagcttaataatttatgaaaaatatttctgcttctatcactaacattatctccagtaatgcccttgtttaatgaaagaaaatttccctttaatacttacaattaatcttgcaagtaaagcattggactagagtccaaaataaacatcaagctatccaaataccttgtactttgaagagggctacttgtatttacttatccattcatcagtgtcatcattttaagttcaaacattggaattgtatgtgacttttatcttggttatgaagaattgctttcattaagaaatggattaactatggatggaatctatggatggaattaggcagcttcctggggccaaatgttattgaaaatgtattttgtatagaaaaaaatatatactttttaaaaagatttagacttctatatcaagttaattagagaaacctccttttcaaaagcagttaattataattaagggcaaaatataaatgtctactttaaattccttaacaaagaaaactgatatctttgcttctaagtcaacagatgaaaagatgaaaaaaatgtggaaactttatttgaatggattgattcaagacacattttaaaatgcttgaaaataggttaggaagtgttcagcttttaaaaatatgtccttctggaaatattcattgctcacttgctcagtgcaatgcaaactatgagataaaaagtattacaaaacatagtcttagtctttaataagcttacagttaacaacagatgtgtctttcttaatagagaaaatagtggattaagtgttatgaatgatgtaaactcagttctactggtgtgtaaagaagtatttaattttggcaccagtgattgaagaaggctttatggaatgacttcactcttgattatggaagttaatagtatttcaagaggcaaaaatatgtgagaaacagcccccctaccaatagacagtgtgatcaaatattgcagcaattaagatattaaaaataatatctctgagcattttaatttgtcagacactagaatgagatatcatgtcatttgatcttctcagtagctctgtgaagtaagaactttactgtcacaattttacaaatagggagacaggaacaagtgataggtaacttgttcacaaaaaacataactaggaagtatcagatcagagatttaacgtctgacagagcctatgatcttaatcatttatcagtataaaggggttgcaataaactatcacccaagaatgtaataataagggctaatctaatagagaacatttactatatccagcctctgttctaagtgttttacatgtattatctcgtttactcctcataatagccctttgtagtagttattattttattattattatttttacaaatgaaaaagctgaagtagtgggaggtcaggtaacttccagtaagtggagaagccccaattcaaatatgaatgatctcttcctgtccttgctttcagccatgaaggtattttaacattatagatataagaataagattaatttccaacagattgtgaaataaaaagtaagtgtataaattacatagaatcattttcagtaaagtgacttcaagccctcagaattccaacatactaatgccaagggaaaatactatatgtcaattaggaaggtttacttattattgaaagcatggaaatgagaaagtcattgggacaaaacaggctgacctatctgtaacagaaatagctgccttctccttgtgggcaaaagtagaaatattgcaacctcaaataaatcatttttttgtcggattaatgcttctggcccagtaaaggtttatgcagaaatttgagaaagccacctggctttttaaggtaaactctgatggctctcaaactttgtttacctgcctggctcaataactgttcttttttctttgcaaatagaataccaaatttgagagtgcaatattcctggctgaaaatctgtagtcccgggatatcttacagctaacttttgtgatgtaatgctgtcagaaattgtaaaaggttgggaattttatcctatttgcaagctagcaagttagcctgcatcactttcatggatgctggtggaaaatactaggcttttagattgtatagagagactttattactcatggtacagcaagcagcatgaccctcatagtaatgtctgtttctgttgccctcaagttccacaaaacaatgtggagcagttcaagtgaataccctatgtgtaatgggcttgtatggcagctgagaaaccctgagcttggggaatccatgtgtcttgttccctaataagaattcctgttttcaaaatgtgtagtaacacaggagacctatggagaattgtctcccaataatgtaatagtcacattctttctacaacgttgttggctaatagtaaatttcccccgtgagattgccactcctctagttaatctgaatggtggggattgcgatcaaatccattcagtttttctcatctgtatttatttaaagagactataaacaggactttaatgagcaggattgatctcaaccatgcccaccagggtcctggacccagtcagctgaacaaatactatgaaccactgaagtttactttaaaaagccaggcggctctctccttaagtttctgcataaacctttccacttggcgagaagcattaatttagatacaaaaggatttatttgtggttacaaagattccaccattgcccataggcaaaacctatcacctataaataccctggccagtgagttgaagctgacctgaatgaattccagagctgaagtggtgccattgattgcttcagtgaaattcagggaaaaaatttataatggatgaatcccatagtaggataaactgcccacaggattcacagatattgctccatgtagctcccataaataaataaaggtagcctcactttggagagatctcattagtgtactatattatcttctgctgatctttacttaaacagttgaaaatttcttatggctaccctaatgttcaaatcatgtgtcttcagaagggtggtaatcttcatacaaaagttatagtactggaagtgggcctggtttgcctgagttggtggagggaagggttaggcccaatttcaggaacccgctgggtggaagacaaacaaatattacctcctatgtgacctcctcgccctctggtaacgccaggtgttctcaattactagaataattcagtccagttcttgtttaagagagactttgtgagagtagttgattaggtccgtcctcattgtctactccaggggtcagcaaactactgttgggcttgaaatctctttttgtaaataaaattccattggaactcagccatgttcatttatttgccttttgtttggctgcttttaagctacagtagcagagtcctgcacttgtaacaaaagcaatataacctaaataaccctgacatattattatctagccctttaaggattgtttaccaatccttgttttatgccatcagtttagtggctttattaccacccgatgtaatgagtgagaatagtggcagagaaggtatttagaggtattgacaagcattctgcataggagtggcagatgcatcctgtgctattttcagtagacttatttctaagaataaaagaatggcgatcaagtcgtgaatagagccatctggtaagaaaaggcaagtccaacagtcagtgaagtttaagacacttatcctagtttggatgttctgtaccagagagttttctttcatggagaatactccagaagtcattttgaaagacaaatatcattaacatctgtcctttccccataattgtaggggtctgtgaatgttcccttcttatttggtgctctccctctacctccagcaaattggtgtatttcatcctaataactgtgatgtcatcttttttctcaattatttcctgtttgcacatagactttttataaaaaatggtgcaagagctacaaggacatttttataaaacttacagagactgattgtgtcccccactttggcctgcatgaacaagctgtgtcctcacaaagtgctcattatccttatgatccagaatcatatcaataaaacaagaaactccaggagactgaaacataattgagtccaaatcccataagctccgtttaggcaaggctgccacacaggctgctctggggaaaaagaaagaagtgttttgcccagaaaaggtcagaatgaaattttgaaattaaaagtaggtgtaggtaatcccacacgactttcatgttgatcattgcacagaaatcacccaagatgatattatttctttcttggaacatattcataaagtgaacaagcagcctcactaaggtatatgagccaggaaaaggtgaagaagataaagctggacatcttttgaagtcaacatttgaggagattgtttcaacactcaacaacactggaagtctgttgatggtagagagcgaggaagatacgctgagttccttgactaccaggccattgttgagcatcttttgcatacatttgtcaggctgaaaatggtccagtgagctgaaaacatgacgcagattaattttaagagcttctaaagtagtgtctacatcagctgatcagactggaacaataataacacgacctaaaaaagtatctacaacactttcaggcagtcctaagaagtgatcagaggccaaaatagtcaatgtgcttgcagtgggagtggacaaccctctttggctttccctactaggatacaaggggtcaactttcagcaggaatcacaagtattgcatacagtgcaggccctggtaacagaagttatttgctttgtgtcccatctgtgaatggtagacacggtaaatggtagatcatgtcaggcagcaatggtggcaatctgtgtgtctgtctcaataatcagcttgagtccagttgatctgatcagttaatggactttcactatgggtttctccatgagtaaccctgatgtaatcttgatatacttccacaattcacagctccaaagagtggtatctttaatgttactactctgtagttctctaagtggcataccaaaccactaagctgttgacaacagatcagcagtcataatgtgtatatatacatatatacatacacacacaaacacacacacacacatatatatgtgtaccatggaggagagtattgtacagagctatgagaacaggcttcagttctgcccacttagcagagtaagcatgtccattttcagtactgcatagcaggtgctgagcttgaatgacctaagcaaactacaacgaacactttcagatttcaggtcagcaaagtcatcaccatttgtttatggaacttctgcatctcacggccctttagagtcagcacttagcttcaggaggtaaagtcttctaaaggaagaatttgattttgatgtgcatgcttgttggcccctgcacatattactagttgctgaattcgaagtgaccctcctcaagataggaatgtcaggtcattcatagatcaggctttcggtttcagttaagagtccattagaaagctaatagctgcttttcaaaatggatgtacctggtagccatatttggggagcaccaagtccataatcccaaagtgagtctctaggaggggcttcttctcttcagcagaggtcccaactggcatagtcattagtcagagtcagaaatgcccagagtccaacatagcgatagggatctctttctggggagagaagaagcatgtctctatgtgacattattcccaataaggaaaatctccttgaatatttgtgaagtaggaaattagaagcatataacacatgaattccaattatatactcaatgtaggaagcaacaacagtatattaagttggtataaaggaacccagctacatgtcacgtgcctttccctctcccactgaaacccccaccaaatagttgaatctgagcattttcccctcttcccccagggctggataggtgctatatccgacaaagccatagaagtctgagtccctcccttccccaagatttctcagaatattgatacgtgcctagggtgtttagtctctcttatggcaagaatccttcttttaaggcagctaatgccagggaaaaggggaaaggaggggaagggattgtggatccagagacctattgtacagcaataagcaaggcactttctgtttcaagtagctactatcaagttcaaccaagcaaatctggttttggtctactccaagctctatatcttcatgggtaacaccatttatttcagctcagactgattctttcactttttatttttttaactttgatagttgaaggaatatctctgtatgaatattatagaaaaaaggccttccaatatttccaagcgttgaagaatgattgtgtttgtgttaaaaccttgagtggcacttgcttcaggaaaaaaagggtgtttatttgctttctattaaggttctttaaaaattggttggaataaatgctagttgaatttatacttcatgacttgaaaagcaagctgattttcattctgccttctcaaggagtgcagtatgtttaaaatactacttttgcctgctttttgatttgctatgaaaaagataaatattttaaggacacctggaaaattttgaaatacattttatatgcatatggagattaaagctaagagactaaaaaaaagtcattctttattttggttaattttgttttgttttgtttactatggcactcagtccagtattctctctgcatagttataatgcagccttgctaatgtaaccagaataactcttcattgataatgagaaattaacagctgaaaaaaatcaataccataaataggtaatataattttaatgaaaggcgacaatctgaaggctggatattgaattagtatctggagagtgtgtgcatagatgattgggggaaggaatcctaaacatcagtcttcctcacagttacatttacatgcatgagaaacaggactcctacttacactaagattaaacctaattagtatctatgtagaaaagagtgaagatgggaaaacaaagataaatgtgaagagaaaatgactgataattagccaaaattgaattaaagacatcaattcactgagccccaagcataagtaactacaaataaataaataagcaaattaattaattaattaatcaagttgatgttggtatttgaaaaaagaaaagcttaaatagcaagaaattaaacttctacctttagaatataacaaaataagactatattaaacacaaagtgtaagaaaataaaaataaatggaaataaaacagaaaacaaaatgagaaagttaacaaagtctaaaattattaatttttaggaaatattttgataaaacactagcaagaccatttttaatttttttttaagattatacttcaagttctgggacacatgtgcagaatgtgcaggtttgttacataggtatacatgtatcatggtggtttgttgcgcccatcgacccatcatctacattaggtatttctcctaatgctatccctcccctagccctccacgccctgacaggccccggtttatgatgttcccctccttgtgtccatgtattctcattgttcaactccagcaagaccatttttaaaaaatacacacagaaaacaaaatttgccagtatcagaaattaaaaagaatacatatcctccacacacaaaaaatattctactggaaattctaacactgaaataaagcaaagaataaaacacaaagaatttgaaaaggaagaagcaaatatgtctttatttctcaatacataataatgcacatagaaaatcctatgaaatctaaaacttataatttaattagtaagcttatagcctatattcgcaagtaattgtatttctttctaatagcaataaaaaattaaacctgaaataaaacataatatcaaatacccagaaataaatctgcaaaattttgcaagacatttacgctaaaaattatgaaacattgaccaagagtatttaaagaagaactaaataatggagagatatatgttcatgattttcaaattttagtcttaagatatccatttttcataaattgatttatagatttaataatcaaaaatcttaaatttttaaattgtttttagagccttttgaagaaattgataagctgatcctaacattgtgtaaagatcttatatagccgcaacaattgaaagagcaaagaaaaagattggatgaaatattttacctgacttcaaggcttttttgatattggcataaggattgacaaatagattcatgggacataattaggagtccagaaatcaacccacaggcatagagtggggttgattgttaaccaacatgccaatcaattcagtggtgaaatgtttaagcaacattgctgaaccaattgggtccctgtatggaatcaaaacaaaaataaattttactctcatctctcactacacacaaaaattaattcaagatttatcacatactaaaactaaaaccttagaattagaactcttttagaggaaaacataagacattatcttcataacttcaggatatataaagatttcttaggtaccaaaaagaacattttggactttctcaaaattaaaacgttctgctcattaacatacaacattaagaaatagacaaactatgaactgtgcaataaattctaaaacatagatccgaaaaacgtataaatatgtgaaatatgtaaagtgttcaaagaatacacatatttaaaaactcttaaaaagcaccagtatgaaaccaaaaacaattttaaatgggtgaaagccttgtccagaccattcacataagaagatatataaatggcaaataaactgtgcaactttattagtccacagaaaaatgcaaatttaaattacaaggagatgccaatctgcatccactagattggctgaaggcaaagactgacaatccaattgcacctctgatactttgctggttggaatgtaaaacatacagccacttaggagagctgtttggcaattttttaccaagttaaatatctacttaccttgtatacctcacctatttcactccagaaaaatgagaatgtatagccacacgaattcttgtacaagaatattcatagcagcattattcctcatatccaaaactggaagcaactctaatgcccatcattttgagaatggttaaattaattttcatacagtagaatactattgagcaaaataagtaatgaactattgaaatatgaagaaacactgagttaagtgagaaaagactcacatttataaatgagtaatactgtatgattccatatattttaagtccagtaaatacaaaactaagctatcgtggtcaaaatcagacagtggtcacatctatgtgtctggggtagattgtctggaaagcgacacaaaataacttttagtggtaatggaaatatccattatcttgttttgagtgatagtaacagtggaatacaataaacaatctgttaagcatttaagatctgtttattatatgtaaattaaacttcaataaaaaattacaatatagaacaacccatcaaatatttgaagacaaaaaaggtaaaggaaaggaaaaaggaaaaaaaaacaatttacagaaatatcataattttaaactaaacacataattgaatcatgatgatttagagattactgagtcataaaaaaaaggtgagaatttaatttggtggccactgggaacccaaatttgaaagtatattagaatctctagaagagctttttagtaattggaatgcctgggcctcattccaaaaccattcaatcaaaattttgcagggtgcatagcaacatatatatatatttaaaactccacaggtgcttctgataagccagctttgttccttgatgaggcatctggaaacagcaaatttcaacaggtctcttcttccacatctttgattgacagttctgtttcccctgccagaaagactccaagcgatgcagaattcgttactttttgatgcagcttttttcatttttagacattggacatttctagttgtcaaaaagtacatatgaaactgaaaacacacacattgatcaaaatgagccattttctggaataatattaaataagtagtctgttttgcttatagtcgtttatcaataagtaaataaaatgatacctctctaaacttaccctagatgtctactgcataagcaccacaagcagtttaccatttttgaatttgatgttaatttcagatatctcacctttctaagtggctttatcccttgctattctagtttttccatctctctgtatgagaagataagacctgacatatttactgattacaaaatatgccacgtgttgtcttgttgctgtagagagatgtgagatatttacctctttttaaaatacaaagcacttgtactgtgttttctttatcataatttttgcttttcaattttatgttttaccttcattgtgttaatgatattgaccaacccttccaattttgcattgttctcaattggcttaacatgctagtcatgatttcaaccaaatgccttccaagaggaggcattgtcaaacaggtggattatggtattgaaagaggctcattaaaggcaattggcagtcgttccaggcagactcaccatcagagaggtctaagcaaagaattaagacagatatatctgacaatggctagatgccataataaaagagtcttgcaactgaaataatacagaaaccagaaagttataagaggaggtgctcgtcagaatagaaaaatagtaggtaaattgttttaatggaattattctcttttgagagtactgatgagagaaacattaaatttcagggctggaaaagctgggtagaactgatttactagaatgaagcaaacagtaaggttgataatgtgctcttcatcaaatgagctacttgagttatttaagtttccttgcctagtaacaataacaacccaatattgggatggatatattggtagatctattagaatggattcagctgtagagattggagggctacttcaatgacagggagctaaacagtttattatgataatgatgcaggtacatgaacttaatgaaaatagttattctcttaccatatcctcacctctacttctattcatgtgttggcttcattctcagtcaagttagcagactctggtgacctaaagcatatcctgacagatgattgtattaaagaaagatcatttcctgtgtgtgtgtgtgtgtgtgtgtgtgtgtgtgtgtgtgtatgatacacatagggatttttatccatacatcaaatactacatgttgtttgggtccttttccattcttaaaccaaataatttggtcaagtatatggagggctctgagttaccaccctgagttacatgatgactctttggtagaagggtgaagggtaggcatacatatacacatgtacctccttttttggtttgaaagcaatcttacttataagaaaaattaaggaaactataattgttttattataattcattattttaaaatcccttttagaacataccctttgaaagtttagtttatatttatttgtttcattttgttttggtcagctaaaaattattttatggtcttaacctttctgttatttttcttatagtttcaggatagcctttactattctgcaacaaggttggtggtaaccttatataaatctccactgtaatttgttaaactaattttgaaaatcagagacctagatatgcataataagtattgacaaaatatcttagcatggaaatggctgtatccagtatgctgggtagatatgtacactttttgttacccatatgcacaaaaacaaagaaaaaaatcaactttatggatgaatcagagggttatttatgggctccactgcatactgaaaacattgatttaatgttttcaaactagagtcagtacatagtctagtgatctaaactacttaagcaccactcttcaccgtatcactctttacttacaatttaattgccatgtgttcttttgaaatgagcattgaaggaccatcctcatgaatgcattcctaagaatcacaatgtttattctgtgtagtcttgatgtaggtttaatcaagacccttgaaatggacacattcctcttaattgattgcaaatgtttatgattacccagagagtgttttcaaatgtctgatgactataatattactgactttctctctagacagtcttaaagctgtttattgctcatttggctactttccagctttcagttgtctcatttacttccatgtgcatcaataagcatataattaatccaaacatcttattgaaccatttcctttgcattagtatatatgatgttaagtaggtaaaatttatatattctactgctttggatttattcataagtaaaatgttcttaacaaatattgatcagcatcaatgtaaagatgcctcttatactgaaatattatgatctcatgctcagatcacaagctattatcaaatagaaattcaatctcagtgatgggccactgttgccagatcgtgtcacctcagaaatctagtatagcatataattatctttattttttaaatacaaagtaaaaatgcagcacaaatgccaacaaaataataaatgactcaaattctttttgaagtgaagttttttctaagcaagattttttaaatggcttatggttaaaagttttattttctcaggaagcaagccatttataaagtatgttttgctattcacgtgttgggaaaagtctcttcagctcaatgatgtatctcatatatccagcagtatgacatactccttcctatttttaaaaaaagcccaaggtttcaaatattaattttaatgcttggcattctgccataatttcagaaacaccaagactggctgaatacagtactgaagcctttttctactccaagtgaggtcttaaaatgtattacatgattaaaaagattaaatgtgcctaatctacacagaggaggaagaaatgagtagaggaaaaaaataagacacaaaaacttagtgacatatctcttttcctattgaattcaatattttaaaagtgatatttcaaaacaataatcagactgagaattactattttatgtattccagagaatgccactaaattttgttaaattgcaactgtagtttggaaaatgagtagtattgcaggatacctctatctgtaatacagtctgtggtatcatcagatggtatagataatatactccatgagggcaagaactgttttttgttttgctcaacattctcttccaagtacctctcacagtgcttggcacatggtaagcaaagacttgaaacagatttatttgtttatgtttcttaaatttttaacattgatacatatgacatgtacatatcatattttcagggtacatatgataatttgataaattcatgtaatcaaatcagggtagttgagatatccatcaccttaaatatttatctttgcaatagcagcatttgaattattttcttttagctattttgaaatgtacaatcaattgatcttaactatagtcatcctactgatttattgaacaccaggtcttatttcttccaagggtatatttttacccattaataaacctctttccattcccttaacccctctacccttcttggcccctggtcatcaccagtctgctctctatcttcatgaatttcacttttatatgttgagaaatatctgcttagatgctgaccactggtatggaatgagcaataccgtgtcatatttctgattaaaagccttttttggggtcagtttagaaatatacattaaattctaatatttcctaggattttttcctaccctaatctactttaatataaaccattttagtagagagattaaaattaatcttactttacagatgatagtaaagtcattattttacgtgatttaataaaatgaatcattaagcttcaatcagccactacctcttggaggattgttgtgggaaactggcctaaataagtaacacaatacagatatctgagaaattgatggttgctagaatgttatagacatcaacttttagttcctatcaatattttattccattttcctattaaacaatggcagaataaaatcaagataaatgttgttattagcattatcacattaaaatatcatttcctgtttaaatgttaatttcttccactaaactggaagcacctcaaagacaggaactgagccttcatcttccttatcaaagtatcagatgtttgctttaaaaaaaaatgtattaatcaagaccctttctcttacaaatagcagaagtttacttcaaaatagcttttttaaaattgactcatgtagtttgaaagtctagggaacagctgccttgcctctgtttcactttagttactttcacactagacatgttggctcctgcaatcgcaaaactactgcattgggacaacttgtgatacacaagaaagaccacttcttctgattatccatatttcacatttcagtcttcactgtaatttgttaaactgtttctgaaaattagagacctagatatgcataataagtattgacaaaatatcttagcatggaaatgactaaatccagtatgctaggtagatatgtacacatttgttacccatattcacaaaaacaaagaaaaaatcaactttagggatgaatcagagggttatttatgggctccactgcatactgaaaacattgatttaatgttttcaaagtagagtcagtactatcccttaaaaaattacttaggccagaggacatggagagttcgaactaaccagcccaggacacatgaccatccagcaatgcaacctagagagttgggcacatgtagaaaacaagggaggcatccagatttatttcttaaatgaaaagtggcatcttgttgtttgaataaaggaaaagaaatattgggaagattaaaaataaaagacatcaactacttagccaccagtataaccctgttaacttagaactatgattctaagttaacagggttatactggtggctaagtaagaatccaaacctagttttcttacaccaaatgcagtgtgttttcccctagataaagttgttttctaaatgaaagatggaaatgttgactgcaaatgatttataaaggctttacatatcatcaaagcaccctgaaaaccaaaacagtaacttttgacttgataaatgtaaggaaacattcaggatgaactctgtcctgtgccaccaaaatcccccttcaaaactgaagactgtcttctcccaaatgctgagagggcttgccgctgactaccttccttatgaattaccctccgcttaggggaaccacctcaccaaaggacacacaggggtgtaaaattcctccttccaccagcgctaacttgggataactctgaagaccatcccacttccagagctccctgcaggtcttcgctgagactgcatcgtagcctccctctgctggctctttcttgttcccttcccttggggcacagtgttattcccgagagcagtccctgatagcctctctagtctccaatctctaccccagagtcggcttcctgggaacctaaccttctacagttaatctgcttttcttaggcctgaaggacaattaaatagtaactaaaacaatgaaaggttttcaagggaaagtatttatgtgtttgctatctttttatctaaaattttcctctatttttaaacaaaacctcacattactttttagcatggaaatgtttataccttaccctcttatacagtctggataagaaaaaaaatcactaacatcagggacgatatgcttatccaggttctccaataactacttttaagggaggcaagcagagttgactaagagattataatcttggcagtgtgcagaatgttttcagtatgtgcatttactgagaggagagagaattcataatctttgattttctcaaaagagtctgtaacacaaagaaggttaagaaattggagcactggttcccaaatagtctcttaagaagcatcaagtgagagaaaatcccttgttttttttttttgtttgtttttttcctgagcgtttctgatcccatagaaatgggattgagcaaaaatcttcatttttttttttttttaagtttcagcttttactttaggtacaaggggagtgtgtgtaggtatgttacatgggtatattgcacccaggaagtaagcatagtacccaattcatttttcagcccccaactttctctccccggctagtagtctttggtgtctattgttcccatgtttatctccaagtgtagtgtaatgtttagcttccgcttattagtgagaacaagtggtatttggacaagttttccagatgactccaaaataaaactcagtggattacaatttggaaaaatacagacttatggatgaaaatatagttctatgttagtttctattgctggtgtatcaaattaccacaaatttagaggcttaaacaacacaagttattaatagtattttttattttattatgattatactttaagttttagggtacatgtgcacaatgtgcaggttagttacatatgtatacacgtgccatgctggtgtgctgcacccattaactcgtcatttagcattaggtatatctcctaatgctatccctccccactccccccaccccacaacagtccccagagtgtgatatttcccttcctgtgtccatgtgttctcattgttcaattcccacctatgagtgagaacatgcggtgtttggttttttgtccttgcaatagtttactgagaatgatgatttccaatttcatccatgtccctacagaggacatgaactcttcattttttatggctgcatagtattccgtggtgtatatgtgtcacattttcttaatccagtctatcattgttggacatttgggttggttccaagtctttgctattgtgaatagtgccgtgataaacatacgtgtgcatgtgtctttatagctacatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatgtcctttgcccatttttgatggcgttgtttgtttttttcttgtaaatttgtttgagttcattgtagattctgcatattagccctttgtcagatgagtaggttgcgaaaattttctcccattttgtaggttgcctgttcactctgatggtagtttcttttgttgtgcagaagctctttagtttacttagaccccatttgtcaattttggcttttgttgccattgcttttggtgttttagacatgaagtccttgcccatgcctatgtcctgaacggtaatgcctaggttttcttctagggtttttatggttttaggtctaacgtttaagtctttaatccatcttgaattaatttttgtataaggtgtaaggaagggatccagtttcagctttctacatatggctagccagtattttttagatcacaagtctgaaatggaatctcagtgggctataatcagtgtcagcaatgctgtgttctctggtggctctagggaagagtcaatttccttgccttttccaccttctagaaacaacccacctttcttcactcaagatctctttcccccatcttcaaagccagcagtctttcatctctctgaagatgctgagtctcaacacattcttcaggagttagacctccctttgatgctcctgttctgtctccctcttccaattttaaagactgtgattacactagagccacccaaataatatgggataatctccctattttaagatcagacaattaacagctttaattctatctgcagccttaatttgtctttgttgtgtaatctagtatattcacagattacagggattaacatgtgagcattttggggagaccaatattctgcctaccacaagttcctttatagtgtcatggaaaaaacatcttcctcctcccccagtcttatgtttaataactcaattaatgagccttccaccacctgttgttatgtaattatctggtcagtagaagaaattactggaaactacagaaacttcttttagctttctgttatccataaatagcacctagtcacacccactcacctggaagcaccttgaggtcaggaaccatatattctttattttggaaacacagataactcatctcattggctgccagctaatcagcatacagataatgtggctgaatgattgtgatgtgtgatgatgtttgtgttcattgaacaaaaccaaaggcttactctcttttattttttatttttttgacatggagtccccctctgttgcccaggctggaatgcagtggtgccatctcggctcactgcaacctccgcctcctgggttcaagcgattctcctgtttcagcctcctaagtagctgggacgacgagcatgcaccaccacacccagctaattttttgtatttttagccaggctggtctgaaactcctgacctcaggcaatccacctgccttggcctcccaaagtgctgggattacaggcatgagccactgcacccagagtactctcttttttaatgactcttacacacagcagctcataaagagcatggctctgaatcttctctcattgaacttaccagttgccacatatcatgggtatttggtgtcatttcctcaaataagcaaaactatttatgcttaactcctgcattccatgagtctgccttgtaatttatgcttgccattttgggtagctagccatcagtaaaatttaggcaatctggcctgttggtgggaagagtggtggtctcttaacaaatagtcatgttctttactaacaataaaggaattacaatatgttagaccctacactagattttgtatatacacagcaaacacacatagacacttttgcaaaatcaatctttgaagacttctataagataaatatttttttctgggagtggtggcttatgcctgtaatccaagcactttgggaggccgaggcaggtggatcgcctgagctcagcagttcaaatcagcctggccaacatggcaaaaccctgtctctaccgaaaatacaaaagttagcctggcatggaggtgtgcacctgcagtctcagctgctcaggaggctgaggtgggaggatcgcttaagcctgggaggtggaggttgcaatgagctgatgtcatgccactacactccaacctgggtaatagagtgggaccctgtctcaaaaataaatataaacaaataaattcttcatttacagttgaggagaaattttcaaaaaatgttacagtcacatatctaagaagtgacaaccaggattccagtgttaggaaacagaggggttatagtggtcttttgtcacatcacttttcagtatgcatatcactctgatcaaaaattaaagctaaaaaacgttatatagtttcaaattaaggataattaatttactagatcaatttatttattaaaaaaattttttttgagggggcatctcactctgtcacccatgttggagtgcagtgacacaatctcagctcactgcaacctccacttcccaggttcaagcgattttcttgcctcagcctgggtatgtatttttagtagagacgaggtttaccatgttggccaggctggtctcgaactcctggcctcaagtaattcacccacctcagcctcccaaagtgctggggtttcagacatgagccagcacgcccagccccaatttaaaacatgcaatcaaacacgtcacttccagacttaaactgcttttcattctgctcacatatccagtcatccacttaaggcagatcctctacttgaaactttcaatagattaaagctgtattttgaataaaattaaaacctcttcctgtgtctcacagagatctacataacctgactcttcctctccatccagcttcatgtctcactagctaggctgcaaccacagtggtctcctatagatttttgatccacaggctctttaatgtcctggacattttctgagctgttgccttttctccttatctatttgcttggataatgtcttcttatactttacctcagagtttaaatactagttttgcagagaaaccttcctctaagtaaaatatatcctcctcctcaccctattatcatctaccaatgcattcattgttttcttccaaacacttagtgtgctttgtggttttagtttgtttacttgtttattgtctgttttaatgtttgaatgggtattcattgatgtgctcctagctcctagtattgtgtctaatattcaacaaatgtttttggagaacaagttttttctcaaagtgaaaatgtaaactagtactggtattttatttttgtaatcagaagatttcacagagaataagtaatctgaaactttattctctagtcatgctctgttttctgagcatcttggatctatttcagtgttacttttgttttgtttgccttgtattcagatgtacaatttaagtaactcaaataaagaacaacttacaatttgaaatcaataatctgctctgtctgctctgacatgtattttttttttctttttttttttttgagatggagtctcactctgtcacccaggctggagtgcagtggcatgatctcggttcactgcaacctccacctcccgggttcaagcgattcttctgcctcagcctcccaagtggctgggactacaggcgtgtgccaccacgcctgactaattttcgtatttttagtagagatggggtttcaccatattggccaggctggtctcaagctcctgacctcatgatctgcccccctcggtctcccaaagtcctgggattacaggtgtgagccaccacactgggcctctgacatgtattctaaaggtatattggttctggggtgaggcccaagcttgtgtatttttgataagtttctcagatgattctgattcacatcaaagtttaagaacatctgcttagtatgtacatagtcttgttattgtacctctaccagtgtcaaccaaagtccatcaaatttaaccctttgcttaattcatggttcagagtcttacacctttatgtacattctgacttggatattgaatgaatacataacacctttattattccacctcttttatctcatcctctgccctagctgaggattttattcttttaacctgctttgatggtaacatcctgagtttaccacataattaatgataagaaatgtaagatagaatttatacagtatatatgttgtaaagatttttaaagtcatcagataagtaaacatataatatttacaactattttgaaatgaaagaattcagaagaagaaagcaaaattgttgttttagtcaatttgtaaccttgcaaatgtaaatgtttataagagtaaatgtagtttctaaatttttggctatttgttttcctgttctgtggttttacttactgctttttctggtttgtatgttgaaaaatacataaattaactattaccactgagaggcaaattttacttgcagggaagcacacactattaaggattttgagatctagtctattcataagttccctacaatcccatttacttgtttctctagtatttgccctttaaatattttattctttggatatataatgaaaaatatagttcatgatatagtaaaagaaaatctactatattaagattatagcataatctatattaagcttgtattgtgccagatacttatttcagatatcttcttctataaacaagcaatctgatactaagaagaaatatttgtgatatttcagacatttattgttacttaaatacacatcaaagtacaaatgataaactctttagattgaattttacttttcttatttaagtgtgacgtggacactggacattttaatttgataaatttctagaactttgcttattttggaataagtatgtaaatattttgctgatcatcatgcaatcaaaaatgttacttaatattttctaaaatgctgaaatatgttttgaaaaaatatgttttgcacattaagtattttctccttactaaggcaaacttggtatctcctaccaacttttccaaatttagctaaggaggtaatactaattaaatagattaaaatgcagcttttatttgtggtctaagttacctgaggccctttgaagataaccttttgaaactttctgtttaactgataaaagtcaagtttagtgatactgttgcctattttaagaaacattcataatcttgattcagattcatcagtcatcaatgatattcatgcttacatgaggttaatattactctttaaaatgctaaggaaaatagggaatgtctttcccttcttcttgttttgctctagagaaatggggcatctctccaaccatctccgtgcaccctcacccaacatttctaggattgacatcatttaggttccatgtagatagaaagaaatccatttaaaaaataacaattcctacatttttcatgtgaacatttcaaaatgtaccaaaccttaaacatacttgagagttccgtcagctactcagttggtaattttagacagcctacagtgtggaacaataatctattctgatataggtgaaatagcttatgccttccttctgtacaataattcacaggtattttgatgggcttttgatgtttccagatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgaggtaagtgaaaattgtcttggggtgagagttgtacaaaacaattaaaagctttggaatagaccctacagaggagatgaaaattaagagcagtgcgagggaattaactacacaattcttgttaacactaatggaggtagcatagtgaatgcctcacttatctcatttaccccttactgtccagttagttgctgagagtatttgtgtttatatatatttaggcacatagacagaacaattttaagaagtcttatagaagtttaaaagtgctgttgacctgaatgaatctggcaagatcaagaataaattcacaagtgcacagctctctaactaatccttagtaatttttgtaagttaaaattttacttctgaaaaaataattacttgaatcaggacattattgcctaaacatgattactgttacaaaacatatacagatttatatcttctctgtgaactttgtaccaacacaaataattaagtgtctgaaactctgtaaagtgatgactagtgtacattttatgatgctgcatcctcaaatttttaattgtatctgttcatttagttagaagctctgaaacttagtaaaaatacaattaagactttctagtgataggtataacatctctatgttctaaaatgcctgctattgccttgtaaaagtttattgtcatgtctttttgccccacttcaagtttttaatgttacatagtgatagaactgttcatgactttacaaactttcacatggaatttttaaaaatattttaaatttgaggacgggaatttatttgtttaatactttttttttttttttgcctcatttcactattatgcttctgttagctcctgaagtactgctataaagattccaaattaggaacatgttagaagttctttgacactcacaatatagttggtatcaaaaaacataaggcagaatataaatcactaggaagggtaaaacttgtggaaaactgtcagtaatataaaatttttcattttaataggaaacttcattatgcagtttaaagacaaattatacacattttactttttgagttcagcaaatgacttagagaatcttattgaactactacattttttcataatataaaatatttccaattttaaagaagttgggtctttccttcaagaaacacaaatctggaagatgggagtgagtacacagaggatgtaatataaattaggatgttaaaattgcaatagaggcggttgaagcatctatggtcatttttgttggaggagatcagagaaaacctcactgagcaggtatatttgaactggacttcgtgtcatgggttaggaatttataaaacagaagtggtaatgatatggtttcgctctgtgcctccacccaaatctcatcttgaatggtaattcccacgtgttgagggagggacctggtgggaggtgagtggatcatgggggcggtttcccccatgctgttctcatgatagtgagggagttctcatgagatctgattgtttaaatgtggcagtttctgctgcgctctgactctctcctgcctccttgtgaagaaggtgcttgcttctccttccaccatgactgtaagtttcctgaagcctcctcagccatgtggaactgtgagaaaattaaactgttttcatttataaatgacccatcttgggtagttcattatagcagagataatgctagtgtattcctttgctagagctgccattggcttaaacaacagaaagtttgcatctcacagttctggaggctagaaatctaaaatcaagatgttggcaaggttgattccttctgaggggtgtgagggaaggaactgttctaagcctccctccttggcttgtagatgaattctttttccaatgtctattcacattttcttctcttcgtgtttgtttgtgtatccaaatttcctttttctataaggacatcagtcgtttggatgagggttcaccctaatgacctaattttaatttgattacctctgtaaagaccttatctccaataaggtcatattctaaggtaccggatattaggaattcaacatataaatttgagaaggaggtagtgatggcacaactttacccataacagttaccattagctgttatgagcaaataaggcagaggagtatgtttgagagttcaatttggatcctgtaaaatttgagctagcagtggattcttcaggtggtcttaactatgttttaacacctttatagtacttactatcttcttactacttactgctttcttttctaacacctttttaaaaaatgaactcatataatcttcataaaaagcctttgagttggtactaacatcatccttgttttgtagataagaaaactgaggtgtacagggtttaagttgtcaagatgacacaactaggaagaggcagatctgggattaattccaataagtttgtctctagagtttgtgcacttaaccttggttcccagacaggttggttataaatgcatgactggagaccaggaaaaagatcagtgctcgagatgtagtttatttgtttttcatcagtttaatatgcattgatttactagttcactggttttccagttcatcgtagaaactatgctaggcactagcgatacaatgacaacaaagatcccattccttttctcaagtttatagcctggtgttggagaaggaaaatgaaagagtatcagcattacaagatgcatgtaatggcagaacacatacatctacgctgatctccagagccagccatgtctggttgtagaggtaaagtatacagtcatgaaatgttgaggaaggagcttgttatagatggtatcttgaaggaggtgcttcttgagttgagcgttaaaggacatgtggattggatcaggcagaaaagggtgggaagaacattctaagcagcaggaagaccataaataaaaccacggaggcggggcatgcagcaagaaggcaaagggctagggaaggaatgggtagaggtgggtgtgttgaccaccctgttgagacgtttggtgacgaaagtaagggtaaattatggtttaaaatttttaaaaatcccatgagactgatatcagaaccagggatatctgtttcatttttaggataaaacaagctgagccttttcacacaggtgttgggaaagcaaccagtgatgaagaggagattgtagaatggaaaaagaatattgatgagctaagaccccagagtgttagaattcatgaagctctgccaggggactactactcattaccaataacctacaattgttgcttcaaaggtagacagaattagttcagacttcattaaaggaattttcattgataatccttgtctttctgataatcaatttcaactgatatgatcttaacttctcaccttgtcccccaaccttgaccctgaactttatacttataataatgtatcccttccatcttggtccccaaacacataaaatctattatctttccttaaagacttttctgtctttccccactcatccaccatttttttaagtaacttatcttttataatcactgattttatgtctccaaactgtggaccagttattccacaggcatcttaagcaatgatgtaggaatggcagacagaatgtgaactaccaccacctctatcctagcctaagctcaccctattgtactgttctctgacctgcaagatggttcctgtttctcaattagttgttctcagacacatcccacctcctcgatgggttctaggattgtttcttttgagtagggaataggctgaccctattagtgctgggagcagttcattcaaaagacaggcagaactaaatttgaaagagtacactgaaattctgaagacacaaagagaaattatttctgtgtgacctagagtttcactcagtctagtggaagaggcagcatataattaaatattactatgtgaaagaaaattctataataatgatggatcaatgatgttctggaataccgtaggagaactgactcatgctacagagagcttagccagagtcagaacaaatttcacagataagttgtgtcaccagactcttgaaaaataaataagaattaatcaggtaaacagtggtgggcaaacaattcagaatgtgtctgtgtgtgcttgtgtgtgtgtgtgtgtgtgtgtgtgtgtgtatgatatatgaacagaattaaaaaatcaaattctactgaggcttttaaaattacaaaacaagagtctatttatttctacctccagttattcttttcagaagtatttattttttattttaaaatttaatttgtatttacttttagcatatcctgtgtatttgcattgttcaaaatttaaaaggttcaacaaggtaatatcctgccactgttcctcaaacacctgagttccttttcatgaggcaaatagtgtttcttatgtggcattccaagtatatacagacacacacacacacacacacatttttattatttttcttacataaatagttatgtactatgtttaaattctgagcttggaattttaaacttagtaacttctagatcattctattgagacatacgatgtgttcctaataatatctaatggttatataatattcccttggtaaatgtattagtccattctcatgctgctgataaggccatacctgagactgggtaatttataaagaaaaagaggtttaatggactcacagttccacaggactggggaggcctcagaatcatggtggaaggtgaaaggtatgtcttacatggtggcaggcaagagagaatgagagccaatccaaaggggaaaccccttataaaaccaacagatcttataagacttattcactaccaagagaacagtatgagggaaactgctcccatgattcaattacctcccccaggtccctcctacaacacatgggaactacaggagctacagtttaagatgagatttgggtggggacaaagccaaccatatcagtagattaaatgactcttagctctttaacttttttgttttaatttttacttactctagtaaatattactggttgatttattagtttgtcatctcttacctaccttttcttatataataagtgatgatttacttcatgtccttcacctacacctgcacatcctctcaatatattactagttatagcacaattttaaataactttatataacacagttacacttctatttccataccaactactgttgacagtatagtaattgtaaagacaatatactagttgtaaaagttcgttcactatttttccactcttctacctctcagcttccatgtcccacagatttacttttatattgagtgtgttggaagcacgtattttctattctgttactagaaataaattattcatgcttgactaaaagttggctttataagatgaaaatctgtaatttgcttatgttttatcactataaatattgttcactgtacaacaaagtattaagatatgattatatttagttttttatcactcagcttcaggtttcttgtttgaattattacttttcttacttttttcttcatctttgggtatgaaaattctaaattgctgttttcaataacaaatctccaaaatccccatttcctgactgcaccctttcctcccagagaccccctttcctgctctgtttctggtgcatccttaaaatcagataaattctagtgggtcagatccacaaattcctggttcctgtgtcttaacaatttcttagtttccggccttgctgggaaatatcttgaagtaacttctgaaggaagagggttttttttttttcttacagagaaaacatctgtgttagataagctgtgtagaggcaagagttatagtgctgttggccacaagttcaatgataatgaatcaacaatgaatattaaataaagtgcctttaaatagaaatgcataaaaccagaggctggcagggaccaaactctgtatttcccctaggagcagtgattcaatattcacaaatgcagtgttcataggaattttatagaacctaactactgtgaatgacaagcatccacaatcattgttattatattcacttatgaaaatgtattcattctaacttcatccttgatgaataatgtggctaattgtaaatttctaagttaaaaaattatttacctcagaacatcaatagcattaatttattacataatggtaatttgatcatttagattgagtagatagaagatggatatggttattttactggaggtagtgctagcttttgcatgtgtatttatgttgccttgctcttggataataatggcgacattagttgccccaattcacctagaaaattcacctatttatttagaagagaatcctatgcttcttactttttttttcaagggataaatatcagctttcaggaacattttgcatgtgacagcatgtgagaatcaacatacatttacgtacaatcagtctgctttattaactgattttgttttttgcaaattcacctattcattaagctttatttgtaattccaaaatcaatactcagtgcactttcatgatcatatatttgcatagctcaaaaacttgagttgttagtaattaaggtcaaataaagctgctctctgcattcttgttttagctcctctatgacaagcaagtgttcttttctctatctatttatttagtgcctttttcaattttttgtgctttcatcagtgatttccctgtttaaaatatctcccaaacatagtgctaaagtgctggtctagtgtccctaagcacaagaaagctgtgatgtgcatcacacagaaaatacttgtgttagataagctatgtataggcaagagttatagtgctgttggccacgagttcaatgttaaagaatcagcaatgcatattaaataaagtgcttttaaatataaatacaaaaaaggcagaggcttacaaagaaccaaaccattcccctagaagcaatgattcagtattcataaacacagcattcataggattttatagaacctcgctactgtgaatgacaagaatcctctatgttcccatattttgagctctccatctcacacctaccttttatttggccttttcaactatcaagacttctatgactctgcaggtagaggtcttgatgcttaattgctgcccttatgacagtctgtagtctacggcttctgccaccctgcttcaccagatatcattgctacctctgatcaagcgtcactgcttcatttttatttttcagtaatttaggcaaaacacttttctgatggcctctgttccttttctcatggttgttggctcatatacgtattcaattcttcatattttcatgagactctgggagtcatctcctttaactttcttgagttgaaaggtccagaatattctttcagatttttagagattaaagctcaacaatgataagggacgtttaagaccagtttttatagattttatgaaacaatattaaatcatggcatttcagatttgaaaaatataatatgtaatattttgttgaattccaaatatatagttgaataaattaaaggcctctctagatctaactcacattcttctctaacttcctccagctatgttctgcacctctgcagattgtagaggacacccagagtttgaaactggtcaaataggttgttagcaggtcaaaggggtgcagaatttttgcatctgaaaagaatttattgaaaacggcttaccatggattatatgatagaaaggcaaatgaagctggaaagaaactgatggattgagaaattaggaaagacagagaaactaaaggttatgatgaggtcagagacacaaccaagttcagcaagtgccttaaacagagagaagttgaggggagaaattctggtaaaaggggaatagcagaactttcaaccctactgttttctatactttataagttagcatgcaaagttattgaaatattcaagagaaatattaactttaaagtcagaagaatgagttttatcaaagaaattgctcacttagcattgtcatgtaattgctaaggggaaaaataagcatatcaattctgtttgcatctttttcttttttttctgtccctggagaaattatgtagcattgagttaattatgctccctttgaagtcttagaaatttaatacattaaatgtctacacttagtgctccacctctcattcaagagtatcaaagctttaagaaaaatactgcagttatgtgcagctgagtatataaacctgctgtgatattggcagaaaattgttacacaatatatctgtaagtgtccttgaaatgaatatagtgaaacagcagtgctcacttggttttatttaaatatagattggaatgatattttgaaaaaaatgtttttatataggaataatgttgcatttgttgctgtgtacattatagtctttccagaaacaatacaaaaaaattctatataaattagacattttggccatggtctttagtgtttgggtttgagaagatacgccaattctttgaaaggaggaagttttactatttatacagcaatagatattgtctccaatttacattttttcttcaaattttcagaaaggaaccctactgttccatgacatccttttatttcacagtaagaaaaggttattattatcttgtattccttaaacatactttatgaaatagttttcattgtattgtactataccctaggttcattgaaaaaaagaactttgaggctgtcaaacaacaaaaaggcaaagttacatatttcaaatatgtatgcagcttcccaaaaataagcctttggaaagatttaggaaacaagggaaggtagcttatctcagtagatacagaatgactcccactcatcaaaagggtgcccttttaagaagtgtctgttcatagcctttacccactttttgatggggttgtttttttcttgtaaatttggtcaagttccttgtagattctgggtattagaactttgtcagatggacagatcgcaaaaatgttctcccattctgtagctcatcatcactggtcgtaagagaaatgcaaattgaaaccacagtgtgataccatctcatgccagttagaatggcgatcattaaaaggcaggaaacaacagatgctggagaggatgtggagaaataggaacacttttacactgtttgtgggagtgtaaattagttcaaccattgtggaagacagtgtggtgattcctcaaggatctagaaccagaaataccatttgacccagcaatcccattattgagtgtatacccaaaggattataaatcatcctactataatgacacatgcacacggatgtttcttgcagcactattcacaatagcaaagacttagaaccaacccacatgcccatcaatgatagactggataaagaaagtgtggcacatatacaccatggaatactatgcagccataaaaaagaatgaattcatgccctttgcagcgagatggatgaaaccagaaaccatcattctcagcaaactaacacaggaacagaaaaccaaataccccatgttctcactcataagtgggagttgaataatgagcacacatgggcacagggaggggagcatcacacacttgggcctgtcagggagtgaggagcaaggggagggagagcattaggacaaatacctaatgcatgcagagcttaaaacatagatgatggggactgggcgcggtggctcaggcctgtaatcccagcactttgggaggctgaggcgggtggatcatgaggtcagtagatcgagaccatcctggctaacatggtgaaaccccatctctactaaaaacacaaaaaattagccgggcatggtggcgggcacctgtagtcccagctactcaggaggctgaggcaagagaatggtgtgaacccgggaggtggagcttgtagtgagccgagattgcgccactgcactccagcctgggcgacagtgcgagactctgtctcaaaaaatataaataaaataaattaaaataaatttaaaaacctagatgatgggttgataagtgcagcaaaccaccatggcacatatatacctctgtaacaaacctgcacgttctgcacatgtatcccagaacttaaagtataataataataaaaagggtgccctgagtactcaaattgctgtgatagttatttaaatgacacatttttttctaaaataaattatttggagacattatacaatgcacaattttaaagatgaagcaattataatatagtgcatataagtttacaactcaacaaatttccgtgtgaccatcatccagatcaagaaacagaacataactagcatgcccagatttctcattcatgcacgctccagttaagatctccccaaaggtatcctgacttttaacactattcaactagttctgattaattttaaactgtatataaatagaatcatacggtgtgtactgttttgtctttctttcgttcagcattatatctgtgagattcatccatgttgaagtttgtagaaaaaattcattcattttgattgcctcaaaatattttgttatatgaataagacagaatttatatacttctgttgatgatttttttacagttttgctcattacagataggggttctatatacatctttttggatatgtctgtagttttgttgagtatatacttaggaatgaaattgctagctcaaggagtacgcataaggcatgttacatattaatgctagctgatgctgccagtttcccaaagtgtttataccaattttactatttgaagtagtaactgaaagcattccaattttccgtttcttcaccaacacttgttattttctgtcgtcatcattttattttaactgctggacatatattagattcagattttaatttgcatttttctgatggatgatttattttgtatatttatttgcttcgaggatatttttcttttatggagtgcctgttgaagttatagtccccccttctttcccctcatgatttgtagaagccctttgaatataatggataaaagtctcttgtcaagtgaatgtattttgaaaatcttctcttctgtctgtcttttcaccctgtaaatagtgatgaacagaagttcttatttgtaatgtagtccaaattattacattttttgtagttagtactttttgtcttttttaaaagaatgcttcttactccaaaatcatgaagatctacatacaaggtttttctagaaacttgttttatcatttacatttaaatctgaagttcatctgaaattaattgttttgcataatgtaaagtggaggtaaagatacattttattttccatatggtgaacacttcattttaacacaagatcagtgtgtctaaatggaaagaataatagaagcttccaatacccattaataaagtgggagttgattagtgtatttgaaagtattatctctgtactgcatcctattgctatgacctatatattattttctaatatgaagcacatgactttagaagaaaaggaaaggttatactggtgaattaattgaaataagaatcttcctgtgatcccaggatcacaaaagttcgtgatgctggattctatggtaaaagttgtaactctttccatgggcccaatagttatgggtcatcaagtagcagatagtggccaatcactcaaaaacaaactgctccatataaatatagtttttacaattgcatggaattgtaagaaaaaaaataactggcttaaaaaaaaacaaatctctaacaggcactgattcatccctgatttagtttatatttccttgtatcgtatttatcaattattattaaactgctctcaaatctgagttttaactttagctttataagcttgtattgaaaggcagctctgttactagtcaatccacagatgtgggttttttttttttttttttttttgatgagaaagtcttaaatttattttactttgcgtttgacctaaattgtatatgatagttcttgcttctgttaatgaggcctgagacagcatcaagtttttcttttctgattggagagctgtttaacttgcagaaggtttctctgaacatggaaactaagcaaagaacgggtttccaatgagtctaaacttccaaataaaacagacccaaattaccgctcttgtgaccactgacttgggacactgatattggtggacagtttgctactaacttctcctaacagcctatagtctatttaataatttttgactgcaacatctactgctggtttttactttatactaagttcttaaataagtcaatcatttttattccattccatttgaattattatccaagcaataatttgaataattgtggaaaaacaagaaaatatctgaatatttgtgacaattgtaccattattttaaatataaaatcacagttgcttcaaccttcaagacaagaaaattgaaatccttctctaatccatttttcacttattcaattattcaaacaatatatttaaagctattctatgcaagtcagtgtgggaagagctgtaagaatacaataatgaatggtatatgattccataccccaagggatatagactcataaggaaaatgctgtaaacacgaagtgtgcaaaataataaaaccataagaacagacacagttaaattactcctctctactcctaaagggacttgagaataaagaaaacaaagttgctacctgaaacctaatcaaataaagtctattggcaatgtatgagttacacatccctaggttattcatatcaaaactttattgttctgctgtaagtgagaattcttgaccatttcaaaaattcttaccataacctgctgtagtcttctcaaagcaagtctagaatgtaaatgaatccaaaaataattaaatttttattgagttttccctccatgaaattatacaggtgattcaaaaacaaacggagtagttagactggacctaatgataaatttgaggttgggggaggggggagggatagcattgggagatatacctaatgctagatgacacgttagtgggtgcagcgcaccagcatggcacatgtatacatatgtaactaacctgcacaatgtgcacatgtaccctaaaacttaaagtataataaaaaaaaaagaaaaaaaaaaaagataaatttgaaaatgggaatttggcagtgtttgtctattgctgcttagagaagacaccagtcatggaaggcaaggacaggctaacatatgaaggtattctctgtggtatgtcaggcacaattcatcagatttaattaaaatgattttcaaaattatgcacctctttgagctctgctcctactctatgacataagaagccaggagaatagtgagctcatgcattctaagcactagagagatgtatttattgcaaataaataaattagcaatttatatgctgatttctatttaatttgcttagtacataaatggcaaatacatgctacaagtgctattaattccatttccagaccaaaaccatagattaccactatctgccctgctgtactgagcagctatagcaaatggatcttagttagcactggagtccgaacctatttgccaatctgggttagtatgagtcagtctcccagaacttaatcaattccttaaatacttactgacaaaatcaatattttagttttgtagagaaccagattttacggtaatgccaccccatgaagctttgttgaaaaattagatagtctctctagattacaattctatccagactttttctcactataatacaaataggagggaaaaaactgtcttgacagagcaaattaaggtcaatttgcttttcctaacaaaacccattgttattagaatgaaaaaaataccctgtagcatataagaaggttaaaaaattaaacttatatgtgtctatccaatagtaaaatttcatgaacatagaggtcctttaatgttctggctaattaaatttttagtgccttgtagactataccaaaatttctttttggtttctacttgtagaaaagtgttagaaatactttagtctgggtttttttgttttgttttgttttttgaggtaagagctagagtatagccaagatacctaaatctttcacattgatatatcagtatgttgctggatattcagattatcaatgcttattacattaaaattcacgttagacctgggtcctgaaatcatatttcacttttttcatatgtcttttttagtaagctatctgagatcctccttataaagttaaatataaatgtacccatgtctatgcaaagttttgcatattggcatgaaagagtatatatatgaaaacatacatttatacacaaataaatgtagaagttttgaaaaagcaaattcattaactctgattctctgatatatatacataatatttatatatgttataaaataatatctgctattcagtattttattctgttaaaactaaaagctattaattgatggctagttgaaacataataagttgttacttccaatattgcttgatcaaactcaagtcagattattagccctctctaatcggccaaaaacttcactttgaaagatatcatgagaaacttgcaaaagtaaattgccatttaaaatttattgtgtagaaattacttttttttaaccgtgattcttgttttgttccttaatagcctaaatatcctgtaaagaacactggtattaaatgtaagaagtaggtgaacactttaattttgaaaaattattgtaatgaataagcaaatccttattaaaaaggaaaagtgaaagatgaagggtgggtttagaactgaccagaattcttaagtttaatatccataaattcttacatataggattgatatccagcaggtgtgcacctataaagctctcttcactgcttatgacaggcatcctttctcatggaagatgtcctatttgattgctgagtggctgttttacagagttttaaaaatattttgaataacattcccaatcacatgagtcctctaggaatgtagaattgtgagacgtacatctactgatccaagtaggtaacttcttcaatccacatctcttcatatatcattctgtttttagtcttcttagtgaataaaaataatgtcaattttaaatgtttaatacctaataaatatttgcattttaaatttcactcactattatttaattagcattagtatattatagttagactacatgttctctaatttggaaatgtttccagtgataatttttaattttttttcaaattgccagttttaatgaggggaaaaacctaactttctctttattttgtttatatattcataatagtctacagagttcaaaagaaggcataattggcataatactttagagataaacaaaaatgtgtttacctaaaacaaagtttcttgggcttggcactattgacaatttgaaccagataatttttgttgtgggcagatgtcctgtgcattataacatgtttagcagcatctgcctgtacctagtagatgtcaataatacctaccccagctgtggtagaagataaaattatccctggttgacagtcattgataactatttaattctttttttttttttttttttttttttttttttgagacggagtctcgctctgtcacccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccagataactatttaattctgaaacagtaaatttttgttctcatgaagtttttattgctgtcctatgataattacttttcactttaccactaataatagctagctagcatttattaggttctttcagttgtgtgacactgctaatcactctgtaagttaacacttataatcctcaaaaaacccaatggcatagatagaacagtatcttaatttcacaaataaaaattttgtaaaatgatgtataagcatttgtctatcttaattaggtagatcgtttgcattttattttttgtttgcttagtgatcacttgcgaagttattatactattttttaacatgttcatcatgaaatgcattttttttggagttacttggtttccaagtgacatttaactccctaaaatagcatttaatcagtaagtttgtgttgtggtctttgaacatgccatctgagggacaagagtgtgctagattgccttttgacttacgatttttagaacaaaataaatgaaaaagaaaaagaaatgaacatatacataaactgagaagcataactaattgacagcaagaaatgacttgattctcaacactgtaaagtagttgctaaaggcagtagctaatatttattgtgttttccttacgtgccagacactgctgtatgtgtattttacatatgtacacatgtatttatcacactaaacctaggggatagatgcaagtttagcctcattttacagctgaggagattgatacacagaggttgtaaaagtagtttcaggtcacacagtgagtaatagcaaaaccaagtttagattactagtacggagtgtgctaggctgggcatggtggctcatgcctgtaattctagttcttgggaggctgaggcaggaggatcaattgaggttgggagtttgaactcagcctgggcaattgaagccagcctgggcaacatagggagaccctatctctacaaaaaaattaaaagttataatagctgggtatggtggtacatgcctgtagtcctagctactctggaggctgatgtgggaggatagtttgatccccagggttcaaggttatagtgagctatgattgagccactgcactccagcttgggcagcagagtaagaccttgtcccccgcaacaaaaaaaaaaaaaaaaaaaaaaaaaaaaaaaacaacagtacgtgctatattggttttacagctctacagtgaaagtgaaaaagtcaacttaaccttttattcatgacataagaggtagtcagtatgcctaactcccactaaattatttgtaaggcgagcttgtactgtgaactttatcagtaaaatctattacatggtatcataatataatggaggaattggtcaggattatggatttttgtcatatttcgcccttaagcatagagaagaacagaacttttggattaaatggattaattttagtgtatgtgcttatactagagagagaaaaagagagaggaagaaagaaatctaggttgaataaatactttctgacataaagaaattttgaaatatggaaattattattggaactccagtggctcacaagatagtatttaattattgatatgataagatcactcaatatgctgaatgtgaattttcagaacaaaagagaaatgttaatggtggtttaatctaagagatccaatttgtcaatcaatctcccattggacttgtagagaaaacagatggcaacgatgattccctcattgctaaactgtcctaatcagggctaagaagaggagcaggaatggaaacttgggaaacctgaggtacagaaagcggcatgagcctatttcttagcaaacacaagtttgccttttctgggagacctgaaataaatgttcatcctggttcaaactcccatggtgatcctgacctgagcttagagttgctacaaaaaaattcacaaattttcagcagaaatgaaataagaatttcaaaagagactccgaatttgatgagtagaacttacgctttgcatttctgtaactgttttgggaattgcaaacctcatggtattactaaattatccattccctattctaccagtgttggtttgtattctcaagatatattgattgccatgaaagcaaactaaagccacaaacaaacctatcaacctagcagtccaaccttctctggacattaaatttatatttttaaaaaactatctaaaattcagaataactgccactaggagagtggagaaatttggcaacaaatatagcttaaccacacaccacacaaataacttttttattataagtaactgagaagtttagcaattagtacatctacttaattgcattttaaactgtaacgtgtttcttggcccacctttctgagacatgtttgttgttgaaaataataataagaatagggttatttatttcctggcaatgtcctccaactagcttaatgttgaaatactgttttttttgtttgtttgtttgtttgtttttgttgttgttttctaaactaatagtgcaggatcccccaggtctttcagaatctagcatttcttttcccctttccgcaaggattctggcatcgagatttttatgttgatgatccacctgctccaaatgtggcctggagactagtgctactaggggaaaattcatcctcacactctgctgttgccaatatcacaatccagggcctacttaatacagtaaaatgtctcttgcaacccaacaacactcccaggcatctcaacactaaaccttacttcaccatcattgcaccctttgtcaagtcagtttccctttagaaaagctgatgatcttgtatttattttacctattcttttttgcagcccttgtctccatgatgtttggcactcagacacatggaacctggcagggtgtatctcaaagtcatgtctccatttagaccttaaattagaacttacaacaaatttggggtgttccatttcagatggtacccagtgaggttgaaggttggatcgtattgttcagagatggagtggatctaactagggcaattagctgtcaggccccaaatgtccaggtatatttccttatgattaagctctttaagcaaattgaccaatcttttcccaccctgccagcccttcaggctgccagacatagaatgacatagctgagatggctgaaaacatgagcatatgtatttatttgtaatactgttgttttaattatccaggttgagaattagacaggcgggagacccaaatgcaaaatgaaattttaccttaaaagatcggtgtggtggctcacgcctgtaatcccaccactttgggaggctgatgtgggtggatcacttgagcccaggaatttgagaccagcctgggcaacatgatgagatcctgtctccaaaaaaagttttaaaaattagccagttgtggtgacacctgcctgtggcccttcctgcttaggaggctaaggcaagaggattactggagcccaggatgtcaaggctgcagtgagccatgttcgcaccaccacagcaatccagcctggagtacagagcaaaaccctgtctcagggggaaaaaaactggtaatacattctgaattaaataattactttatatttactatgaaagagaaaatttcagataattaccagagaaacaaaaactaaggaaaaaaaagaaaagtggctctttaaatttccctacagactaattaaatttatttttctagctttgcttaatggacggatacctttgtgaattttggatctttaaaatctatcaccagtattcccataatttattgttctccgtcattagattgtaaacttcatgaggtcgagctctttattttttcaagtccaaatcccacaccatatatagcctaatatattgcagacaacaatctctaaataaatggtaaatttttgaggtgaaatttattctggagattgatgattgcagctacttgattttgagagttgtagacatcttataactggtttaaatgagaactaaacgatatattccagaacgactgaaacagttctctcttatccaattgcatcctttctgcctttcatctttctatgagagtgtctcacattgcatttaatctttacattggctaaattctaactaaacaaaaatttcttaaaacataaatgaaagtaaagatttttttcttagcaatgaccaaccctctccctagacagcctacttttggtattttgggactgattgctagaacttccatgaaaagattaaataattttttttttttttttttttttttggtgagatggagtctcgctgtgtcaccaggctggagtgcagtggcaccatcttggctcactgcaacctccacctcccaggttaaagcgattctcctaccccagccttctgagttgctgggactacaggcactcgcttccatgcccagctaatttttgtatttttaggagagacagggtttcaccattttggccaggatggtctcgatatcttgacctcatgatctgcctaccttggcttcccaaagtgctgggattacaagcttgagccaccacgcctgcccaattaaaacaacatttttaaaatccagtctaatctctttattttttaaattaagaggaggttaaaataactagtaaattatatttatttatttgtaatattgttgttttcattatccaggttgaaatttttaaaaattaaaaattaaaaattttatttaaatttttttatttttatttttaatttttatagatgcatactagttgcatatatttatggggtacatatggtattttgttataaggatacaatctgtaatgattaaatctgggtaactgggatattcattacctcaaacattaatcatttcttcatgttggaaacattcctggttcttacaagatataaaatttgagacattcagttctcatctctgcacaaatggatctgttttttctttttcctatgtatacaactagcactatagagccgttatctaggaacatctgttagttgcttaaaccgggtctcctagaatagtgtctctcagtattgttatatctgtgatctgattttaggaacttgttctttagtcatttattcccacctcaatccataagcaaaaaacacaaacaacaaaaatggactataaacaattatctgcaataaaaaattataagtataatttaaatatctggactaaggaaaggataaattagaagaacattagaaattaacatagcacagtataggccgggatgttgcactatttttcccaatacaacagtaatcaccttgaggtcaggggctattgtaaatttcacattctcctcagtatttgacatagaacctacatataatttggcactcaatacctacttgtttgtttcacttaggcaaaaagtagagcagaaagaaaatgtttgccttatgtagcatgaaacactttctttttatgggtgagatcatgcccatttaagaaccttgacacaattgcaaagatctagggaactgtaccattctcaggttgcttcacttcctggctgattttaaacacctggaggaatgaactattgaaaatcctttgtgctgtccacaattaagtttgggggcagcctcacaactctcagcatggatgctaatttccaaattttaacctgggcccttaagggatggaattggcttacctgatatctctttagaagaaatgaacttcaacgtgacatatattcactaattattattatttcttaattctgttaaaacataaaagatgaaaggctaaaatgtaattctaattggcaaaggaatttcataccgggaaggcatctcttgattagcagctgtgtaggcagagggagggttgggggtatggaaatttggctaagaattcacacagaaaagtgctcgatgtgcttcgaaatagctcaatcagtactcagcgtgctgtgaaagcgctcaactggtgctcaacttccagcatatttaaatgagtggaacgcttactttttaaaagtgctcaattgggagtgctcaagttgtggtacctattagttgaatgctaattaacttttccttttcatatggttcacttctctgttaagcaaacagatagttttgctgttcatgttttgaggttaaacctggactttccatgagacattaagggatttgtatttattttcgagaaggaaattataccatcaactattccatcaactatagcttttcctttgcatgctcttgcatgcacgttctcgctctctctcggtctctctctctctcagatttttatattatactcctcactatttctgagctttattgttttgtttgaagccattttgagaaaactaaaagagcagagctagatgtgttatttgatctgatatcttttattcctgatacataggtttggtttttcccaagtgtcttttcaatcattttgataacactgctcttcagaaatagttttgagctttaatttgagtttaagaaactgcatagttttgtgctatgtttctaaatgtccactttcacctttgttgaactcattactatcttacttttttaagttggaaagatgaatcctgtaatttggtacataataaagacttcattaactaatctgtttaagattgaatttgagctatatgttttgagaatgcactttgggaaaaaattactatgactttcaattatctcactattgccatgaattaagatgaagatttaaatggatttttttttctgtaacttcagaatttctttcctaggcagatgctgggcacattgtacagcattgcacaacatggcagttgtgtcctatttcccctaattaccaacagaaagctatgcacgggtgaagaaagccttaggaacatgctcctataaatggagaaaaaagaatgccaaagctttacctgtcaaaatacaaactgtcaaagactgtatttcagtttaattcttgatcttctataatgatgtggcaagctgttgttcaaagtaaaggttaaggaatatttaggcaaatagaaaagtagaattccatttgcttcacatagcaactgaaaaagaagaatgcatagtctcacttttagggtgaataaaatgtaattttaattagcatctaatgcaggattaatgcattagcctcctaactcatctcccagttaaacacattctaagacagaaatgcctttcaatatatgtcattgaaaggccacattaggacttcttaggctggaagtcattgaaaatgtgggtcatctaatgcccctgttctgatttaggttctccaaaaaccttctgattttaattggcttccatataggtctactgtggagaaagaataagtgggtcagatgaatattgtttagaaaataagttagtcatatttcagtatatatgaaagacttacaaatctcactgaaaatgaagaaatttgtaccatggctttgaattgcgatctgaattttgtaaatgtgaatctgaactgagtaatgggatggtgcttagtgttctcctaatagcaattttctgagtctacagtcctaatggcctgaccttggatggtggtgaattcactaaggtaataactatcacaacatgaaacctctttaaagaaaacttgctggatatcaaaattctgttttaaatttttctctttgagtttaaattgaatttctgtggtgttttcacaaaagtgctatgctcagttttatgaacataatgaacatcatttttttttacctttatgcaaatattctcagccactattaaggcattttaatgaaaattaaaatttgattttttagcaacttgcagtagcttataatgataatattgaatcaggaatatattttttgcagaacaaaatgaaggaagttgggtagtagaggtcccttcaccaattctacccagtggctataagaagcaatactgggttattgctttgctgtaaaataagagagaaatgtatgcctcgttgcccctcgctgtttggcgtattgaaacttgcctattaaattaccctttactgagtttcaccgtgctctctctgaaaataaaagctaattcagctttcctatatttatgataatgaaaagtaatatctaaagtgggggtttactgtgcaatcatacattcaagtgatgtatttactttcataaactaaagaaggtatttaagtggtttgcattagttttaaacaattatctttttgtattcacttgacctagttagataatgatgtgcaaacagatttgatttaataacacattagtaaaatgttcggtgaagtcttaaaacaactgcttttaatattcctgaacaataggaggctttgggttcagtctcctgtgaggtgtgtggtgcttgtttgcaatcagctctgacattttcagagtcttctactacaaagagattctattttgaaaacaattattagggagcagctgaatgtgtatcctccattgagcactaagtttttgttgttttcagttgttggtggccaagattaagaaatgattgagaaagcttccgtgtgtgccatttgatagttatacaagataatactttttcactttttaaaaatatctttcccaaattgggattttgtaatgtattaatatgctaatgactgctatgactgtttgtgtccttcctctactgtatgatctgctttctagttgaaaattaataaaggctcccaactggtccaaagttttcatcaatatgagcagatgttgctattgtttgtttggctggagcatttactttgaaagatatgatctgagtttgaaaataaactaagccctagtcctatttttgtacagtggcatcaggaaaatattttgttttgtttttatttcagtagaaaaccaagaagagttaccttatcaattttaggatgtgaatttcagaaagaagtcatgatggtgttttgattttattcttatatcaaaatcctgccaacaataacaacaaaatacttattatatgtggatcaaatgacaatgaacttaccactgctttttataaactgtgtggtatgctaaaatttccatcattttatccattttgtaaaaatttaacaatcttgtaatacaaactatatgccactattcaaattaattacaggttcatttaaacatcataataaccccacaggataattactttactattattatgcccattgtatagataaataagctaatgtccaggcggttgtatagcctttccaacgtcacaccacagatttttaactcaggcaatctgcctccgcaggctgttcttgtatctgctaaactatcctgtgttaaaaattccaacagttattgtgtgtgtgtgtgtgtgtgtgtgtgtgtgtgtgtgtgtgtgtgtgtttaattatcctaagaatgctaacctcttggatatttttaataagtccttgctttaatggtaagacagtggactttctagtagtgatactgttattctttgactgaaaatgtggccaaagcttctgaggaacatatatccaaaagaaagagagccttccgaggcagctggatgacatgacaatcctgaagatcaatgagatgaaaatgtcatactgccacattcatttcatttaacctttaagtttaaaactttcaatgaaaaggaatcactgaaaatgttagcatatagtgtaaatactgaccagtcttgtttattatcttacataaaaataatttcaataaattgtatataaatgttatatatccattatatatgtaggagaaaatgaattctaaaggagaaacaatagaagaatctgtggttgaggcaaatttatctctttaaagatactttattgtttagaatcaactatagtactaagtgaatacgacttaaatttgtgatttaaggtgattccacaactgaccaagacatcagggagataaaaggaacaatgatcagtagggtataaaatactatccaaatcttaaaggcaaggtaacttatttcatcttgttaccaaaaatattaaactcttgctttcctttaagaatatattcataagcaagaaaaatgtggcctcttctattgcatagtttataatctaaagttgttgattatggcagacaaaaattaatatagaagtgtaagtacatatagagaaaacaaaatatataattgtttaaaatcttggactgtatgtcagtagtttaaaattctaaatgatgaaattaagcttataactgttactcttgtagccagttgatattcgccaagtcatgcttaacccttctcaaatttcagtaggaaatcaatattttgcagtttgctcatcttaagcagatggttatagcaaaacctcagcttgagtttatttatccattgaacttctggggaaaaaattaatgcaacataaaatcaaataaatatttgaataatttttataggcattattatgattactatgcaggatgatgccttgcccttgagaaatttgcattttatattaagcaatcttccattttatacgactgctgcttgagatgacacaaatatatcacaaggacctaatattttaggcctagaaggaacctataggacagctctgtcaatatcatctaagcaggtgacaagcaatgtcatatctatttagtgaagcaagtaaacagaaagaggatttcaagatagaaataaaaggtacaaggatgcacaaatgaaccttgtatgtggtttgagatggcaataggacatgcaatttaggctatcttgtactgctttaatattaatggatataaagtatattgtacgtgaaacaaatgagtttcatctccatgaaactgaaaatatcatgggggatgttttaattatatcatcttctgtaacattttatcatgaaatcaaaacatgtgggaccactatattttacatttatctacctcaagagtgatgtttccaaaattaaaacacaaatttattataattaggaaattaagtgttctttcagaaactcttcatgtattttgtaattcacatgaagttgagctttttgattttgaacataaaagtctagcaagaattttttcttcgttttttttttttttttttttttttgagatagggcctagctctgtcacccgggatggagtgcagtggtgcaatcttggcttattgcaacttccacctcccgtgctcaaaccatcctcttacctgagccccccaagtaactgaggctacaggtgtatatcatcatgccctgctaagttttttgtatttttggtagagatggggttttaccatgttgcccaggctggtcttgaactcctgagctccagtgatccacctgtctcggcctcccaaagtattgggattacaagtgtgagccaaggcactcagctgaatttttttcttaatttagtataggtatttgagtttgtttttgtaccatatttatgttgtaatctacacacctaagaatattatggctacatgcttatattatgccccttgtgctctattacttatgtttactacttatgtttgtaccactaaagcttcattaaatctctgtattgccccattacagcatatccagccaaaatatttaatacatgaatttgcctcttataccctaatctaattgctaccctgacttcctattgtcaaattgactcattgaatcttgtcttcagatactgctgtaactactccctcagttaattacacctccagtcattcaatttttcaggccagacaaccgataatcaccttttctcatgcctcacacaacttcactgttctcacagttctcttcctatctctattgccattgccaacagctttcttaaagtatttgtgagtcccaagtttcttttgtgtggcttgttactttaggttgctaactgctgaagtctaacttcccttcaaaactccttcctaaataatgtccaaagaatctttctaaaatgcaagtaagattagatcactcctttacctgaaatcgggtcacagttgtttatcatctttatggtcatctccgtactcctcagagtggcatacaagtcctttctactttcatctcctgctattctttcatttactctaaacattttatagttctctgagagattctctgctttcctatttatccttcaagactcaggttgtataaatcaggctccaatcaaaaacagatttcacactcaaattacagtatctcaagaagagtataccacagtgaatctgtttacaaaagtttgggcagggtgtaagtaagacatgaatgttaatgcaattatctaggttaacacaaaaagtaagagctattacaatcctaaacccagaggggtgaggggagacagtggttatctgaaaccagaaggaaagacagctctgtagtaaaggctgactggagaggatcagtgaccacaggacatagcaaatttgcaggcagagggccaggggaatcaatacactgaacacattattctccccattggctgaacctcctgaagtcagaggcttccatagggcccacataatctgccaggtcaggaaaccaggggggatgatggaggtagatctggagagctaatagaaagtttcctaaaacaaatctgttttagattctccccaagtctagttagaaacttcctcctttgcttttccatagtccatactgtcctattataacacttgtgttttatcgtaatcaccttttcttggtctgtgtctttctagagcacaccacgtcctaaggcccccggaagacttttcccttacccttccattccaataaacttaaatcagcatcaaatattgtcttttatttcactgaggccctagactgtacttttgaaacacacacacacacacacacacacacacattcacacacagacacacatagctgtaaattattgtagttacttgcagaagataaaattgtacaactcaattatataatgggaaactaaacattatgagaaacagttaatgttatgaaaatgaaagtatataaaatatgtctggatccttcttggggtgatcaagaatgtttgtaacaatattctaagtaattgcacatagcatataaaggaagaaaaccaagcaacatgccgttgctctctaataaagtataaacttgaaatagatatatgcaaacaaaaaatatgaaacagaagttacaaaaaaagtatcttggatgtgccaagtaagggtttgatcgtctctgccatcccttaatctccattggaaaccatatcattttctttcttttcttttcttttttttttttttttgagactgagtctcactctgtcacccaggctcgagtgcagtggcaggaccaccgctcactgcaagctacgcctcccgggttcacgccattctcctgcctcagcctcctgagtagctgggactacaggcgcccaccactacgcctggctaattttttgtatttttagtagagacggggtttcaccgtgttagcccggatggtctctttctcctgacctcctgatccgcctgcctaggcctcccaaagtgctgggattacaggcgtgagccaccgcgcccggctggaatccgtgtcatttttttatggacagttggcatttgctcaattttatgtaaatgcaataaaaatacaacttcatctattcctccaatgtatacagtaccccttacctcacgtaccctctgacatagaaattctgaagttgccattagaaatgttactgatacattacaaataagtcaaggatacagtgacaataaatatgatagaaatttgtatagtcaccttaacttagtgttataaaatatgtcttctctgatactaactttgtagcatgttaagcaaatttcaaaatattgaaaggtctatgccaatcaatacatttcacataaatacagcagtattatgctctaggttcccagaatacataaaacttaatggctagacatgttagaaaatattaaggtaatgctgtttttgcactggatctcattcctatccttgagatgtcatatgtttcagtaaggtcacagaaaaacctcacctcaaatataagattatatccatgtcacattttgacaaactgttttagtctctggagaactgtctgccttctttatctacaaagtttcagtacttctgctggagaaaatgcatttaagttttcccattttccataattcagtttattttaatataaagttttgttttatattcaggttactatattgatatgtttctgttatttattactattttgtagttctatttattttgtgttattatttcttatcattatatattttagttttattttccattgtgtttaattaataggtatctgaggctgattttagatttaaaattacatatgtagtctttctcccttgtttaaccttgagataagatttatttaaacaaattgcatatgagctactcctaaaccaaataagtttagttttgtgctataacctggaagcttgataaagtggatcctagatcctgatatcctggcagttaccttgactcaaaaagtgaggaagtaagacccagcattcagtttcaagcctctgagatatcatcatgaaagaagaaacaaaagcaatgatgtctgtatacttaaaatagaaaactaaggtatacagggtattctttaaagcttttgaaaaaaaaagtctttaaattatgtgttgaaatgattacaaaaatttataaccactacagagagctgccaagttcatttaagattgattaaaacaaactaacttatagtctggatctatttatctgaggaaatacatttttacctgacactggacacatttaaattactgatagttttagctttggaacatggcttgtgaaagctcctgtcataacagaaaattgtgcaatagggatttaacaggtttttttgtagcattgtgctatagcatgaatattgtttgtgcttattacaagtttctggtgatcttgtttgactttcctacacataacaagggatttggacagttggaaaatctgtacaaatagtaccacttgtggtttaatatttaaaacaaaatactgtggctgcagtgtgctggcttatgcctgtaatcccagcactgtgggcagccagaccagcctgggaaacatagcaaaaacttatctctacaaaaatacaaaaattagctgagcatggtggtgtgtgcctgtggtctcagccacccaggaggctgaggcatgaggatggcttgagcttggaggtggagattgcagtgagccaagatggtgccactgcactacagcctggttgatggagcgggaccctatctcaaacaaacaaacaaaaaacctacttctcttttaattttccctattgtttcattgagagatgtattaatctatctgggctgctatcatgaagtgcccagcttataaacaacagaagtttatttctctcatttatggatgctaggaggtccaagatcaaggtgctggaagaaatggtgtctggtgaggccctgcttcctcagtggtcatctttttgctgtcacctcatatggcagacggggtgaacaagttctctggagtctctcttataagtacactacaccaaataatgaggcatctaccctcatgatgtaataaccttccaaagtttctgtctcctaatattatcacctagagggttagaatttcaccataggaattggagatgacacaaaccctcagatcatagaaagttatttttaattgccaaggtaacaattataacacagtcatttctggtcgatatgtacttgcataaacaagacttatttttcatgctattcaaccacgtcagaataaagaaacagactgaaaggaccgtgaggtttctaaacaacgactgtggttgccacatgtgtatcaagaactgtgaaggttcaatgtgcaagctgaaaagtttgctggatactgtttaataaacaaaggaagaagacatacgtctcctaggctggagagagagaattttatttttcatagcagtggcagcatccatagtatcagcattcacgttggtttcacatatttcccaggtcacacaagagacagggtggaggacccaaatggatacacaataggtttgcaacacagttgagaaatctgtgattaggaaactcaaatcttttataataggctgcaagaaatcccatgtcttgccccagaaggaggcagtaagcaaatctgccttttgctgtagaagtttatctaagaaaatattagctgaattaattctatatattttcttatcagattgcattagaaaaaaatgttctgcaactataaatatatgttaaaaccacttgttgaaacaggacttaaggacacactacttagattaaattattttgcattacaaccaaatattttactcttaatcaccatgttccttgttaattatttcataaatataacagtttccatgaaaatcaaaccatcctagtgacagtcctgaatatgaatatgctctgttgatgccacttatgttatcatctttatataggaggccaatatggcatggaataaaggagataaaactatacatattcaataaaattgtagaaaagaagtttcctaccatgttgcatgtgcatgtaaatcttagttgcttcttcagccaagaagtttgaattttgatgaaggtgaaaatttggtataagattgattattacactattacattccactttagaatagtatatctaacttcttaatttataaaaaaatcacatatatcattaaactcaactgttttatttaatgactaaattttcatttatttaagacttgaaacaagtatgaagactttctaggagcaattatgacctaccttgactgctctaagagttttcagaggattattctaacatctaaacacaacatagatatctgtgaggggagcaaaatacatttcgtttgcctatcttttatttgcattgcatatgagccatgttctaagtgatttttttttctatatagattttaagaagtttttcttaaaggacattacaaatttctaagccactcactccagcacagttcttaggaatgtaattatgaacaactaaagacaaacgttataatgtaatacatttcctctaatgcaaaattagcatgcatctgaattacttggagggttgggcaaaacatggatttctgggccgcaccccagtttctcattcagtcatgccagataatttacatttctaacaagttgccaggaggtgctcatattgctggtctagggaccacactttgcgaacaactattttaaataaaagagactcaagatgatggagatgaagctgatgaagatgacagtagcagccaacacaaactaagtgctgtcctgttacttgtcagtttgctaaattctttatgtgcataagctcattatgtgttgtgattatttttaaggagaaaactgaagctcaaagaggttagacaaattgcccaagatcacaaaattgaaaagcatcagagctagtttttaagctgaggcttttctgacaccaaatcctgtgcttaacaaagaatagaaataactgcagtccataagggcctttggctctacaaagcaggtgggagagatgcactgtgattcaggagagccaggcacaacctgtggttcctagtaaggggtgagaattttcatgtgtaggaattagcccttgaaatctaagtacttgaataagtcagaaatagcccaaagtcataaaaagcccagaagcaaaacataaatgacaggataatcaccaaatcaggtcagaaccagggtttcttcatagttttaatatttaaaaataaatggcttctgttgcttaaacaacaatatttcttcatcaaaatactggagactgaaatggtgtactttctgtgctttgtgcccaataaaagtccaaaatgatacatttgctggagtacccataaaaagcaacattaatcatctgcttgcagagacaagggcaaagacaaagtatcagggaacagtgggatctttgtggatgagccttaaaatctgaaccacaggccaaaacaaaaccatctacctttacctttaccgacctgatttctgttccttgatcataccaagcttgtttctcacatatggacattacaatagccgttttctcttcccagaatgctttttattttagtttttacctggctggctccttcttgctattcaggtcttaaaagttgcagtctcagagagacccatctctgatcacccacactttgtagcgcttatcacagcatgttgcaccatatattttagttacttatttgttaattatctttccctccaaccactacaatgaaaactctgttacgaagggaatttttgcctgctttttactactatgtttctagcacgtagagcagtgtctaacacatactaggtattcagtaattatttttttgactagataaatgaaggagggaagaaaaaaagaaaacagacattgtagtagttgaactcttaatttgttttcattttaattattttttatttatttatttgtatttgtatttatttatttatttatttttttttgagacagtttcactcttgtcacccaagctggattgcaatggtgtgatctgagctcactgcaacctccatctcccaagttcaagttctccagcctcagcctcctgagtagctggaattacaggtgcctgacaccccacccagctagttttgtatttcttttttcctttttttttttttttttttttttttttttttagtagagatggcgtttcaccatgttggccaggcttgtctcgaactcctgacctcaagtgaactggccgcctggacctctcaaaattgtgtgattacaggtgtgaaccacagcccacagcacctggtctactcttaatggatgattcacagggttttcatgccccaaatttgtgcatgcacacacacacatacacacacacacacacacacactttatagtctgtagtgatgatcgaatgtcatgcagttatgtaattatattctctctagtttttgcccctcctcttttccctcaatgcttaaaatagacaaaggtatatatatacacaatatctttgaaaactgcaagcaaattcccagttcaaaatttgttcaatttttaaattagattaaatcacccttgaaagataattcactcagctccaggaatagtatgaattatgtagaaggcctaagactaaatattttaattccacatttcccctatgtcagggaaaccacctaaaacccaaccgcatatttatattcttgtaattaattgcagactaattttattcatgaagttatatttgaactaatagtgacatcgagagttaattctatttggcagtgtatttggactttcatttggtatagaatttaaatcaagggatttgaaaataaagttaagagggcaattcaattttgataaaaattgagtcaatgatgaaagcgcatcctgtaagctctaatgtaaacccagtctttgaaaaatatcatgcatggtacttggaaattctttgaggaatgaaagcttttcatgtgtgatcttcttaaaatggaatttacgttcaaattcaatggacccatgtgcacaaagagtgataatgcatctgaagagtctttctggattctctgtgtgagtgcacttgcatgtgaagagagaaaggaggagagagagagagagaaagagagaaagaaagaaggaaagaagagggaagggagaggttgttaaaggaaagagccactacaggtacctaagtgatttaaaaaaaaaaaaatcttatacttataaatattgtgcacttagtgtgtaaataaaatgttttgtaatgcttgttcagctactatgcttttcattgggattaactagacatcattcaatatgtttcatttgtggcttttaactcatttatttgctcacttaaaaaatattgagtatttaccatatgctagtttctaatctgggtattgggaatgcagctaagtattttacttccttattcttacataattttctaaactgaaaagaagggaaacttgtttttgaatgtagaatgattgaaaatataatgagattgaatacaaatgtattccgtaaaggtctatgccatattttttggtttaacattttactgtaatgaaatttgatgaattttttaacgtacttataagagatcaagtggaattttttcagtaattttgaataccaatcttagaataaagaatagacttttaagtaaaagtagtcaaaggttacaggcatttatattcaaacctacagtgttatcagtgcagcagagagaatcaaaaaacaaacaaaaatcctatacttcttatttgcagggaaaaaaatcaacaagtgagttgtagtcttaatgcctaccattctagaaaaattactaatggatgatcaaatattttctctttgacctacatgatacttgacactttgtatgagaaaaatgtgtactcagattaaatataatctcaaagcaatccttttaatttcaaactttggaaaagaaaatgtacttttttttgaaatttaatactcatggaaaaacagaaatagtgaaactagaaatgtgacacaatgctgatcacttcttgaagtactgcttctaggatgtgtgaggagggaagagaggacattaaggctgcttgcttcatgctgtgagccattagctgattgctccaggcttcaccaccaacagcagaacagaaggggaggtggccctgatgaaagggaggaaagaaaaaagacagatttattgtcttctctataggatcttatttccattctactccagtgctcttttctaagacattaaataagtacttaaccctttactatttacactccttatgatctgaaacactgggaaggtatttatattttgccttgaaacatcattttaaaatgttttacttttaaatgtttattgagttgtacttacaaatgttaattatagcttcctaaagacaggaatccaggaaactggatttctctatagaaggattatgtaaatttggttcactacaggatgcattactagcattttgaaaatgcctggtacatagcaagtgcttcacaggtgttacctgaatgaataagtggttgctatcttttgtttgtgacaaaattgaataatatggaaggatagaagccatgatgtgtggcataccaggcagcgtacaaagttaaggagtgtaattgtttaatgcctaatgcttaaatgacactgaccatgattaaaacccagctgacatctgccatatgcctctgaataagtgagttaacttttctaaatatgttttctcaaatgcaaagtagaaataacactactgccaacttcataaatggcacaccaataacactcatacactgagaccttagtataaatcttatatattagtatcattatttagagtggcagaacatagcccatacatagaagacaaaaataatctgatcatgaaataaaaatagaagagaccttgcgtgaaggaaaagaagggattcaaaatgctttatatataataattaacttcaaaacctaattcttctttatgtattttatggcagtaaattctgtattctcaattatagcatattaatatatctccaaattaagtatatttattgaagcatgacttaagtgaggattgtttaaaatgcacaaggaggtattagtttaaatatgtttattcacgtaataataacatgtataaataggctagttttattcataaatatctgcagttataagtaaagttacttataattccattacagtgttggaatagaagccctgtgaggacagggattttgtctgtttttaatggctatttgtctagtgcctagggcatatcctaattgtggtagatatgtaataaatatttcatgactaaagcaagtaatatagaaacattatatatatttagattcttggaaaagaatttcagcattgctagtacaaatcgatttcatgtaatctcatgacaaaggaaagtttggttcccatatcttttgcttaggcaaatggcatcatgaatttatgtttcagtaagaaatagaggaaacagtcattattttcagggccccattctgttgactaacaattctacacagtcctgaggaaattatgccactagtttgtgacccctcagcagcagatcccgtgtgacgctgctaagcatacattgaaatacaaacactgcttatataatacttctggatcaacaatgcatataaaattcaaaatctccattttcctctcacaggtgctaaccagccacaagggaacctaggacaacaaggaattcaaatattgtcttataagtaacaacctggtgccaggcagggtggctgacgcctataatcccagcactttgggaggcggaggcaggtgggtcacttgagatcaggagttcgagaccaacttggccaaaatggtgagaagttgtctctagtgaaaatacaaaaaaattagccaagtgtggtggagcgcacctgtagtctcagctacttgggaggctgaagcaggagaattgcttgaatacgggatgcagagattgcagtgagccaagatcacaccactgcattctagcctgtgcaacaaagcaagactccatcaaaaaaaaaaaacaaaaacaagtaacaacctggatgtttagcttcaagaaaagcttttatttatgtatttatttattagagacagggtctcattctgtcaccaaagctggagtatggtggcacaatcataactcacagtagccttgaacttctaggctcaaatgattctcctgcctcagcctcccgagtagcttggactgtaggtccatgcaacacgacctggctaattttttaattttcttgtagagatgaggtctcactatgttgaccaggccggtcttgaactccttggcttcaagtgatcctcctgcctccacctcccagtaggctgggattacaggtgtgggtcactgtacccgaccaccaagaagagctttgatagtcacaaagatagtcttcaaatattgaaatcttatcaagagaagtatccattggtcaattttgcacttcgacagagggcaaactatgattacaagtaaaattaccaaaaaagaaagtttcaattcagtgctagaaaaatatttttttaagagctagagttgccccagagttgaataactcatctggtcagttaatgtgacagttaattctgagtttcagattttctgggagagtctagttgtacatatttaaatgttgtatagtgttttgagtggaaaatttaaggaggtaatttaagattacttttattaaaaggaatgtagtatcaggctctagtacagaacacctttaacctaaccattatatctattatatattaataggattacaaacatttcacactgtacataaatacacaaaacacaggcaataattatagtgtggacacaacaggtagcacgggaataaggagaatatagggtgtgagtatctttaaatctgccattacatctggtttggcccaaatagtctctttgcttataagtgctcactgtgcccccattggcacccttaggaggacaccaagtaggggcatgagtttactcacccctttcagcagctggggagagttattgggccagagagcctgttctggccagctctgcatgtaaagaccacagagatgcagctggttccatctgcatttttcttagtgtctgtgtcctctctgaaatttgtgctcccttgtccctatttgagaaatccctgcaagtggtagcctctttgtcctgaaccctggacctctggctgtctcagaagctttgcatcctggtctagggcatgtagaaactctcaaacccctgaatattacccacagaaatacagtcagaggtcgggcgcggtggctctcgcctgtaatcccagcactttaggaggctgaggtgggaggatcacttgaggttaggagttcaagaccagcctggccaacatggtgaaaccccatctctactaaaaatacaaaaaaattagccaggcatggtggtgcacacctgtaatcctagctacttgggaggctgaggcgggagaatggacgtgggatgcggaggttacagtaagccaagattgagccactgcactctagcctaggtgacagagtaagactcctcaaaaaaaaaaaaaaaagaaagaaaaaagaaaagaaatacagtcagacagaagcactgcctccagctcatatctattcctgccttctgtgtcaccatccctttcttggtgttaaagagatgtgagtagagatttttctggaggctgtcatctgaggtctggtatgcctggaaggggtgacttgaaaatctcaaaatcccacatactaaaaacaggtgcttctatctgcctccccatccttttccatccccttaacctcagaattgcacctcaaaaggagaaatatgaaggcatttaactttaatctcatctccttcaacaggctcaaacttcaaaccagcaataagggcagaaattagacaccgccttctttatattaaaactatgtgataaagtcagccagacttggttcttaataagggtaacaaaaaatagattaaagcaaaatatccaaaatattatagctgtgacacttacaaactatgaatagaagaaaatattagaataatagtgatataaacatttaatttcataatctgagtcatatgaaatataccactgttaaaaatataaagggacatctcacttttcctaatacatgtgaaaaccacttttttattttgaagccaacagtgccaggtcacaatattgtttctggagaaaaaatgattttcatctctcaagatgatattttaatccaataatcacattaaatgaacttgttttgtgtgtctcgatgcacagtaaaataaaaatgtgtcgttgagttctgaaattcttaatttaaatttaataaagtatgcatcagattttaatagacatgaatcagcctcaatgtaagcagtcttcatatagaatgcaagctgtttaatttatttttgcctgttctagtttcacgtggtaaaatactgtgtatagataaacactaatctccaaagtatgaaaggaataatgaacattcaaggaagggcacaaagaacttcagaaaagcaatcaaattttctttgtttcagcttacagagttagagtaaaaatacatacaaaataatataattaactcttcacaatgtaattttaaatctcaaagattaaaccgaagcattttccttatggactatctaattctttgtttactaattttaaagtagacttcaccaggtttggtactttgctttgtgaactagaaagtaaacaataagcaaggcaaaaagaataaaaagggagaaacctactttaaaacaatctgaaaatgataagcagaggtggttgtttactcttgatttaaaaacatgaagacaaagagtacatgattgcttttccaggaaaagcatgagatgaaataggcttgagatataattttactagaaatcaaagaagtacaaaatatttataattaaccacagcttaaattgaacaggtggatacatactggttagcatgttagctcattgtgtatttaaagtttgttaaactatttattgctgcttcaagccagactctggaaccaaatggtgtttgataccaacccttcattgtcatgagccgtgatagtaacagattaagaactgctttgcatggctaattctgatagatgaactgttacttcaaagctagcagtaataaagtctaatcagatgtttaggaaatgttttagatatttcagagaaagggaagatataatttatggccaggaattaaatggtgcaaaggtgttcggcagttataaatattaccttggaagcatagtttaaaaaaatcctgatgaagataaaaagaataacatgctcaaaacaaccaacctggttgtccatgtttatcagtgtttacttggaggaagaccaataatgttattttgtcctgatatgtcctattaacatttgttgtaagttactttaatgaaaacaaaggaagcctaaatatgaaattaggaaatagatccccaaagtgattgaatattctttgaatagtaatctatgtctaacctatttagataggtggaaatcaaagactcaaaaaagactggaggtaaaattaacaaaataaatacaaaattctggcctcctatttcacataagatgatacaccaagaaactggagtgatcttccacttaaaataactaacagttttatgtacatttttgaaactatcttcagaaatacttccatgagctggtaaaaacaccctggccaaagtcaaatggagcattgaatcggactttcattttgagggcatttgccaaatcaggtaatttgagtactgatttttgcaggctttcagtactcagaggacaggaaaaaaagcccagggctcgcacttgcaatcagagaagtggcagagactagctagtcagaaagctttttcatccttttcctaagcatggtggtgaataatatttcctggcatctcctgagttaggtagcagtgaggcagctgagttctagccgatgtgctatgaatgaaagtgtcatatgctcattccaggccgggacatagcatgagttttctcccttcaacagatccagtggtcatgtgttgaaggtggtagtgtcccagtttagaaggaaagtgaattactgactcaatgcatagggaagagccatcctggagaattccggttctccttaataagttcttatgtataactgattttagttttctcattttatgtgaaataattggaatttagttctcctaagattcttccagacgcaaagttgttggttttattttggtaagaacacatagcatgagatctaccttcttaacagatttttagatgtacaatatagtattattatccacaggcacaatgttgtactttagatctttagaactagtatgtatacctctgacataaaatagacacttggtatttttgaataaatagtgagcaaatgatccctaaactgccattccctgcaaaagtgtcctctatagcagctattcctcctattaattaaaattctattccttcattgttaccaactgattagggtacaagttttaggaaaataataattgaacaaattcaccctcaggagtaatgataccagctctacagactgatcaatattcagttgctatgcaccagcattgcttacattagttgttaaagtattgaaatattaccataacagttcataaatatctgcagcttcaaaccctccagtatttctccccaccaccaccctaacacctttccagagacctaagattttgtgatcatagttccttgattccacaactaaaagaacagtgtttggtgtaaacatccttttccttcttagcatgaaatttataggctaaccttgcctttatctcttctgatttgttggtgctgtcacactagtggttaaatattttgaataccactcccggatagcttggctaaaccgttaaacaatatttgtcatttaaaatcatctactaagcctagatgaatctcttagtgcaatgtacagtaagtaagacataattttttatataataattcttctaggtaaagaaatatcttaaaagtatctgattgaagaaacaagggggtgtggttaataggcatttaatgagtatttgtgaactttctgagaaacctcattatcttctctctgtattcgtggcaaaaaaacaaaaacaaaaacaaacaaacaaaaaaaacaccaccaccaccaccaccaccaacaaaaaacccttttcctctactgcaattctgcctactcgtattccttaggaacccattctctgtccttcttctctcactttataattatctgtaagggttctcatccagttcacctgatatctatttttagatgatccttacatttatatttttttgctcaaaactctcagttcagtattttaacattgtattggtcatctttgcctgggttcctacaatttaatattttcagattacctacatagaggctccttggtggtctagtggttaggattcggctctctcaaataacctgtgtattcccagtctcagtgattggcctgatgatcctccttttagactaaacttgaaattgtatattcatgatctcaccttctctttattcttctttcattcagttattcaccaagttttcttaattctgcttcctaaatatccttgaaatcatgttatatcttaattcccactaccacatgaggatgttctagccattctgaaaaatcttcatgcctctgcatattctattgctctgcacagaaggccttttctcctccccaacatcttttttctgccttgcagatgccaccattttatccttttatactaagttctaaggtcaccattttaggaatctgtcttgactcctattttcccctggaagtcatttgataaacatctctattactgcacttaacaaattttattgtaatgaattctgaactaagccgacatttcctatactctaagccactttatccagtaaaactgaattatttggcaacagtttatccaggttatctaatagtccagtaagatgacgtaagaattagcatggctggaagatgatagctggaaagacactggagatacatgtacaaataatggagaagggaggggcaagcaagtttataaaatcaaaatgacttcatgtggacagagcataaaacacaaaggggacaggcaatagagaagtgtaggggaaaatacaggagagaaaaatgacagttacccaatgctgggaagggtagcgagggcatggggggtagtggtgatggttaatggatataaaaataaagttagatagaatgaataagatctagtatatgatagcacaacagggtgaatatggccagcaataattcattgtatatttaaaaatctaaaagagtagaattggaatattcctaacacgaagaaacgataaatgctcgaggtgatggatacccaattaccacaatgtgattgttacatattgtatgccggtatcagaatatcatatgtatcccatgaatatattcacctgttacatacccataataattaaaaattttaaagattatgaatgaataaatatgtatgaagtacttggaacagtgcctggaacacagtgttatatgagtttatagagtaaataaataaaacacattttatatttacctcttaataaaagaaaaatagagaggacttacttgaatacatatgaaaaattaaagatatggactttgtgttggaaattggtgagaaattagtaaaagattttgttagcaagagaactatatgatcttgctttttagaaatatctgtcaggcagcatagtgttggaatagattggaggggcataatagtaggaacaaggaacaataatccagttcaaatagatgggcgtgctcaaatgtcatagctgatagaaagaaagaagaagattcacaggccctttagatgtagtgttgacagatcatggtgtttggatggggagggtgaaagagagaataagcctgggattctggcttactagaataagactggatataatagacttattaatgaaaatgagaaaaacagagatggatactttggcaagggtggaaatgggtgggtagtgattttgatttagatctaatcatcttgaaggacatataagggatgcacgggagggatccagtagacagttgaatgtatgaacttagagcataggagagagttccagtgtgggttaggcagatttgaaacttatcggcctattggtggtttttaaaggactaactgtggacaagatgatccaggaagcaagtatgaagtgaaaagtcagtcactcttgtttgttgaataaaaggaaatcaaggatcagttctgagctgaggtgaggaatagaaactcaagtggacacaattaagcatcatataaagtagcccctggtcaatagtgggaaaagtatcacagagcacaaacaaaagaatgagactgtgtcctgcactctatttttcttttattttactcaatcccttctgttaaagtgaaattttgtcaccaaatgaatccagatcccatgtacctggtagttgtgttctcagtaagaagaaaatgtagatttcaaccttaagcctatctactcaaattcctgcttcatactcagggatgcctacattatttgtgagactcgaaacaccctgaaaatgtaggctccccagttccaaaaccaggaaaaatatgccatgaaaggtaataaaaggtaccttttcctttcttccacgatctcttcctctactttgattttttagaatgtcctatttaatgtagtttttaaaataaaaatatctaagttttaaaatattattaattttatcattcaacactatattgtgtagtatcagttttaagtgcaaatatgagagcatgtaactcacctgcagaatcaccaaaattatacaatttgtatttcatagcttcgacatgcatatgtctttcattcttactggaaaagtagaaacgctgcacaaaactagtttttactttatttcctgatacatgcatgttctatcaatactatctactcttttgctttactgattactaaggatgaatgaaaggaaaggaagtatgttcaccttatcttacctttgtttctatgttgtcatttttagatgcaaatactcttctgtactcactttgagacttgctgaactctcatgctctctcgctacaccagaattctgcttatgtggcatcataaaggctgtatgataatgaggcaacaaggaaagactgataggcatacatattatacgtatcttctttgcttaaattcatgtttcattgtcccatcagatttcacttacaaaacccaagctcaaacataaaattattaaaattttaagacagaaataacagagcgttaagccaagcatgactacagttgcacatgtagtgttattttaggacataaagaaagctatatgttaataaatgcaaactagtcatcctctattacacaactttctcaatcacacagcattttctttaaggtgacagcaaaagttgtcagttttgtttgttttcaccatttgtgagatatgtcattttgcagacttttctgccactagagggaaagataatttgtgttctctgctgcaattcgttatgcaggagctagggagggatagagaataatgtatgtttgtatagagagctgaagcagcgaatactcttcatgagaagttttatcattttacatttatccttgatatgtgccttttaaaacatgaaattcttttgaagtaggtgaagcctccaatagtaccattatctaaatctgtttttgcttctcattgtcacatgatagcttttcatttagtgtgatgctggggaaagagaaaggagaaggttgaatcaatttattagggccaggtacatatgtggttttttaaaactctcaatttctaccatactaccttaccttgcagaaaagtcatttccatatctgtcatatttgcattttttttgtaattctgaacttctactcctttgttaaataaatgattttaaaaccacacacacacacaaatacctacatctaggaatacaacgatctaccatttgaagagctctggagttcgagtttggcaaagcaattatttgaactccagctgtctttgacagaatgtggaatatgtgtagattattctatgaagtgggaaacctaagtctgtgtctcagatgagactgaatgaagaggtttacaccaacagatttgccaaacaataaatgactttataagacttttttttttcagaaggtgctgaagataacagtgctattaagttgagcttagacctgattctagactgactctaaatgttacatttaaaaaccactcatttttatgttgctttggtacaaagattcattggccattattcttgccttatggaattgtactatataattacttggcaacaatattttaatggtatcatcagtttgtgctttttttttttctactggtggctgagtccatgtccccataaaatactcctcgcaagctgtgctaaatttcctagcagttgcctggcctccacctacacagtggaaaagaatgaaatggcttgaggaaatagatgattgtacttgtactggtcaaattactaaagaatcaataaggccgactctgtaaggttattgactggcaggctaatctgagcccataactttacttccaaccaatgtttcaaggagtgctggatccaggactatctgtagaagctaagaatcatagtgctgagaaaagcaacataagattattgtattcaagttattgagtgtttttgagtcatccagtcatttgcttatattgcagataggatgctccttcatcatgcctattctgtctctttagtgcttttgaaaaggaattgaggatgagcaatctgccatttcctgtgcacctaaatttatctcatttatcttttttataataagctgatatagtaaaagaaagattactaatacagaagagtcttagctactgtaacacttagagaggattaagttttttaatttcattatttttcattttaaacactgaaaataagacagataagaatttttttccatctgcattttttttttttttttgcttttctgtttcagtgtacttctagagattaagttcttagcaaagacatcatttatttagtattatcagtacaaatcactagatgcatcaaataaaattgaattttgagttacaaagacaagatgggggtaggataattgtacaaaactaaagtagaattaattccattatttaaaaaatactagtgaatttctgtagctattttatttttgaaaaggcaaaaatatatacagtttgatcatctcattcccgtagaagtcactcacatctcagttgttatcctagaatgtgtttgaacttaggtattcattatgaaatgagaatagaatgagttatctatctgtaactcaaaggatatatagataatctttggcacatattttcacagttaaacaataccagataaaatacatattctgttccacatgggaaaactgtatggataattcgtgagttgtaaaacacaggccatgagcattcctttttggattgacaaggaaacaagaattgtgaaacacaggtcatgattattaattccataaagcctaaaatttgtacagtaatcaatatagataaggtaatatcattgaatgcttaagaaaaaattatttgaaaaaccacaaatgaaaaatacaaaaaataaagttttccagttcgtctcgagtcttaaaaaaaagtttgtttacttcaagagataaaagtgacaatagctaaacaaatataattttgttagtcttaccttattagcccaaatccaatttctttgagtgatgacaatgctaaaaaattgtgttttcagtgaaattggtgttctgtgtcctccaagtccccctctacctttgctttttggcaaggttcctttcccctctcctctgcgaaatcatagcactcaaaaagatactggagcaatctccttaggaagatcccattccgctgtctacaattaggacacttgttagccctctttaatgggataaaatatgggttcattctgtatcgtgtaggcatttctctaatagagctgttattagtaaattgtgggctcataagtaaattgatattagtgtggatcataagccagtagtatcactgtcacctgggaactagctagaaatgcatattcttaggcaccaagctgatctactgaacctgaatctgcattttaacaagatttttatatgcattaaaatttgacaacactttgtctacaccagaatggtattaacactgaatgatggccaagaaaaaataaaatgtccagttgcaaaactgcctcagtctaaagaaatgatgtatatggtgacagtactaggctccatgtcagggcaggtgaagctaatggctgtttaggactgtagcggtagcatatcatacagtcatcattttctcagtctttgacaaaagttattccttattttactggaaaaagtttacatcataatgcaaatttaaaaaggatttaaggaacagtacatatatttgcaatgacagagaaagggaaagagagagattctgagaaacttttatttaagccctagcagaattttgacctcttagaaatcaagcaatagaagtatggctttgcctttaacttctgaggtttgagcagaaatgtaattttccagcctctcatcatttctgtgacctttctgaatttcttcacattcttcattattactggagtttagaactgagtatatctcactactttcttaggaaaggccttaattaatatttgaaggaatttgagcttctaattcccacatcctttttaatgccttattttctattacagctgtgccctaaatagtttttaaataattagctgtacatggtaatttatatttttaacaaacttactacataattatcgttcatgtggtctttagaccagattttgaaatactgtgaagattaagcaccagactcaacactaagattttcagggtaaaaaaaataacaattttaaaaatgtgtaaatcatagtttttatgtgactgaaactatcatctccaattccagtttgccttataagttttatttttaatatagcaaaattctccccccttcctgcaatttttgcagtgtaaattgtgcttactaaagttaaaaatattttaagtttttaccaattatgttttcttttatactttaagtttttcttattaatatctatagttatttctaattttttatctcataaaatctgctggaatttaatttttaagacattccaatttttattttgactatggcagcaatttagtcaatttctaatatatttccaaaaaatgatctccctaacatttccagaaaagccttgaaatcctaataacatttctttggaacaggccagttgaggtttttctcatgatgatcatgttaggactgtcatagtggaaagcatcccatttgaggaaagccctccttattctttgtgaattttagaaatttgatctctgaatcctctggaatgaaaaaaatcttaggcagactgacagataacaattttatcagaattgtaataagttaccataaattaacactgaatatgaagacagtgcttaattaaattgtatatattcaaatacatttattgaagaattaacgctgaattaaattagttacaattttcatgcctattagtgacatagaagctcctttaaaatataataaacatgtcagcttaccacatagtagtttcttcaaattgttgagatttaaataaggataggcctgtgttagcgaggaataaaaatattgtgcttcagctcagtagcttccttcttgtgttttctttatatcagtgtgtgtttgtatattcctttttaacaactttataatttaataaaatcttgtctgtaagcttagcaacccataatttatcattatacaactggactaatgaatttattttacaggtacatcatcaacctggaatcatttttgtctgttacatacattttacatgtagaattccttgaaatgttaaaatgtgctatctggagaagggtatcctagaaagaatgatgactgtaccaataattagaaagaagcaagaattttgaaggaaatatgaggagttccatcttcatcatggtcaaataagaaagataatagaacacccaagaggcaatatgagacagctcaaaacacaatattgaatgctgtgcaagattaaatgaagagaaaagagaagggctggtattcattcatgctggcccacacaggaataaaagcacttaccgcattttctagagcataatagttttagcaactcttttgaatctgcttctttctgttttatacatttactttaaaacacacatcttggaagtatcctcttttttaaaaaatcaaaaatattccatggtaaataacatacacattcctttcaggttgtgtgtatacatttgttgtaaacaaatatcttagaattaatattaacatttttctgtcaagatgtgttatttaaatacatatacaaattatatgtgtatttaacagccccacaatgtgatttaatttttatgtgcattaatctaagaacattatggagcatataaaccaaaatatcaagagtggttatctcaagacagtaagattataaatgcctttattttccacttctgattttttttttgtgtatatatatatatatatatatatatatatatatatatatatatacactatatatatacatacatgtatattttctctctctcttttaaatagagacgaggtcttgccatcttgcccaggctggtctcaaactcctgggctcaagtgatcttcccacctcagtcttccaaagtgctgggattacaggtgtgaatcactgcacttgccagttttttttttttaataacaagaaaaaaatttagcagaatttaaaaaaagagaagtagttcaaaatagacatttcttatgactgtatattttttatgatgggctgtcattaaatatttagccaaaaaaagaagtaaaaccatatgaaattttaattacttaaggaacaatgtcatgtaacattggtaggagtggctactagtctggaaaataagtttgggcagaaatagtagactgtggcttaatattaaggctacctgcaaatgcccctgtaacataactagtactggacagaatgtaagagttatgaatttgggatgacaaacatggagactcagaatacattatatggatttttagattaatacagaagttatagcatggaatcaggatccctccttaggtaattgccccactcctatccctcttcacattgtcttataattacctattaagttagttctctttatccatggactgtaagttcatcacacgtgaacttggttttctttactgtgcttggtatataaatagggccttaatgtattctggctagatgagagatgtgtgacaggcgaaaaaccaagcccggggggggaaaaaaaaggtaatttagaaaagaaaataaacagagggaaataccgaacaatacagatggctcagcagaaattgtagaaagcgacataaatagattttaagagcatgactttgggactaagataaccctggtttgattttcttctccatgagaatgaagagcagatgtaacgggctaaagtgagtaaggatagcagcactgagtagtggcatcagaaaagcatctaagttttattacaagacaaattaaactcagaatataacaaggctcattcctgggaataattttttaaaacacagctgagatagtcataaaacatgcagttattttaaatttagaaacaaaaccaggacctttaaaaatttatgcttctctgatttttgtccttccaaaattagtctagaaataagtttattgagaagtcagctgtttttaggctctatgttgacttttaatagtatcaaacgaatggtaggggaaaaaaatgaaaataccggttatccttgtttgaggaatctagctttgggagaaaagtgacaaaatatgcttaatttttttcctttcatttttcagatgtcgttttagaaaaacacttagggaggaaagaatgtgagtgatttttgttttcatgccagagcacagacacttacgtgacaattggagtaaataaagtaagctttgactactgttctctaattcatgcgtacctctgatattgacgtgttaaggaaaataacgtatctgcagcccctttccagagaggcactatgacgtaagagttcagagtatgagcactgttatttcacacacctgtgttcatatccttgcttagcaggaagaccctggagaagtttttcagtttctctgaaggctgcattctcatctggaagatggagataataacttcctcataggattgttgggataattaaatgaggtaattcctgcaaagggtttaacacagtgcctaatactagcaattgcaaagaaatataaattattttgttattattatgtaagcagatatcacatcaactgttagtcctcagacttggcaacttacaactggcggaaggagaggaaaggaaaaagagagagcaatgtcatagtaggttgttgttcttttctataaattcatactgcaaagagaagaaaagaccaggagcctgagcagaagcccctaaatatagccaaagtcaaggttattaatagagtgtgggattgctaaagattagaataaatgaatctaagacagaggggacacaggaaagaggagatatgagaatcctctgtcatttacctccctgactttcctttcaggtgtcttacagtagtgaaactggagagagtaaatgaaaggagggaactgttgacagcagagaatcagaataggaaaacttggtgtgcctgttatgactcttccaaaagagcttccctaagagcagagtcccaaaggagaaggcatgaagcatgatgttttagttttgcgctaactcctctttctctcagagtatctgctttttcatatcagagctgagtcttatcaacaatagtagcaacttaacataaatgaacattccataattaaaaggactccctttaattaaaaatactgtgcagacaggaggtgcttcttaaagcttggaagattgatggacggcgcaaaaccacctattagaaccacaaatagggagcagaaatttaaacactgaaaattagaggaatgtcatttgtatttattaatactcaaccaatattgcattgaatatctatattgttacaatactaggagtggagaatactagcaaattaaaggtgttttatcttaaagcactaaatcatatgtataggcacttataaggcattacgttataaaatactagttgtatcttttaggtaaaaggagcaaatgaaagttgagtgggattcacatagcctgcagtcttcatgatttccacatggaaagagagaattggagctagcatttaaacactaacatacgtgagtaaagataaagtgaatgaaaaattgtagtggactgtaatttgttagctaaaaattttagtatctatctattaaagtgtttcttatgctgttgacactttaaagctaaaaatttacattttctcaaaccccaacatctaaagtgggtagaaggagttatagccactggtctgctctctctacactcccttcatttggagaacatcacctgtgggaaagaaaagaagtcaggtgacctgggtctattctccttgtcagctggacatccaggaaaatggactaaaaatatttggagaaagagaccttatctctgcaatgctgtcagcatgatgtgctggcaaagaataatgaaacttagtaaacataaccctgtatcggtaaggcatggccatctgtaaggaatgccacacataaactatagaactatctggagtataaaatgaagatgtttcagaatttaacaatcactgctttatgaggaatcccagaagcctcatgtagggataatgcagggatataatctcttctggccagagctgcttgtcagacatgagaaggaagaacctggggaaccacccttaatgtctgttctctctgtgcttggtctgaggcttttcttgtctgtctccttgaaataagtactaggttactactgagtaaggtctctgattctcgtgagtctgctttgagaatctaaaccagtgtgctagctcataggttgctagatatgatttgggctccactaagcagatgctctgtaatgagccttcaatttgtagtccattaagtcaggagagaggcagtgcattgacaattattttactaatccacttaccactacagttaatgggagcaagttgtgtgcatggtggcggtgagagagtaaaaatcttgtatgtttcataagagaggtagtgaaagtgacagcaagaagagtaaataacatcagaaagggaatgtaaaaattgtttgaattccagctttgttctgagacacagcaagcaattgttgtttctcattattttaaaagaaattgtgtctttttgaagttactcttgaattgcttcaatgacaaattcatactctagaggcaccccattccttgtttgatggctccagttgttgcacagttatattgatacagatctgtctccaaagagattccaaccagcagcctgctccttggtgctaatttttattttgacttcaacaactatcaaatccatcaaggtatgctagtcacctggtttttgttgtcttagttattttagtagttctctatatcgtttttaaaagtctatattgcatcctgaggtctcttccctgaatgtgcttaaatttgggtaggctccttttttgaaaatagatattaggtttctctgcaacacaaccaccaccaccaacagaaaatggcaagaaaggaaataaaagagtaatgaaggatgagcctatagattaaaatacactaaaaagaaaaacttaacacatagtaacacatgtactttatttggatactgattcaaatgagctgcaaaattaatttatatatgagttatttgaaaatttgaacattaactgaaaacttgatgatattaagaaatcattttttttctaggtatgattttagtatttggattatgttttaaaatttctaatattttagagatgcattctgaaaaattttatagatttgtttcaaagtaacttagggtggtggtggtgagtatataaatataaacatatatatggttgggtgcagtggctcacacctgtattcccagcactttgggtgaacgaggcaggtgcatcacttgaggtcatggattcaagaccagcctgaccaacatggcaaaagaaaccatctctactaaaaatataaaacttagcgaggtgtagtggtgcactcttgtaatcccacccacttgggaggctaaggcataagaatcatttgaacccatgaggcagagtttgcggtgagccgtgattgagatcgcagcactgcactccagcctgagcaacagagtgagactctatctcaaaagaaagaaaagggaaggaaaggaaaggaaaggaaagaaaaggaaaggaaaggggaagaaagaaagagaaaggaaaggaaaggggaagaaagaaagagaaagaaagacttttgttaatatttcaaattcaccataataaaggcatcattaaaaagttttagatgaaatctcattagataaggacagttttctctcactagctatacgtcttacttcaagaaagcagctcaaaaatgtgtgtatatatatgtatatttagttagccagtcaaaagaatgaacaaatagataaaaaatatatcactacaagtagaatgtactattaataagaaatcatgggattccataaattaatttattagttatataaataaataatagtcatctcttttaaaatttaaacatgggcaattggagttgactctgttttggctatttccttgctcttagcaaaaataaaaacagagtctttagcttcaacttaagatcttacagaaaaagagaaacagaaccgtgactagagatactcattttttaaggaatcaaattttatatgaaagctattacatatataatttctagggttacttcttaaatcaacccagtttctggcataaaaatactttcactataatcaccagtactgaaaatgtggtccatttgtgcccatgaaacttgctgcatttggctctgagcaaaaggacactggtaggataacaattaaaataaaagttaatattttatttaccttcttagttctaggtcagttttcaaactatagaaacagagcattatttaaatattccctcagatgactaggggatcattcagtggcctcaagtactattttttaaaaaacagtgaataaaaagaacatgtattcactccttccctgaaagttatattattcttccaagtggcttttttcaacacaatgaaatacacacacacacacacacacacacacacacacacacacacaaacttaaaataggctaagtgtaaaaattatagaaaatatttattgcctatttttgagcacacaaaccagaaatatgtgtctttattgatgtactttcacacccagttgaaatatagcaaattatcttgaaaaactttgattctttctaaaatacatacaaaaatagttatatacaacttagtaatttgacaagtagtctcgaaaatatgatattcacagtcttaccaagattttaatgtccagtgatttactaactttgttgtttatataacaaattagccctaatgtattcaatatttgattgcttgatattttctcagtaagaagcagatatagtcaatatacatagattgcctaaaataggagtcattgccaagggtcaaatattataaagggcaagcctctttaaaagcatcctttatatcacagaaatagagaaggagttatttttcagtggttgaatgtacagaataatttacaagattgaagtgtataaaacattttatacactaaagctcaatgtgcccacttgtgctgaatagcttattgtggcttgagcttctcatacattctcaaacatgacttaagggtgaatggattcaattatcctacatctagaggcaaatttcacctaaatgtaattgcaggaatcaagaaaacaatccaaacttctactgagatatctgtaaaaattctcactgaaggaatcaagtgattttgaatgacacttataaatatgcaaaatttcatcatattcaagtatgtttcaagctgtacaataacacaggtttaacttgaaaaggaaaacaatgaatgttattattttcatcatgccttgtataggctatgttttttggcaataattagatttcaagtaaaacaaacttcacatcatcacataaccattttattttaagacagaggtttcactcctgtcacccagactggagtgcagtgggcgcggtcttggctcactgcaatcaccacctcctgggctcaagcaattctcctaccttagccactcaagttgctggaattacaggcttaagccaatgcacccggctaatttttgtatttttattagagatggggtttcgccacgttggccaggctagtcttaaactcctgggctcaagtgatccacccgccttggactcccaaagtgctgggattacaggcatgaaccactgtgctgggccccccccttttttaattgtaataaacaatggaatccagttgcagcaatgtcagtcatatctctggtcatctgatgtttctctgggcttgggtgcacatcacatccggatgtgtgtttcattcttatttccattgagatatagataggtttctctaccagacagttcctgcttcgccataatagcagttttattttggttttgcattttgggggcattaattctgacccaaattctatacatcaaactctaatgtcaaccaagatctgtttctgtgtcataaatccaattcccagaaagaggatctgattggcgcagctttgggtaactgtttccagcatacacttctcctttgaattacagtcttacatacccgactgcctattgcgcacatccacttagatgtcaaataggctttaaaatgtaaaatgaccaaatttcaatgacgattttccttagagtcatgtttgattcttttttttttttaacctatatgcaattcaagaactattccatttagctttacttttaaatatactcagaaaataatgtctgctcggtacttcagcactactgtctaggccaaaccatcatgtactcctgcctggattattcatctctttgcatctgcccatgccacctacggtttatactcagtacaaaaagtagaatcatcttttaaaaatttagatcatgtcacttctctggtcaggtttcctatctcacttgtagtaaaataaaaaggctttgcaatgatctacatggttctgtattacctactttcaacccattacctttctgatcttttaacattttgttctttatgttactcacttggctccagcaatacagactttttgctttttctcacatgtgccaggtacattctcaactgtgtggtctttcctcctgacttaaatgttcttccctgagatggctgcatggctcactccctcactctctccaactctttgtttaaacattgtcttctcaatgaggctttttctgactatctaaaattgaaattcctctcccaatattccctaagcttgctccacagtttaaatttctcttaagaaattatcctcatctaacattctatatattttactatatgtttattatatccctctattcctttgacatctcaccagaatgtaagcttcatgaacaaacagatttttgtcaattgtgtcctaaaccaggcttccaaataaatgtttgttaaataacttgtccacgtaggacccaatcaaccattcctgttcagtggagggccataggaagaggaggtttacgaagaaaaggatgtcatggaaagagaaaataattactctcatataggcatatattgttatttatttccaaaataaaagaaataatgctcagtatcgctcaatgatttacttagcattatataactaattagtgttagaaagtaaattgaagtcccgcacactcaagttcatagttcttttagtgattttatagccatagcttcatatgaccagaggtgtgttagtaaagagattcaaagtcatcacatttcaatatagctctaaagccaacttgttaattggaaaattgctagattatcattatatcccagtgattttcctattagtttactatttgaggtcatatgaattatctatttaataacagaaatttggggcaaattgggccatgatatccttcctgacctcaggtcaatatatttcatcttcacctacaagtttaaaaacatataccacaagaattgttcaattaaaatgcttctgaagtctacattaccagtgatgtgttcttaagttttgtggtagtcaaaggacctgctaatgtctgatattctattgtcatggatactgacaggctgaagctgtcaggttgggaacatttgccattatttctgatgaaaataatgagaattggccaggcgcggtggctcacacctataatgccagcactttgggaggcccaggcaggcagatcacaaggccaggagttcgggaccagcctggccaacatagtgaaactccgtgtctactaaagttacaaaaaattagccaagcatggtggcacgtgcctttaatcccagctacttggaaggctgaggcaggagaatcacttgaacctgggaggcacaggttgcagtgagccgagatccagccattgcactccagcctgggcgacagggcgagactccatctcaaaaaaaagaaaaaaaaaagaaaataatgacagttgctattggaaaatatatctaatcaaaaacataatacaatggacccacacatttgtgaatgggttgattccaaaacaactatttaaaaagagttatagctatattgcagaaagcatactgccactttaaagaatctaagttaagataaagagaaactttaattgcaccaagaccaaatgagtctcagaagttttgattcaaattactaaagtttggggaaaataaagttaactgataatgagattgaatatttgaattgcatctttaaaaatatcacatcttaaacttttttttttttcagttcaatgattcactattgctctgccaagtttctttctcttaggaaaacatcactaattagaaatgaggcatatttcatgaagaaaatattatttttctgttcttaacaacatgtttcactttttatttcattggctatattgaagagttagaaggaaattgtattgccttaaaaatcaagacattatttttatttatatgtataattagactatttagatgaattgattttcttaatgtgctgtgcttaagaaactagttagaaaattaatccaatagatttttttgaccaaattccagtcagattcaagagaggtttctcaatattaaagtggaaaaaaacagtcttttttcccatttttaagcaccatttttaagaactgagaatttgtcatagagcatattagtgctataatagactaacagctatgagtctttcatctcttaggagctgaaatttatttcctagctcattatatcctaggacaggaaggaaggaaggaaagaagaaagagagggagggaggaagagataaaaagaaatggcaatcaagaaaggcagagcccatgcttactaaagatttttaaatttgataagcttggaattgatgataaaatataaaacttccatgttaatatcctatgtaagaaaacacaaccaacttattatcataacttggcttacataaaattgtccttgttagttctattgtttgtttgttttttgagacgtctcattctgttgcccaggctggagtgcagtggtgtgatcatggctcactgcaacctccaccccctggtctcaagtgatcctccaacctcatcctcccaagcagctgggactataggcatgtgccaccacacccagctcatttttatatgtttttggtagagacagggtcttgctatttgcccaggcctgtctctaacttctgagttcaagcgatctgcctgccttggtgcgctgggattacaagtgttgagccactgcaaccagcctggatttttcttttaggatttttaaatgcattttgtatttagaggtaattaaaaattcacaggtagtcatgagaaataatatagagtaatcaagtatacccttccctggatttcgtcttacataacaagagcacaatattaaaactagaaaactggtattgatataatccatcgagcttattcagatttcacaagtcttacattcactcctttgtgtatgtatgtgtatgtttaactcaatgcagtgttattgtatgtgtagtttcatgtgatcaccgccacagccaagagagagaacaatttcatctaaagtctcctttgtgctattatgatctcagatacctccccccaaaaccccaaccctgacacctggcaaccactaatttactttcgatctccataattttgtaatttcaagcatgttatgtaaatgaaattacacagtatgtaaccttttgagactggctttttttcactcagtggaattctctggagattcatctaagttgtttcatggctgagtaataatccatgtagtccaaagtagtccatagtgcagtggactgaattttgtccctcccaaaattcatatgttgaagctttaacccccgatatgactgtatctggagatagggtctttcgggttaaaggaggtcatgagtggggacctaatctgataggactgtgggccttagaagtagaggaagagagatttctgtttttctctgtcatataaggacacagagagaaggtggctattgcaagccaagaatacagccctcaccggaaactaattggcacccttacctaggacttccagcttccagaacagtgataaataaataaatttctgttgtttatgccacccaagagtgtggtattttcttacagagaagtctgagctaacatacatggcatgaatataccagtttaaaatgtttatttaacccagagcctctgggttgcttccagtttggggctgttatgaatgaaattgctattaaaattcatgtgcaggtttttgtgtgacatactttcttatttgtctagagtaaatgtccaatagtgtaattgctgggtgatatggtaagtgcctatttgattttgtaagcaactgccatacactttttcttggctaactgcattgttttatattcctactagcaatatgtgggtgacacattgtttccacagcctcacagcattcaatgttatcattgtttttttattttagaccttttattttgttttgttttgttttgtttcagacagaatctaactctgtcgcccaggctggagtgcagtggcatgatctcggctcaccgcaacctctgcctcttgagttcaaacaattctcctgcctcagcctccccagtagctggaagtagaggcatgtaccaccatgcccagataatttttgtatttttagtacagacgaggtttcatcatgttggccaggctggtctcgaactcctgacctcaagcgatccacctgcctcagccttccaaagtgctgggattacaggcgtgggccaccgcacacagcataatgcttaataatgataaacatcttttcatgtgggccttactagatttttgaaaagtatattgaaccatattttaaaagccctgtggattttctttttcaaagatatgcatccaataccaaaaattttggtcaagggatttataagccaaaacatttttactccttaaagctcaattttcatacataaaactcctagagaaataaaatttagatgtttttagactcatggaaagaagaattcgaaattgtagatgtcagaaatcttttttaattggttctggagtcctttttccatgttttgaaaaaaatattatatatgtaaaagtttagttcaaacagctattttgaggagcctggttctctaggaggtgagaagctgtcccagttttcccctccaatccaacaaagcaccatgtgaggataaatagattttcagggcaacactcagaatctgcattaggagtggacctctttctcagacagtcatgagaaatcttgaggctttaactttggcttttaaacatcttcctagatacctgcaaagtaggagctaatagcagtcataataatgggtgcataaaagcaaattataattattggtttaataatcaacagttaataagcaaatgggtattttagtagaatatgttctgccgataatggaaattgatttttttaaaaagaaataaattgataaccacaaacttaattgaacagaaaaatctaaacattattaattaacttggaagaaatatattccaaataagctatagattggataattagaagttgttagtgataagaaatttttcctcaccaatctcattttgcttactgcttttaatgtgatgagcctaaagtgaaacaacatcctaaatcataaatagaaagaattgtcttcctttcattctttgaaagatgatagttcattctgactctccagtaaaagaagtcttatcaaataaaaatgattaaaaataaacatcaaaaaagataaaacatgaatttaacatttatcatttcacatttctgtcagtagcatggccaattgtctacagtagaggttcctagtgggagaagttagggaactaagcccattaaaatttctaatgcacttaggatgtaaccgtagtgtatctaacaaaatcatatattatgatggtaaaattttcatttaaaaattatgcttttctgagaccattgtctttagtgtctgaaggaatataatatatgttttaaatattactgtgcttttttaaattattttttgtagactctcttgacagaagtccagtttaacacagaattctcagccgtattttacctttgcctctatgtttatgttatctctgaagtgggaatatctcatgtgtgtgtgaatacacaacaatgtttgtcttggatttccatagaacatagcgagaattgtgaaatccatgtgtatttccggagtgagggagaggagcctcctaaattatgttgacttcgtttctcaccttgttgtcattagagtccaataacaatacaagtatgtaagttctcctacctagcagaaaaaaatttgctgcgtgataccgatgtatttatggatccaatttaggttactacctttaataattccctgttagtgtgtagtgtgcaagatgagttatcccagttttcccaagatcattcagattatgaagccatatattaagtgggacaaaatccctgtggcttctattctgtggcaaagtgtatacaaatgaggaattgaaaaaactctttttttttgcatttttaaaaaatatatagattgaagtgctttagaagtaaagagacaaactagaaataaacaataaatataatagctaatatttattgaccgggccctgcttttagccttttcatgccatagatgaatcctttgatcctcaaaaacacatctgagaaacattctatcattatcctcattttatggatgcagaaatggaggcttagcctgcttaagttacttaccaaaggtgagagagcaaagaaatcaagatttaaacccacgtatatccgattcttgagcaaaagtgtttcctactttatcatattaaaatttttcacaatacttcagaaacaaactctaaattaaattgtaatagaaatactttcattgagtactgttgattcaacataaaaataactttagggaaaaaattttaaagcatattttatgccaaccagcaggtacatagaatctgtcaaattaaaactaggtagtaaaatcatttttctttcaaattttatcactacccatttaaagttgtcattgctcctttataataaaattatttttttctaaactaccattaactagtagttttagcaactgcaaacattttataagtacagctgtttacaatgattactttttctatatgttaatgctatacagtcatttacccttaaagtatttacaaaagactcaaaattaaaaataaaaaactactatttgtcatttttaaacattgatttttcagttctttacccttagcttgtacctttaatttctctctctttgctaccttcgtccttcagtctatagctatcgtatggttttactcaacttgaaaaaaaaaaaacatataagctagtgagcaagtaaccattccttaaagctgtgctcttccatggcttctattatagattctcccttactaatcatccttaaagtgaaagctactgtatcctctttgtcactctctattcacttttcaacccactgtcatgggactctgccccatctgtccaggttaccacagcagtgtcacgttcaccagatacttagagtcctcatcttaactaacactctctcacactcaaactgaggatcattttttttatatttagtgcttatattgttttccttgaaaatagattttttttttttttttttttttttttttttccagagagaggaatcttgctctgcttctcaggctggagtacagtgatgcaatcacagctcactgtaacttgaactcctgggctcaagggatcctcctacctcagcctcctgactagctggaactacaggaacgtgccaatacatccagctaattttctgcagagagaggatctctctatgttgcccaggctggtcttaaactcctgacctcaagtgatcctcctgcctcggcctcccaaagtgctaggattacacttgtgagccaccacacacagcccttgaaaagttttcaagaagagaatgttttctcttctgtatgcgatgtgtgtgaatgtgtgtgtgcgctgagatcattttaagaaatggagttttaaaaaatctttatgttcttaactggtaaacactacctacctaggttccattatatcctgtttgattactgagcttttatttctattaagtgtctatgagagtttgtgagggtagcccaaagtaacaagtattctacttagctcacttaaagtgggctgattaccacctagggtataagtcaagatttctggctcttttatttggacctatgctaatagttttgcttgatatatgaaattaaatgatggcgggcactctgtaaaacagagcagggagatgggtttagtaaaatgtagtcactttaatgaggggttgggaagaactggatctgagctgagaatcctactgaggcaaatggcaaagagaaaaatcttttgttcaatctgaaaccgttgggtttgtaacacatttttttcccacataaatcagtttgatatctaattcacagacactgttggacagcacagcaattgcagccagggtagatgggagtgaaagctagtatatcttcttgtcttcgtagtaactgtatcttttctacaaaggtcagtaataacaatttcatttggggactgtaatacagaaggttaaaaatcaaatgaaatgtacaagtgtcattttccttattcttgtttttccttaaagtcttggggagtaagtactattatagattttgaaaattattcgcatgatgtgggataatgatgtccagcagatttaagtacccactggtaattatttatcccgaagaaaatcatatacagaattctaatacatgaaataaatataacaataactaagttccattaagtgtttacaatgagccaggcattgtgctaagtaccttgtacatattaacttgtttaatcatcaaaacaattcaatatggtaagaactattatgatccctaacagactaggaatttgaagcttggaagaattacataataacgtaaccaaggtaccacaaaaatagtaagtagtagatctagatttattctcaaacaacactactaatggacacagataaatgtatacctccttcaaacgatggggggactgatgcataaacttgggtggttttggctaggtccacgttttgacctcacagtattttctaaggaaattcccaggaccctctgctctagtgtatttaaagaaagataaaatctgaattttgcattctaactctcggaatacgtgctgtttgaagttctctcattactgaacttccattaaaatctttttaaacgaagaaaaaaggcataagcagaccggaatcatcatttacccagttactcaggttacatacaaccctaaagccaaattggatgctatacttgcccccacagtgtcacatgcaacccgtcaaaaaagttcaatatttttctttcaccaaatacaggcatattttggagacatcacacgatgtctccaaaccagaacaaattttctggtttctcagcacatgtaaatgttatgtttgcactatactgtagcatagtaagtgcaatagtatgatgccaaagaaaaaaatgtacatagggccattagaaataatttattgctaaagaatgccaacaatcatctgggcctttagtgagtcaggatctttttgctgatgaagagtcttgccaggatattgatgactgctgactgatcagggtggtgattgctaaaggttgaggtaatggtggtaatttcttaaaagaaaacagtgaagtttgtcataccaatcacctcttcctttcacaaaaggttttctgtagcatgccatgctatttgatagcatttacccagagtagagaagaacttctgtcaaaattggagtctatcctctcaaccttgctgctgctttatcaattaagttgatggaatattctaaattattttttgtcattttagcaatgttcccagcatcttcaccaggaatagactccacttcaagaaaccacttttattgctcattcactagattcaatgcttcattcattcaaatttaatcatgagattgcaggaatccagtcacatctccaggctccaattctaattcttattcccttgctatttacagcacatctgccattacttcctccattgaactgttgaacccttcaaagtcattcatgagtgctgaaatttacttcttctaaactcctgctcatgttgatattttgacatgctctcatgaatcatgaatattcttaatggcatgtagaatgatgaatttgttccagaaagttttcaatttactctgcccaaatatatcagaagaatcacctatttatggcagctatagacatgaaatgtatttcttaagggtgataagacttaaaagttaaaattaccccttgatctatggactacagactggatgttgtattagcgggcatgaaaacaacattaatctccttgtacatctccatcagagctctggggtgaccaagtgtgttgtcaataaagagtaatatcttcaaagtaatctcattttctgagcagtagttctcaacagtgcacttaaatatttagtaaaccatgctgtaaacagatgtgctgtcatccaggctttaatgtcccacttacagagtgcaggtagaatacatttagtataattctgaagggccctagaatttttgaaatggtaaggaatactggcttcaacttaaagtcatcagctatattaaccctaacaggatggtcagccgtccttcgaaactttgaagccaggcattgactttctggttatgaaagtcccaatggcatcttcctttaatgtaaatgaaaatttgtttaatgtagccaccatcgtcaatgatcttagctagatcttctggataacttgctgtagcttctacatcagcacttgctacttcaccttgcacttttatgttacagagatgacttctattatgcaccctcatgaaccagcctctactagcttccaacttaccttctgcagcttccttacctctccaatgcctgaagtttagatttctctgaacttctgttttctacacagcacatagactagtacctgaagatgtaaagattcctcatagtagctggtgaattaatgaattgattttaaaatatagtgtaacaaaccctagtttatcttaataaaaatcctttgtaagaatagaattatttccaatatttacaaaatatggtagtccatgagattatcaagaagtaggcttagaaaaaaaggatttaataaatttcacaagtgtttaagaaacttcttaccaaaataagctttctatttggcctgtcacattggaattcaaatggcattgaaatacttccagttccctttaaacttcaatgtaaaaattacatttttagtgtttaaaatgaagtatatctgataatggtcttctccaaatctaatctaaatggtagattccttaaactacctcatgcaggcctatttaatttcctcttaaattgtcaaaatctattttttagttgaactcattgtgtagatcactttaacagctttttttctgaaaatatctaatgatgttatacctctatacatactccattaacttaaaaaaatgaatttagaactctaaatgtgtgatttttatgtgtgaaaagattcttacttaggcaaactatattctattatctttaaaatagactgcattatcaattcaaatgtataactgatcaaattagaagagagtgatcaaaaatagtcatataggcaactcctaattaatattagatttaactttctctctacttcagttatgtagaaatagtggtttaaagataatgctacattatcagaagtcaaaatagtttttaaaacatgcctacaggcatatttttcaagtttccttattgttctgaagacatggctgctcaaatctggatcttcaaatatttgaattatcagaaacttcaagattctacacccagacatcaccgtccttataaacaatttatcactttagaattgttgccaaagcctaataaaaactctaatcctctctagagaaggaaccttgattttgtctttttcttctccagtgcagtagttttcagagtgtgttccctgaatcagcatcacctggcaaagtgttagaaagcaaattcttgggcaccagcccagacctactgaatcagaagttctgggagtggcgccctacaatttatgtttgcgaagccccgcaggtgtttctgatgcagtataaagtttgagaaagactatactggccttaggataatatctggcattcacaggttcttttattcatcaactgagcagaattaaatcaaaatgagtaaaataaagtaaatcaggtgcctgatataaggaaccagaaattcctaaaatttagttgcctgaggcagaactacataaacacataatatctcaattttcactgatttccagtttactaattaaaaaaaaatgaggtgatccatttgggtaaaattttttaaaaaactctaacttcacaaaatgtttgacagtctttttaccttttatccatgtctgtcaagcttattaaattgaagataatactaaacagaatgtcatgagtttaaaataatgattttattatccccctgtaaagacataaccatgttttcttcaatactcaaaaatgatagcattgaccctcaatcaatagatgtttcacgtgtgatgaatttgttctactacatctaaagagtccctgtagctactaacagcactcaatagagggtccattagggattcttcatggcacccaactgatacattcattcaaacaactacttagtaagtgcccacaaggtacttaattactgccagacattgaacaggatacaaggcaatgtagggcaattctgttctccaggattctataatgtggcctggaattaaaagtaaagaaaaggaaaagggccacacatttttctcataccatcatgtgccaggcactgaatagagcaggagaaataaactatatcagtaaatccatgttaccactcagggaagttggcttcattcccagattacaaataaggaaacaatagtttgagagatgctgagaacttgttcaaactcatcaggtaagaaacaagggaggtaaaatttaaaatcaaaactgatttttaagtgtccactgtaccttacactatatcagttcttatataaaaaatcagcagcaagtcttagaggaatacaataaatgcctaaatgaatgatgcacattatttgctgtagggcgattagaaaaggagcagtaactgtggatgaggaagtgaagccttcccagtaaaagttcaacacagatcttcattgaaagaaaatggtttgtagcttggataaaggaaagaagtaaatgtattccagatgggaaaaactgttaaacagaaatgtgtagtcaggaacaagaaaggcaggttccagtagagtggcaaaaatcagctcagcacatttagttgccaaataaatgatgtagaatggctttgcttggctctagctatgcatgaaggcacacattttaacaacgaaaggggagtggtgaacagtgccacttagctttacttaagtggtgtatttactgcctgtgtccgtgtacattcagtcaaggttttgaagtgcctgcttcttttggctctaattttgtatatgcattatctttcttcatgtaagtgatcattctgctcctctcctctgcaaccaacaggattagttcactttagccatattatttctcaaaaaaaaaaaaaaaaaaaaaaactcacaggtactctttcatatatttctcaagtccctacagctgaacaagttcttaaaaatatcaggtctctggccgggtgcagtggctcacgcctgtaatcccagcactttgggagtccaaggtgggcggatcaagaggtcaggagttcgagaccagcctggccaacacagtgaaaccccatctctacaaaaaatacaaaaattagctgggcgtggtggcgtgtgcctgtaatcgcagatactcaggaggctgagacaggagaatcacttgaaccctagaggcagaagttgtggtcagccaagattgcacctctgcactccagcctgggcaacagagcaagactctgtctgaaaaaaaacacaaaaaacaaaataacaatatccactctcccaggtacttatttgtagttactataatgtgcctgaaagacacaagttctaccatgagtaattcagtattcattcaacttgaataactacagggttaggagagtcattttgaaaatggttaggattattagttagtgttaagaaaatatttttagatagttatggtaggtaaagtatgtctgaagaaaagatgtatttgattgacttatcctttaacttcagtgaatttttatatctctgtatttattttgaatcaaaatccccaggtacaggtaggagaatttaagacaaaatttcaatagcacctctgttttcctgtcttgttacagtcctctatgtggtaagaaatgtttttgtcatttgctttctgtgaatttcaaagtgatgtcctgtgataaaatagtggttcccctaagatcttttatttaccctgggaatgtcattgatccaaaagaagataataaaatcagcaataaaatagtaaacattctgtatgggatatcacagttttaattgactacagacactcaaatcaatttttcaatctgcatacacatgacaaggtcagcaacatgggaagctgatgttgctttcctttataagagatatatttaagatttgtaatataaacatgaagtatggtactttgtatatctctttatatatctcttaaaaaatggactttaaaactgtagatattaatgacacttcaatgtaatttttaaacaaattttaacaaaaattacttagaaaatattttgcttagttttcttacaggttttttaaaaatagtatatttgatgataatgtgattaaagaatacacaccaatttttttatattatactttaacttctagggtatatgtgcactacgtgcaggtttgttacatatgtatacatgtgccgtgttggtttgctgcacccattaacttgtcatttacattaggcatttattctaatgctatccctccccctgacccccaccccatgacaggccccagtgtgtgatgtttcccgccctgtgtccaagtgttctcattgttgaattcccacctatgagtgagaacatgcggtgtttggttttctgttcttgtgatagtttgctgagaatgatggtttccatcttcatccatgtccctgaaaaggacatgaactcatcctttcttttatggctgcatagtattccatggtgtatatgtgccacattttcttaatccagtctatcaatgatggacatttgggttggttccaagtctttgctattgtgaatagtgccgcaataaacatacgcatgcgtctttatagtagcatgatttatatacttgggtatatacccagtagtgggatggctgggtcaaatggtatttctagttctagatccttgaggaattgccacactgtcttccacaatggttgaactagtttatactcccaccaatagtgtaaaagcgttcctatttctccacatcctctccagcatctgttgtttcctgactttttaatgatcgccattctaactgcacaccaattttttaaataaaatttatttttatcaaaatttcctgtgtactcagaaaaaaagtgccgtacatataaaactaataatgtaatataggaattgcttctctacatctccctacatgctcttcccactctagcgaagcaaccttcaatttttgttttgttttgttttagctacttttggtatttttcaaatattttaaataaaattttcacactgttttttcttgatttcctagatactgatatctattgatatactaagttgcaagatgagaatttaggttgcatatgtcatctctcacatgaagttacccttaccccccttctaatatagttttaacacatttataactaaattcatattcagtattatcatttatatgactgtctttgtttgggttgctataataaaaataccatagactgggtaatttataaacaacgtaagtttattgctcacagttatggaggctaagaagtccaaagtcaaggcaccaacagattgggtgtctggtgagggctccctctctgctttaaagatagcaccttctcactgtgtcctcacatggtgcaagggcaaaaggtgataatcagcttcctcacacctcttttataagggactaatccctttcacaagggctctgttctcatgacctaatcacctcccaaaagccccaccttctcatatggtcactttgatgagtaggttttcatgtaagaattttgagggaacacattcaagccacagtattctactcctggccctccaggatttatgtccttctcacatgtaaaatatatttattccagacgaatagctccaaagtctttttttttcttttcttttttgagatggagtctcattcttttgccctggctggagtgcagtggtgtgatctcggctcttagcaacctctacctccacggttcaagcattctcttgcctcagcctcccaagtagctgggattataagcatgtgccaccacacccaactaatttttgtgtttttagtagagacagggtttcatcacgttggccaggctggtctcgactcctgaccttgtcaagtgatttacttgccttggcctcccaatgtgttagcattataaacgtgaaccaccgcacctagcacccaaagtcttaacttgttccagcattaactgaaaagtctgaagtgcagaatctcatctaaatatcatctaaatcagatatgggtgtgactcaagatgggaattatcctgaggcaaatttgcctctagctgtgagcctgtgaaataaaacaacttatgtgcttccaacatacaatgattggacagacatagaaaacacatttccattccaaaaagaagaaatagaaaggaaaaaaagtggtaacttgtcccaagtccaaaatgtaatgttgcaaacaacattaaatctcaaggctggagaataattcttgagtagatatcctgcctttcaggcacactgggtcaagcatcgggcccccaagtttccaggaagccctgcccacatgggtttgcagaatacaaccagtattgcagctctcacagggtttgcggaatgcaaccagtattgcagctctcacagggtttgcggaatgcaaccagtattgcagctctcacaggttagacttgcatgctgaaggctgtactattctggaatctcaagggtgacctcacccccagagcttcaccagacattgccctaatgggatccctctgtggtggccccactcctgtggctgttcactgcctaggtcctcagactctctggagcttcatttgaaatctagagtcatccgtgcctccacagctcataaattctgtgcatctacacctgtggagatggcactgtgcagatgccatcattgtttaccatctgtaccttgcagagaggcagcccaagctgtacctgggcccacatgagcaacagtaagacagggcaaggagtgctgttccagaatggggagagcagagacttaaaatttttctgttcccaaggtcctggatttctaagcttatgatgggagtggccagcccgatgatctctgagatgcatttgtggagttcttctgtccattggcttgatgaataagagcccctggcttccaccaatccatagtaaccttatcaaatacaaacagtggaatggtcacatccttggtgttctctatttttcatttgcaacattgccaggctgagaattttccagatctttttctgcttccattttgattataattttttctttaatttgtttctctcttcttacattttactataagcaatttagagaagccatgctacatcctcagtacttccaccaaatatcctatttcagtgcttgtaagtttcaccttccacgaaaccctgggacacgattcagtcaagttccttgtcacttaataacaagaatcacctttcctcaagtttccaatgacatgtttctcatttctatctgagacctcatcagaatgacctttatcatacacatttcaatcaatattctgatcacaaccatttaggtaatctctaaaaagattgaggccttccctacagttctcttcttcagagccctcaaaataaccccattttatggtaaattcatagctttttctagcacgtaccttcagattctcccaggttctgcccattacccagttccaaatctgctccacattttaagttatttgttatagcagcaccccagttttgggtaccaaattctgtgtttgtcagtttgggctgctgtaacaagatactttagaatgggtaatttataaacaatgtaaatttattgctcacaattatggagactgagaagttcaagatcaaggtgccaacagattccgtgtctgatgaggactccctttctactttaaattggtgccttcttactgcatcctcacatggtagaagggcaaaatttgataaccagatccctcacatttgtttataagttcactaatcctactcatgacggttatgctcacatgacctaatcacttcccaaagggcccatcttctaataccagcaccttcatgactaggtttcaacacaggaattttggagggatacaaacattcagatcatagcaatagccatctaaacatttttttctagtttcagggaggatctgactgataattcaatgtgtactttcattcaatcatattaattttttgttcagcaccataccgaagtatccacatatccattgattccaaattgctttaccacctgtactttgcagagggaatatggaactaaggaatatacagatagttttgtgtggtactaaacaacaacaccaccacaccacaccacacacacacacacacacacacacacacacacacacacacaaatctcatctttaaaaaaaaaacaaacttcagagtaagatttttttgtttctgctccaaaagtgtgtataaaaaacctgcaatagatcaaagtccttacctcttcatctagtggtaactttttccctttgaactctgagaatgacaccagtattggtggttttaatttctgttgccctctttggatgagcatatttacaactactgaagttcaaacttgtcacattgactttgcatttattttttatattatcttttaaattggcatagtttagaatgcctaatggtttcattctttatatttatgtcataatttgttacctaaattaaaataaaatgtttcaagaaagggaactaacacttttgttttttattaaaataaaaagaaacaacaaactgtattgtctttatatagacttcttgtttataaccttgatatttctagaacttaatatagatttctatattttattaaactacatctcaaaagccactattgatttctataaattgacatagccattgacttaataaagaggacttaattcagctctgcaggaaaatcttattctttatccaagatttgctgtcttttcaacttcattcagaaatttggcagattggataacccttgacattttggtgaaccacctgacaatttcaattatagtttgaatttcaaacagcaaatatttgaggtgtttcagattccaaatcatatccaactctcaaccctaaaaatgtccttttcttggctctcaataacattttttccatttgaaatgtttcctttttaagtttcttagtcatattcaaagctaaagataaggatttttgaacagtgtcaacttttattaggacagagagaaaatacacaatttagcaatatgacctacgctatttcctagctttagagctagatcatcctttaactaattatttttcttttgtgttactgttttaatcataattcatattggatgttttgggtctttgacataattcttttcattagatttgcagatacctttattcataaagcaagtttaagtaaaagaaagttaaggtataattttcaatataatataaatatgatttagaatttttgaaaattatttgtgatttctatggcttacagtagataatctacaaaataatttgaagaatatttagaaattaatcttaatttatctcagaaattttattagttctgagaatgatctggcataattgcaagtattaaaaatttcagataaagttgattatgcatttttaatagtgtacatgcaaaataaaatttaataaaattagaaggatgaagaagcacgtgttttatttttaatggagatttttattcatttttagcacaaaaaatagcaaaactctagatagtctttgcaataatgtactggtagtatgtatgatgaaaaaccatacctggaaagaatgtaaccatgttaaaggatcagttggtaagaaatgttgctttcctgcttcttactactctgtatatcagaatctgaactgccatagcaagctgtcttcctctttgctcacatacctaacttctaaaatgttgagagagattctttatggcccttataaatagaaacattaatttgttgaacgtaattgaacccacaaaatgatttttaaattatatgtaattttaatttgcaacacttatacaaatataattttaacaaatttactctaaatatattttatacaaattataaattgtgcacagagccattattacatatctttatttctttatcactaagtgttgttttaaaaaaaatcttacctttggaataatactgaaaatagcaataaacatttatttttctttttgtcacatcaagatttgtctaattctctcccatgtgtcccaaattgcttttatccaagcccaatctgccctgccatatcaattattattgtcaagtaatatgtaactatcttcataacagtatcaatctctgcttttaatttactcaaaattcatttcaagcatattttatttatcaaaaacatttcaagaaaattttatctctgcaatatgttctggaaaatgccaaccataaattgcttgctcattatacccataatatcttctatctatttctatatgaccattcattgttctttttacaccttcacaatatctctttctaacaacaatattctgccctttatattctacatttgaagacttgatggtgattggataatgttccattttattttcactggggcttatgtcttatgtccccttacagacataaccatgattctagaagacaggaacagtaatttacctagagaggaactgaatccataaccttactaacactttgcttttttaacaaaatggggcaaccagcaactgaaatcattccatttaaaataatttcacacctcaccgaaagaacttgaaaaatgaagccttacaataggccaatattctatttttaggaaaatagatagccttctctaacaaatacatttttctcttaaatccttacattagaaacttgaatgataaacacttcagtgaatagtttacaacttatagtgtaagatacaagattttattcctaaaagcaaaggatgggtaggtcttaagaaaggagatttcagaccaggcactgtggctcacgcctgtaatcccagcactttggaaggccaaggtgggcagattacctaaggtcaggagttcaagaccagcctggccaacacgtggaaaggcaaaacccattgctactaaaaatacaaaaaatagccagcatggtggcaggtgcctctaatcccagctactcgggaggctgaggcaggagaattgcttgaacctgggaggcagaggttgcagtgagccaagactgtgccattgcactccagcctgggcaacaagagcaaaactccatctcaaaaaaaaaaaaaaaaaaaaaaaagagatttctgttgattttaaaattatcctgagctaaccacactgtcatactgcaaatcagggtgaaatgtgtccataagaacaagcctgccgaactaaggtattgcctgccttatctcatgagataattatttgttctgtagtggggtgcatatatttttaaaatgtgttacaccaatgtgtctacaaaagaaacaaatgaaaagcaaaacaacaacaaaaagatcacatcatttcaacaattgtggtgatcaaaaccacagaatatttacttcaagtatgtccttgtccttaattagcacaagaattagtgctaccagaatactcttaaagactctcttctaataattctatcatcaagtcatcttggaaggaaagcttttaaagccagtcagccagcctgcttaatgactgtttctgtagaggaatacaagtagctcccagaattacagttgtcagcccatctccttgggtctgaaggagaccgagggatcattatcaaatagatcatttgatatggtttggctgtgtccccacccaaatctcatcttgaattgtagttcccataatccccacgtgtcatgggagagacccggtgggaggtaattgaatcatggggtcaattacccccatgctgctgttctcatgatagtgagtgagttcttacgagatctgatggttttataggggcttttgccccttttgctctgcacttcttcctgccaccatgtgaagaaggacgtgtttgcttccccttctgccatgattgtaagtttcctgaggcctccccagccacactgaactgtgattcaattaaacctctttcctttgtaaattacccagtctcaagtatgtccttagagcagcatgagtatggactaatatatccttatttgctcttttccttttgtattctgacatgagtaaactgtgaaattgtgctaaatagagatgtatgctaactgtgaaacactgataattatttcagtaaactatgatacatataagagatttaaaacgggtatatgcttctttaaaatagacgaagaaagtcttggcatacatctccaggataccccctgaattataggccacaattgtacctcacagcatttatggcctcaactctagtaacagaaacacaccttagtcctattctgtagttcctaataaagattgattctcaaaataaaaactgactaaagggcagaaatacatacagtaatcttcaagaattttttctctttatctgcctggagttagttgaagcaagctttgacaagtcatttatttaacagtttagcggaactcattcctactcttgaacctggaatggaatgtaagaaataaagagcagtggaatccaatgatgtatttcaggatataattggttgtctatactcaaggctgatcttatcacttgagatgaaaaaagaaaaacaaaacatggtagtggaaaaaagtttatgtttacaaaccctgaaaacttaattcttgtaaataacatcaccacaaatagaaaatatgtgtcatcaaactaatttgtgcaaagctataatttgtgtagcaatgattgaagtataaatataacactttagtgtgttttaaggagtttttttcagatatgctattttctctttacaataggcttgaaaatatagtatttttttctaaaacaagccttttgtctttccttctatggaaagatgcatgtctttagttatttctgctggactattatgtgtggactggcaggtattggcatacttttcataatcctaataagtatccggtgtagccagtctgaaagctcatttagaacaggacaaactctgtcttgcttgttgaaacaactccagtacctagcaatgtgtctggtacattcttcaggtgctcaacaaggcagaatggctttgtttattaattaaataatatagactcaaatccattcagtccctgaccaggactcttcataaaacagtggatctcaaaatcattccctgaacctacaatattgcatcaactgagaactcgttagaaattaaaattttcagaccccatgccagaccttctaaatcagaaactattggggtaggcccagcaatctgtgtttaaaaagccctccaggtgattataacgtatgctaaacttgagcaccattgatgtaaacaatactcaaatacattgtgcacagctttttagaattatgagagtggcttaagggtatattacaagaagacaattcctatggacagattgtgaataattttaatttctcaagaattttgttctaatttttttatgtataggatagttggaacgtatgttctacttcttacaagtatctttattttaactataggactactcccctcatgtaacaaattgtgtaatttgtataggaaggctgactcagtttgagttactggtacagatactgagacaaggagttgaatgcagatggcttattaaggaggtgttcccaggaagcacaagtgaggaagtggtgaacatgagagagggtaaggagaaaagccagtcaagcatgtgttaacaagaaagggttacaactgtgggcaaataggtctcaatcctgtggagaaccatctgagaaagcatgtgtggaatatatctcagaatcacccagtggagagtggagagactgaaacatttatgtacttacttccagctccactgtttgagagttgatctccagtggttctaacatatgccatattccaggttatatttgtgtatggccaaataagctggacaacgtcatcaggcagagaagatgagacacagcacttgaggtgggacatgtcaatacactggaaggttgaattgtcactgccttgagaatggaagaagagcagaactgactatatacagaaaaagaatgagggtcagctttaactaggggttagaagccatgaatttgcaataacaccaaagcacccagttgtgtgttccatttctaggaaaggtagaacagtgaattctaagacatataaatggcattcagagtaactctaattgttttataggaagtatgcaatcataaacgctgacagataagcatacatgtaaaatttttaagaaaggttatgatcactaaaatatagcagatgacttcgaatgttcttgctttatgtgatcacaaatgggctcctttgtcgaattctagaattctgctctgcaagtgacattttgtttgagcagttggcatctggtacctcagtttcaactgactttttgttactaaacacagttcgaacaccgtaaggtaatttttcaatggtaagaaaaggtagtttatacttcatcctagtgaaataactcaggcagggaagtcaattgcttggaattatggaaagtttccatgctatcaagcccaacaccatttgaaaacattttttacagtaggccacaaagctgcctttttatggaagaaactatgaaagaaattttagaaaccccagaaagctccaaggtcctgttctgattcagtaaaaatttcaaagactatacctcctgagcttactttgagaatgacaaaacacaagtagcttaggaagacggacatggaaattcaccttttgcatttccctgcattttcttttggatattttgcacagaaaaacaataaaaccttttgatttttgttttcctgtgaagtcttttaattttagtagaatcatcaacattttatgccactcttaaaattctagaaagcaaaatccccatgtaatactggaaaagtccaaggataacagaaatattgaactaggactgttttttaatgagaaataattagcctccatagtagcttcatcaacgatgagctacttataacagtatactaccaagctacacaaagactttcattagtgtaagaacagtagtagactaattaactgtctaactacagaaactagatgcttaattgccatgttgctttattggcacagtatctaagaatcgtcgtccaatttctcctctagaagcttttttgttttcctcctctggtggcaatgggaagtttcgttgtgatgaaagaacagtaacagataactgtttctctggttaagtgtcaggtgcaaatacttctctggttaaacatcaggaatatacatgtgtatgtgactgtatgtgtgtgtgtacatgaaatgtttaatcagttaaccagtgtagcaaatttctctcattctgaaaagaatatgaaaagtaagtcttactaaaggaaaagcacattttcttataccactttaaggcaaatagtcatggaatcacctgtattgttcaaagtcttctatggtttagtctctttctctatcagttatacaatggatgcacgtaagttaacacagtggagtataaataaataaaagtctagtgtatcccacaaaatgttctgcaacattcagtttaactgtaattctaattttgaaaactacataacaggttctgcaacttagaagcagagggctatgagaaaattttgtagaacatatctttactaattattaactcttgcatccactcctgtttcgctttatgatttgggtgagttactttaactttttgttcctcagtttcttcatatttaaaatgcacatagttgtagtgtttgcatgataaggatgttgtgataattaaatgagttattatctacgtgtgtgtgtgtatataaaaacacatagtgtcatacatagtaagcactcaacaaatattagcttatactattattattaatgacatactgtaaatagcattcaataagcatttactggacagaataaatgttgtcaaacatgaccatttatgagtactgtcaaaagtattacagtaacttgagtgatttttgaacacatgtaatgttccagatgctttagatacatttagccatttagtcctcactatgcctccatgaagaaaatgtcattcagctcatcaggaacctgagactcagagtatgtaacataccttgttacagttaaggaggcccagcatttgaattcaagcccatttactcaactttcattttatttttctagtatcagatagtctccaagtcctgaggtatttggctttgcagattttgaatttaatatttctatacttaattactatataaatagttaagatcttctcacttgagaaaatgtaaattgattcattttctgatttaattttttaattaaaattttttctaatgacttcctttttatatgagcttatcaaatagtttagtcctaggtgaggtatggatatccacagatgtataaggacgagttagggctatatggttctcttatttccgcaagcaacatttaggaaaaaaaatctgacccattcctagcaatccattttattgaaaccctactatgtgtcactcactgtaaagggatagaccagtgaccaaaatgaagtccttactaccatgaagcttattctacagcacagaaagagatggtaaataagtgactctgtgtgtgtttatttgtctcaggtgggataaatgctctaaagaataggacaaaagtaacagagactcatgggggagcaataatggatgatcatagaagtcatgcctgatgaagtcacatgcagagacctaaatgaaatgaaggagggagctatgtgtgtgtctctaatggaagagcaatccaggaggcaacataaggacaaaggctgaactatactagaggaccagcaggaaagtgattacagctgaaccagagggactaaggggttatataaaatacgtacaacatggccctcacagccacttacatagttatctacgatttcattaaggctgggatagaggttggctcagagtgtcaggcaagcataagggttgggataatactgcctggagttagagaggtaggatgggaagggtttgacattttgttcacaatttgagttatgagaaacactttgtcaaacagagaaactgagaagaggtcaaaaggaacaaagcaaagcatgaaagtccacagctgtggagagctcatatattgcatttagacgtgatgaatagacttgaaaaactttattttttctttattggcttcaagatagcaagaaagccttagttcataaatcctagcaattaagtgccaatttacccccaaatcattttaagcgttgatcaaaatccaactaagaactcatattcatttgtttgcctgtcatacttaagaattaatttactctgccaagggtcatttagctattaaaaaataatagctacaagaaaataaatattttagtgtaatttcctgatggtgccaaaagttaccatattagcatatggtaaaataggcaagggatgaggggtccttcaacaaacaccgcttttcctaatgttttggcataatgcaccttaaatcaccacagcaaacgcccaggaaaaccccaatgccagcagaaactcacagagaattaaagacagtaacacagtggtttctgacactggcaatgatttttaaatctttattctcatgaggtaaagtactgaaatcatgaatttgcttttaatcactgttcaatctttgttcaataatatagaacacaggaaagttggtctatgccacatgatgaatgcagtctatctcttgcattacacattaagaagcagagcaggtagcacagtgttggctaagtctcagcggtggcatattttcatctcccacagggtgtgggaagaccccactgcacagcagtaacaataaatctagcatatccgtttatgaaataactttggcagtaatggcaagaggatttggatgaaagtgtatttgtggtcttccagctggaagatcagagcagagattctaaagcaaaaaagcagagtggaatggcagatagtggctgcttggaaaagaacagaagacagttgaggatccatgctgagctcaaggggaaatgcaaacaagacagtcctttcagaatatccccatgctgcccagtgttggcgtgagggattactaatgccatctgctggatattcttgggatttaaaaatggtatctaaacaaataatactccagtctccctatgtcttggcttcagttctttaatgagaaaaacagcaacaataaccagctaaagaaaacaagtgaagaaaacaaaactcaggtcatgtacatgtttcctgtaccttgagaaggttggagtttcgtatggccactgtgtttcagacatagtatttataataattgcatttttttggttggtgtttgtttgtttagttttagcagaactctatagtagtgcactttggccatatgcaacactcaggcaactggatatagtttgaactgtaaatccacaaagcccttgctaaaaatatattatacactataaactttgtatactacatactcccttttgttggagagaacattgtggttttattttgtctattttgtttttaaatagggataaaaataattaaaaggaaagaagcacaagtatcaccatttggtcaaaaacattacataggccgggtgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggtggagcttgcagtgagccgagatcgcgccactgcactccagcctgggcgacagagcgagactccgtctcaaaacaaacaaacaaacaaacaaacaaaaaaacattacatatacatttgtgtcatataaaatacagtaagtcatcttttgtttttgttttgtggaaatattttcctctgtcgtgctctctgtaggtttattgtgggattgcaatttaaaatgacaaaattccttctggtatttcagtaaaattttagaacctttagaaatgtgtggctaaattaacattgattatagtctacatgttccaaaccgtactaatcccatgagacttgcagtggaaaaaaatggtttctgtggtcaaatccatctgaaatattctataatccaaatatcttctcctagagatcaataaggcacatgaactgaaatgtgaggagctgatatttactgacagtttaccatataccattatctcatttaatgttcattctgattctattgtgtgggcactatcattattcttactgacaaaaaaggaaacaggtttataatttgttcaaagtcacactcagaaaataaaggtactaaatctgactttagagattgcactcacaagcacaaagctatatgttccataatatcaatcagtgaaatagtatatattaatatgatttttatgttaattatatttctatattcatgttaacctgtttaaagctttgaggaataatgtggtaatagcatctgtttaactttgcttagcccaatatttctaaatctacttagctacagaaaactcattacttttagtggaactagtgtcctacagaatatagttccaaaaatgctgatataagtaagctataatattgctatagatgagaagccagaaagggagtagctctttagtgtttctctagccacttgttccagcgtatctgctggtgtcctctgcctatgcatgccccttgctgatctccacctgatgatttggaagggctagaaatagggaagcaaacacctgatatctttgctgctacaggtgcacagagcactggaactctctgcgtaaatgtgtaatatttagtacatcctgcaaaaggaacaagcttaatttagttaagccacaaggttgagtgataaacagcatgttgctgttattgtttagtcaattaaatcgtcccctgcacttgtaggaactgttccacatttattactagtgagaaacaagctcgggcagggttgttgatttccttgcattgggttgtgttatatttagcacatctaaagatttgagaatgaatgatggaagacacagtgataaattgtcgagcttttccaaagattcagaagttctaaagttcctgccagtgacagatggtctgtccttactcattgcttgtcttcctgacaggacttgatttttttttttccttttttgctcaattcccttatagtaagctcagcttcttgggaggtgggatagtttaatttgttataattacattgctatatttcaaagtggcatcaactctatatgaacatgtcatgctctttttagattattaatgtgcacatgtataatgacaaaagagaattataggataagaggaagagaggaaattcattaccaagggaaagccatacctcaatctttcctgttattttgataaccaagcatattattaaatagagtcctcattggatagtggttttttaaaatcaatattattttaataccttcaatattttataataatcgaaaactttttgaaatttttgtttaaacagcactagtgtttatgagcttgtaaaatatttctaagaattcacacaatgagcccaaacaactataataatgatgtgcctagatattaaacaggttccaaatgaaaaaaggaaaattgcaatcaaatttcttaattcctttcattgatttcaaatacgttcactgctaaaataggagattagaagatatgctaaatagataaggaatgtgggaaaagaaaacaatttcctgtggcagtaaatataaaggctttaaaaattctagcttgtcttcaaataacttctaaaatccagaagtaatttagccctcaagttagtaatgccactagtgtgatagagcattatatagctgcaagtgttaccaagtggaaagagatcaacattatttaaaactataaaaacaatcaggtgaattgatttgggatttataatagttgtcttctgttatctacacaaagagctcagaaattctttttaggtaaattatttttttgtaagtgctcactccatattagctcaatttgataatacatgagaagcataaacaatattatcactgctttttctcctttatttcctttaattctacttctactggagttttaaccactttgaagtgatatgcatataagtgcatatatgtttcactgaatatatatatatcatactactatacattcttttttgtgtgtgtgtgtatgtgtgtgtataatacactactcatttaagtgagagaactcaaagcttactggatttccaaggtctaggctattgaattccattttatctttttattccccttactaaatgctcctaccattactgatatcagttacctttttattcagtggctttttaacattgctttattttggtaacatttgattacaaaatctcagagaactcatgccagcccactggttatgcatgaagatgttaacctagacctagggaaattataacccttgtttagtgaatattttctcagataataaatggaagaattaactttctgtgtagaacattacaaaaaatttcaagcttctttaacacatgatgtcacaataatacatggattttagttgtgtatattacatatacattgatatataattaaaaagacaagacatatctgtttttttattcttaaggaccattctagtataattcgtttttcttctccagataaaaatgtgtttgtaaaaaagattctaaatattcaatatttttgaaaaggccaagaaatattgcataattttgaaatcatgccattataaaatcacagaattaaaagttactctagtgagtatgtttattaaaatttattaagattagaaaaagtgcatagctgaagttaataaaaatgctttgcattaaagataagatgggctaaattagtctaacaagtagacccaaaatgtaatattctactactaaagatttgtttcatgtcagctcagcactacagcatagagtaggaaaggggagtctgctccatgcactggagctactgtggcttccaaggtctctaggcgtgacgtcacaatcctactaagctggaatggacagagagcagacacaagcacatgggaggttttatgagtcaggtttgaaagtggcgtacatcactcggctcacattctattggcttagaactcagtcacatggccttgtaataccctgcagtggaggatgggaaatgtagtctagctgagtgtcccagcagaaggagagaatggattttgatgatcatctagcagtttctaccacatgaacccttgactttgcttaaaaattgaggtgactttaaatgattatgctattaatatagtctagtttttctgataaactttgtatccactcacttgtttgtagggcagggtattttttaaattcatttagtaacctaaattggagactaagtttgaggactaatgattttagaatagttggtccaatagaactcgtaggagacctgttaacttgaggacccaaaagagattcagatagactctttcttaaaaatgcacattaagacatacaggactcatactgaaggttcacagatacttagtacttgcctatggtgaagagcactcaatttagaacatgaagatagatgatttatttatttatctgtagtaatgtgctaatgtttgcttgtaacaaatttatactgctaaaatatcttagatgttaatactcatgaataaaaccaaagaccagaaggagagactatctccttgctgaccctaagcaacagaggatagtacagtgagtagaatcatggctttagacaacatgtttgtctttcttcttcactgaaatacaggatttgtgcctcaatattatttcttgcttttgcctaacatactttaagatgaagagccatgggtaaatctcatggtctagataagttaccaacaagttatcatcataactcttaccttctacttagtccataaatgctgttgcacaaaacaacttctcatttagtaatttctacaggtgatgcagagtgcttatagtttaaattttgccttatctgattacatagcgaagattattatttagcttcaaatgaggataacttaagctaaatagaatcactgtactactattgcttcagaagtattttacatccatgctgcctatctattggtattcacttctttttctctgaattctatttacatattttagtagtggtttacccccttgtacaacatatttctctttattttacccagaaacccactttccttatatcttagtttctagtttgaagtctttttaatctaatggagtctcacgtattttctgttactttttattgttaataaatttttcattatttgtctcttagatgtttaaagtaaaacaatcagaaaatttgaaataaggattaccattactggtataaagtgttttttttttatttttttttagctaaaactgaaaactgccataggttatgttttaattattaagtttcacctataagtggagtatacatatatttcaaaaatgataataatagtccctggagtgtgatggtccccttcccgtgtccatgtgttctcattgtttaattcccacctatgagtaagaacatgtggtgtttggttttttgtccttgcgatagtttgctgagaatgatggtttccagtttcatccatgtccctacaaaggacatgaactcttcattttttatagctgcatagtattccatggtgtatatgtgccacatttgcttaatccagtctatcgttgttagacatttaggttggttccaagtctttgctattgtgaatagtgccgcgataaacatacgtgtgcatgtgtctttatagcagcatgatttataatcctttgggtatatacccagtaatgggatggctgggtcaaatggtatttctagttctagacccctaaggaatcgccacactgacttccacaatggttgaactagttgacagtcccaccaacagtgtaaaagtgttcctatttctccacatcctctccagcacctgttgtttcctgactttttaatgatcgccattctaactgctgtgagatggtatctcattgtggttttgatttgcatttctctgatggccagtgatgatgagcatttgttcacgtgttttttggctgcataaatgtcttattttgagaagtgtctgttcatatccttcgctcacttcacaccagcatggcatgtgtatacatatgtaacaaacctgcacattgtgcacatgtaacctaaaacttaaagtataataataataaaataaaattaaaaatgataataataataaagcttagaagtagataacatatcctcaattatctgatcatgtactatctctacacctcaataaagtcacagggaacaatgtgatgtataatggaatagtatgaaacttgtaccaagtgttaaaaaacaaagattctgcaactaattacgtactttgaaaaaacattgagtcacataccaaatatatttccaattttattttttgtgatgcaatgcacctcttagcaggtgtttctcggtagaacaaagaatagccaacaaaatgcaattcaccttctataacaactccttgatagttatttgaaagcatcttcatttgaaacccaatcgctgagtattattgctaaaaacaacagaatgacctcttacaaaagagtctcacttattatatgcccatgccatgcataaatcagaagaacgtgtcttagaatatgtatgataagatttattagcgtagaaaccttcatatagaaactgcccctactacacacacacacacacacacacacacacacacacacacgcatgcacacatctgaggcttacttctttggcctaagccaagaatcatttagaataaatgtatctgaagttagtcaaacaaagagtgctacccatatatttttattcttccttttaaatatattttatttcttttcatcttattagcaatctaaaagctactaaaatttcctacccatgctttaatgctagtatgttgcctatcacttttggtatttaactttcagataattttagaatagatcaccttagaatacacgttacaaacattttcaggagaatacagagcagtttacttagtcaaaacagtagaaagcatatacacagagaagtagcagcagataagaatattaagttagagccagattgtagaagctatgtactttgatatttattaggtagatgataaaaagacatcaaagtttatttcgagtagggaatgtgatttgaaattttaactccactctccactctcagttaaatcacaaaacagtgtattttatttatgtatttttttctgttgaaacccatggttttctaggttttgatgaattatgttttcaaatataattagcaagtctacagtgcatctatatgtatgtcaaatgcaaatgcatctacagtgttttgctaataatttttccatcttcaattgagtaacaaagacctttctaacatacgattcattttttgtcatttgcaaagtatattcatttagttgggtttgttttgcatgattaattttgactgatagctgatttgttttctattctaggttgtggagactaatttggttgcttttgactgtcactggatcattataaatgaggtaaagccaactaaaccttattgttaactctgtgtccttttttcacatatataattgtagcatttccaatggccttgaatttttaagcggaaacaaaacttgaagtaaacattcaacttactgagtgaatgctgtttaacaaagatagaatgaagagtttttaaaaatgataaagggttttatattaataaaataaatggagaaagtctttctcactgagtctcttttagctctttctgttggctcattctgcctgctcaaggagatcatctttataaaaagtacagttctactttgtaagcaaagtaaactcctcccagtggagtgcttgtgttccatttatattttaatgttgtttctagaactgttatgtccaccctccttacatgagtattaaaaagttcagcatatgaatatgaataaacacagaacagatttttcccttttcataaggaagtacaactgttttcaaatctttagacttgtcaaattcttgtgaaagtcttttgatttttgcaaagataatacataagattaaaaatatattacaacctaaaagccctgggaaataagttgttccattaggacctgccagtcagaaatggaaggaacaatgagcaggtcagtcatggacaaataatgtgatcacatacatttttcctcaacaagatgtagtacttggtcatacctattatttatgaataaaaataatgtaatatttacttattcattatactaaatacagaattctagaataataagatttcttttagggacaaaatagtatttttggataagaatcctggttttatagtcagcaagataggtttgatcctggctataaaacttggtagctgtcttaacatggatatcagcttcctgtgcctcagtttattcatttggacaagtataataacaattactttgcatgttcataataaaagttaaatgaggtattatcaggtgctcttaacacagtgcttgacaaatgacacacaagaatggtactgcgataatgatcatatcacgttaaaattcagagatcattcccttatatattatcttatggaatactaaaccatattctctgaagtactgagggaatgaggtccatagagaataaattattttcctctttttacacagaaaagtgaaaataattcccagtttcaagttgtttctcctacactacacttcaatgatggaatgatcctttttatttcagagtaaagacgctgaaaacaccttacaagtctgtttttggtctgccaaacattaggtttctatgaattttagctgtatttctcatgtcaaaataagataggtttttctgagatttcctcaggcaatacgtatctggaggtctgcttttcaataaagttctggtaccttctaagtttctagtatgtcttaattttcatgtggaataactaaacgttgggatagagggaaagacaaaggaaaaggaacttaataaaccttcaaattaaatattttcatttcaatttttctccaaggaaactaagtttcaaagaaattaaacaattcagcaaatattacacaactattagtgatgataatggaatttaaaacttaatctttttcagtgtaaagctttggttggttttgttttgtttttgttttgtttttagcttttaagttcaggggtacgtgagcaagtttgtatgtaggtaaactcgtgtcatgggggtttattgtacagattactttgtcacccaggcattaagcctagtgctcattagttatttttcctgttccttttcttcttcctactctcttcccttcagtagaccccgaagtgtgttgttcccctctttgtgtccatatgttttcatcatttagctcccatttataagtgagaacatgaggtatttggttttctgtttctgcgttagttcgctgaggaaaatggcttccagctccattcatatttctgcgaaggacatatcattccttttttgtgattgcacagtattccacaatgtatatgtgccacattttctttatccagtgtactgttggtgggtatttatgttgattccatgtcattcctattgtgaatagtgatgcaatggacataggcatgcatgtgtctttatgataaaacaatttatattcatttgggtatatacccagtaatgggattgctgggtgaaatggtagttctgcttttaggtctctgaggaaatcaccaaactcttttccacaatgattgaacaaatttacactcccaccaccaacaatgtataaacattcctttttcttcacaaccatgccagcatctgttattttttgactttttaataatagccattatgactggtgtgagatggtatctcatagtggttttgatttggatttctctaatgatcagcgatgttgagctttctttcatatgattattgatcatatgatgtattattttgaaaagtgtctgttgatgtcctttgcccacttttaaatggggttgtttggttttgctttaaatttgcttaagtttcttgtagaacttaaggataaatagacctttgacagatgcatagtttgcaaaaattttctcccattctgtaggttgttcactctgatgatagtttcttttgctgtgcataagctcgttagtttaattcaattttgtttgtcgatttttgcttttgttgcaattgcttttgtcatctttgtcatgaaatatttgcccatttatatgtctaggttgttttccagggtttttatagttatgggttttacatttaaggttttaatccatcttgtgttaatttttgtatatggtataataaaatggtccagtttcaatcttctgcatatggcttgccagttatcccagcaatcatttattattaaaggaaagcgtcctttccccattgcttattgttgtcagctttctcaaagatcaggtagttgcaggtatgcagccttatatctgggcaatctgttctgctgcattcatctatgtgtctgtttttgtaccagtatcatgctgttttggttagtgtagcactgtagtatagtttgaagtcaggtagcatgatgtctccagctttgttcttttcccttaggattttgttttttgatacatgctttttgatacattttcacttagaattttgtttttgaccatgagaacaacatgatcacccactgtttaaggctcaatttgtactttgggagaaatagcctcttcatattatataggtgtaacctgaatagactagcatgtatttaattggtaataaataaatattttttgataattatctttatggtttatatttttgaaatttctactgcctcagttataatctgatgggagctatttatgtcactagcttttttgtattaattattttctagattactttttttgaaataaggattcttctaattttttgtttttatttcacatcctactttggacaggatatagactacacagatttcctgatgcaaaaccagcgagagtcattttacctattcatgtcaatcaaccttactagaaaaataaagtgacttcttacctctttagagaaatggattaatctggacaaattaatgcttacaatcactaaattgaaatggccattctcctgtattggttgataagattgcagaaggaaccccttaattaattttttttaatatccaatttagcttccacaagtatacctgaacttaaaagtataaactgaaatagagcttctgagaacaacatggtcatttacccactgtttaagactcaatttgtactttggaagaaatggcatcttcatattgtataggtgtagcctgaatagactagcatgtatttcattggtaataaatagtatggaaaaaataataaaaatttatgttttattgtatttttcataagcattatgattcatgtttttaaacttattaaattttatttcataaaatattacaaatgaaaatattgtcattaagtggatgctccataatttgggccactattttgcaaaataaaacatccatataaacaaagcaatctcactggtaaataactcaatacatgttagaagtctaggagataattaaggagacctcaattattttcttatccttcaaacttaggttttctactgtgaattgtctaataaaacttcaccatcaccatcattgaaaccgttatctctttcttacccacagccctactttcttgtcttccagcagaggtataatttcttttgggcaagccacactgcctagcctcttaaaaatacaatgttcacaacccataccatttacattacacaggttagcacttttatctgaacaaggttaaaactcagataatgagcaaatgttttctgtattttaacccataaaaaaataaacaaaaaccattattggctggtatatccaaaatcaacactcttactttcaaattattccattcacccgcatacttattctcattcatccactttattctgaaatatgcctcagaaaatgacttacatttttcttgcacacttttcatttacatgcttgtttatgggaatttataatggatgaattataattttccctagtttctataaaagaaaaaaaaaacatggatttctcaatattgctaggaagctactaaactctaaatgtaataataaaaaaaaccctcaaaagatgcaaatgcccgttttggctgaacgtggagaacatgaatctgtctagttttgtttgtgtagctattattttgttgctaattttaaaatgggttgcagacattgatttaatcttattgcatcaatagtttttaaaggagggaatataaatcaaagttggcattgtgcatcatgatagaaattaatgtagaaacttgaaaacaatatatttttttcatttgcattaagtgtgctataataatgagaggctgtgctagctcatatggtgtaatcaatcatatgttagtacttggtaatagtatttatcttctccccgcaatcagtggatccagctcagagcagcctttccgtgcaagtattgtcatcccttcagggccctgaagcagatggcttaacactttatttaagttttacaaaagttagaaattcagataggaagacgtgcactgttcagagctgcaagaagcacaatgcttcatatacccttctattgcctgataatatcaaatatgacctttgttgtcttgattgactttactggctttttacttaatttgaatagtgtaagacattattctctgttaatcactgctgagtattacatttaatgagaaagttgttggtttggttttttgttgttttttttttcttttttgacagagttttactcttgtcacccagactggagtacaatggcgcgatcttggctcactgcaacctcttcctcctgggttcaagcgattgtcctgcctcagtctcccaagtagctgggattacagggatgtgccaccacgcctggctaatttttgtatttttagtagaaatggggtttcaccatgttggccaggctggtctcgaactcctgacctcaggtgatctgcccaactcagcctcccaaagtgttgggtttacaggcgtgagccaccgtgcctggccagtttggggggttttgttgttgttttgagatttaaaaagcctatatgtgtaatggatgtttttaattttttctagtttaatgatgaattgaactgctcacttctaagctttcaagtagaaagttgccatcctgcttctcttcctgttggtacatagcctacagttggatttgttccattttttaacatttgcctaattgattcatattaatgttaaattttatggaagcatcaaagggtcatctttgctaaaatatgaaaaatacaaacaaataagaaacaaacaccacatagtagagggcttaatcttaatactaaaatcttctttatttagaattgtttaacattttaaagtattctggtgtctagaattaaaatttcaggtataagtctttagaagatgataaaatcttaccattcattcattaaataaattttgtatttatcaacatttattgaatacctactataagccaaaatatttgttagatgctaagaggtataagaatgggaaaaaggaaactattcctctgaaattgttatttttagtctaaattggcatctgatccaatggattttgagagtcttttcttcccacaatcttattcatttcaacctaaagctgatatactacaaggattcagaaatgattcaattctcctaagagatttcttctgggaaatggctgtttctagatggagttgtatccccagaagatattttagcattccttttttcttcctcggggctttcacagttcaggattcaaccgacattaaattattaaagcaaagtgaataagaatattttgtcggacatattgactttgattcttagtagttttcaagtatctaggtaaattatttttgggaaaaaaggcttccttagcctaaataagtaaaatagaaaagttaagtcgctaaaaaatacttaatcatttgttattgcaatgttaattctacttttatgaatatactcaataaaataaagaatataagaaggaaaataattttataatttgggttctttaaattacttagagctcaggaatactctatatcttttaaaagattaagatatttaatggtgctgggggcttgggagagtgagtgctttattggtaaactagttcttcacatgattattttaaaaaatctgacagtttaaacattttttaaaaaattcagagcattaggataatatagatcctagtacattgtataacattttaatacacaagtttatttctggacttttttccatttaaatggatctctttatagattaaatgatcacttgtctttcagtgtttatataactttgcatctgccactctcgaaatgccccttttgaaatgcgcaagtaaagttccgtaaatataaaatagctgcctaatcaagttttcatatcactgttaaactgtttttgagatcacatgtcaagactaaaattgcaagtgaattttttgagacagattgtctgttagtttctttcagaatgacagattctttcttcccagaaaattactttctcttcccttccccaaataataataggcaaaatacactcaattcaaactgacatttcttcagatatattttagttgtttaggtgcctgagaacttcatctttggaaacctataaaaggtaaccaccccttttccctttttgtgggtttgaaaaatgtcctcttaaaggatttggctcatgatagatgactacatcattccttccagaatcatcaggaaattaaatgctgaaataatgtatctttacagttttaatttctaccattcataaatattaatctaaataattcctgtaaggaaatatgggcatgtataacttcttcagagactgtttcttttgatgacatttataaattcatcctatgagtagagtattatgaatgaagagcttcaagtcttcctgaatctttgtttataaactgagaataaatagcatctgattcagagtatcatctgttagcagaaaatgagataataaagtaattagtattttgcttaacatatagtagatacttattaaatgtgaatttttatccaatatgctgatttgtagttcattatgagtggtgtagatagagatgctgctgtttgataaaatgttgataaatcttagtattgctaaagcaaaaaaaaataccatatacataaaacaacttagttaatgttatgagaaaagtcatacaattttccactgccttcaaatgaaagttcctgtctgtatcatttggaatttaaaaaattggaagacattgaatagcaatattaatattaattaactttaaaagatgtctggttaaaatcaggacttcaaatggagttgacaggataccgtttaatcctactttgtgagtagattacatagaatttaaaagtgacctgctctttgacagacaaagtttttggtggccagtgaaatgacacagactaaaggaaaaagacggcattttaaactgagaaaaaccatttttatggaacattaaggattgattaaatgcccagaaatccaggctattacactagagctagctgatgggaggcatcattttattttcagaaaaatctacacttcataaagatcatatataaaggacgatttttgaatctaacatatgctacaagaataatatgtaattaatctggtaagaaaaaaagaacatttacacctatgaattatctgttttctttcattttttttgtaataatttcttagatcaaacctcagaaatgctcactgcaacccaaaacttattttgtttcccatcttttatttctgttgccgtaaaaattgattgaaaccaatagtatgttaattacaaagacttcattcgttgtaaaggttccaaatgaacactattaagcaccaacttctctagtaaagactaccttaaaactaaaatttattttaatcacttttatcctaattccatttagaatagataaaatttgtttagataaaattaatttagataaagagcactgggtttctctctcatctcatcctgattcagattgtattaaacaacagaatttttcatctattccttaccaagagaaacatacgagttaacatcaacaattctaataaattattagaaaaacttatatatcctcttgctctacttgcctcagttaaaagccaaatttttcattgctaattatgtgtgtgtgtgcatgtgtgtgtgtgtatgtgtgcgtatgtatgcatgcgtatgtgcgtgtgtataactcttacatggcaattaccttcctagatactcaaagtaatagtattaattaataataaactataatagcaacttactttgtgacctttttaaatgttttgaccacacctatgtttctacaatgttcaacattataaattataaacttattgttaataaccatatgtaagacaattgctccatttagcattgtttaggcactaatgtatataatttaaagcatagaaagcaactacaaatgagttgataattttaacaaaaatatgttgctttcatttagatatgcactaagcattaaaaccaatatattacagtaacagaatccctaacatttacagataacaactcataataggtttgtgttttgtgactgtattaaagtatctctaattcttccacctcttatcttataggaaataaacgatgtggacgtacaggaacttgtaagaaggtcaattggaaggttaacgattattcggcagacatttccagttccccagaacataagtcagcggtgtttccgtggcaaccatcgaatatcttcaacattgtgtgatccaaaggatccatttgctcagaatatggaggtatattataaatgacaggatatttcttccagggtgctttgttgggcaattgcaaggagagctttatgagttgcattggattcagaattatacgtgttatttctgaacaattctcctccagcaatttcataagtctaatggggagaaagtgctaagaatttgcgtctttgttctttttgatctcattatagaaaaatttctacttgcttaataaaaaaatataataagtaaaggttattttcttctaaacaagtaggtccataacatttcccacaggagaatttgtaattggtactcctttttccaaactctaaattattaaactaataaatgtgcttgacttttctggcctaagaaggacatagatatttattctttttaaaaagattggtctccagtttgaataactccaacaaaaaaaattagatatgaaaaaagtgctgtagaattgtatggtcatatccaactccgagaggatatagctgaaaccttcagcatccagaatacaacaaagaatttgaaagatataaataaaacctctgaacagcgaaacagagaacaccaagtccctgtagcttactcataagaatgccctttaaatacttacttgaagcctatttctttttcttaagaaaaagcctctgtggtttttttttcactttgctctggagatctcaatatgtcaatctgaagggggtgttacacaaagcaggcacacaggacaacagcagggagccttaaggagccctcttaagcaagagacgggaaaaaaatcaatcagataaactaactcatataacctgtcagtataggactcttcctgcaaaaacaaatctgtgccataaaacaactcctaaaggtatcactgcagtataatgctagcatataagttaatatttaaacaataaccctgagatattagcaaatattaaagtcatggccaatcttagaagtaagcaaaacctaatatattttagaaacttgttctttaaaatatttaccataggaaacattttagtacttagagattttcagttttaacagtttggaaatataaccctaggaaaactagttcctctctaataatactagataaataaggtgcttttgcaaaactaatctgaaaaataaccccacaacctccctatccttagtcacctttgaatttttaaaaaaggatttgccatttatccaaccatttcttctaattactatcactgtagtacgtggactggctccaggatcattaccctgtaactttctgttgcctactagattttaagctcctttagaataggtcctttccatggccaggtgcagtggctacacctacaatcccagcaatctgggaggtcaagggggagaatcacttgaacccagaagtttgagaccagcctgggcagcatggcaaaaccccatctctgaaaaaaataataataataattagccaggtgtggtggtatcctcctgtagtcccagctactcaggaggctgaggtgggagaatcacctgagccctagaggtcgaggctgcagtgagccaagattgtgctactgcactccagcctccagcctgggtttcaaagtgagtccctatttcaaaataaatagatatgtcccttcaagaacccagcatcataagtactcataacgtgcttctctaccatttcctccatcataattaccacagtgctttggatctgtgtgaatatatatgtttgaatgtaattaaggagaaggcaatagtcaaagtaaatcttctgaagccttaacaacatctctttaaatttcagttccacccttatctatatgtgtattagttcattctcacactgccataaagtacagggaagaggtttaatttactcacagttcctcagggcagggaagcctcaggaaacttacattcatggtgaaaggggaagcaaacatgtccttcctcacatcgcagcaggtaagacaagtgctgagcaaaaggtggaaaagccgcttataaaaccatcagatcttgtgaaaactcactactatcatgagaatagcaaacggataatcatccccatcatttgatgacctcccaccaggtccctcttatgatacatgggaattatgggaactacaattcaagatgagatttggattgggacacagccaaaccatatcaatatgcttataatgtcccatgtttgcattttaactggtcatggatataattgatgtgaaaatgatagaattctaaatagaaaaaaaggaaagaattttgatttagaaaattataaaatattaaaagttgtgtttgttaaaagaagtatcaggaaatgaaatacaaacttaagaaaaattattgactgtgtcatttagggacagcagaaattattttacagcatatttgcctaacaacataatctttccatttcagttgatgaggacttcaatatctgtgaacaaatattttatttatgtctatattcctaatcttacctgaaacaataaagtatggggaagcaccaacttcctcctgactcataccttcatcttggtcctgtcaaacccacagatggaagaaaacaagaaaactacttttgcgttgaggatttgttacatgtgaacatccctcttatgtatgatagaatttgatctctagactgttacctattttaatatacatagacagagaagtaaaatttagaaaaaacagaaaatgcatttcacaaattttttaattagtgtccaaagactgaaacccaggattagcttaagttgcaaaataaatattaaagaacaccttttagctagaaaatggtgtttttgcaacatatgtaacaagcaggaagtgatccatttactgcttagtggaactaatgttagtttggctgctaatggagagaaaacagaaacattctaatacttttgctcctttctccatctaagaaaaattgtcttcaaattgggaaggttagagtaaaattcattaaaagaaaatattccactggttcagaaggagcagggagatagcaagagtaggggcactgctttgaattaggcttgccaaataattgctcagagtagccaatcagccagcaggaacgatcaaaatatgatagctcagaaatactggagaaacacttaggaagaggaccaaggtacaagagattggtgtattgtcccaattactgaaaggaaggaaaaaagattctcatggagtttagcatattaaatgttactatgtagataaactgtagaatatattattaaatcaatggtttggagtacctcagataagacaacagggcttccttaaaaacaaacactgccaaactaagcctttatttatatatatatatatttttttagattgggagaatgtcataaatctatgtgttacatgttgatttttatgtggtgtttgacaaatttttacctgaaatccttaggaaagatattgaaaagtcttgacagagtgatgacactgaaacattttcaccaaagggttcctaaaggcagaagatagtgaacactctggcctcagacagaaagcaaaataaagctcaaaaatatttaagtctcattattacctttaaaagttataacatttgtgtatatacaattaaaagtaatacttcaaattatttgccaattaaactagttgtttttctccaaatattcaaacaaaattgatatctaaataaatcaatcaaatcttcaagcaatattgatatgactagaatatgccttagatgtattcggtggctttgagtacttcctgatatccacaacctaccaccagggtttcttttgtccagagtttgaggattgtagaaccagatgaatattcaaactgcagtgataaacattctattcctgaaatgcaaggaactgtctatggtcattcacaagattctattcttggacctaatatttttaaaacgtctatcactacgtgaatgaagatgaataaaacatgcctatcaaatttgtaaatggcataaagctagaagagaaagcttatgttgtattagataatcaagttccaaattgttagtgttgactgaataataagcctaaatttgaaaaagcacagataaagtataggttcaaaatcaattacatgaagaatcctggtttgacagctgttcagatcccttaagttgaaggtaaattcagtgtgtgtatcacacaaatcatatttgctgtaactattttaatataatcgtggtctctatgtcagaagaattttgctaagataaagagatctaatgtcttacactattctctcctagtcagatcacatctgtaataatgtgtcaattctggatactaaatttttaacagaaacattgaaacacaagagaaagacagagaaagagaactaagatgatcagcctagaaacgataccaggtgatgaaaactaaaagaaagatatctcaaagcaagccacagatggtgtcaaatattgaaagcttgtcatgtagaggaggtgagtgtggagatttggtgatgtcaaagaataagtgtagtgccagtaaggtagggagaaatgattggtcatatgtgacatactggagtctatgattttagaggtgatgtatgtttctgtccagtaaatggtcatttgtgttggttgaggcctaagtagaagtgaagatcatctgtacagaaattgaagtgaccttttaaaatgatgagagatagtttggtattattgtgaaggaggagtcaaaggccttacaaataaaataaaattaccaaaagatcagttaatgatgacagaaaaaagcaataaagtgtagcataggaaagagtgtgaagctcaaagaatgggcacttgcctgcaaaagaaaaagtgtcagattaggaggggtaatgaaaagctcagggaatattaccaccacttcttgatcctgcagtttggaatgtggacaaatgaggagacgtagtcatttattgaaaatgcctgtcatgtaacaggtacgaagcactcacctttaagactagcatagatgctcaaaatacatgcctcacggtctgcaaaagagaatgtgccccagcagtgtcaggtttggatagaacccaggttaccagatttttcgtgtctcaacgtctgccaaacacacctagctttaaaattgactttctttttttctcctctctccatccttcgtcttcttttacttcacaactgtttatcaaaacccaaatatgtgcgaggctctaggctaagtcttagagaaataaattacggggaaaaatggaagagaaaagatgtacagtatgagtccccatccaggaggaatttatttttttgtggaaaaggtagatttaaaaaagaatttagtattctgatatgtttcaaagacgtatgcactgtgtgttccggtagatgaaaagaggtgctcaaccttgtgtaggataaggaaagaaaatcagaagttggcagggtaggattctcctagcatgtaagctttgaaccaaatattgagaaatgttaactagttggagaaaggtaaggagatagtgagggatgctaccccaacaatcttttttttaaatatatatatatatatatttttattatactttcagttctagggtacatgtgcacaatgtgcaggtttgttacatacgtaaacatgtgccatgttggtgtgctgcacccattaacttgtcatttacattaggtatatcttctaatgctatccctcacccctcccccaaccccacaacaggccccggtgtgtgatgttccccatcctgtgtccaggtgttctcattgttcaattcccacctatgagtgagaacatgcggtgtttggttttttgtccttgtgatagtttgctgagaatgatggtttccagcttcatccatgtccctaaaaaggacatgaactcatcattttttatggctacataatattccatggtgtatatgtgccacattttctaaagacacatgcacacgtatgtttattgcggcactactcacaatagcaaagacttggaaccaacccaaatgtccatcaatgataccccaacaatcttaaatacacgttcaccaaagggaagagtaaaataaagctagaaaagtaaaaggaagcaagtttcaggcagtagaaccaggaggggttaggaaaggccagaaggttgtgtattattttgatttccctgggcatgtatccttcatgtaacttctatattttcctgttgggtctttactgcctaattccaacctgaatgttgattcatggactagttttagctgtatagcagacttcagccattcttttgtagtctatctagtaattatcaggcaaaatggggagtggctgggatagggagtgaaaatagccagtcctaatacttccttatgaaggacaaacttgtattgcacgtaatgcattgagtgttcaatgtctcttcaaaaaaggcctacaagtattatacatataaaatgatatttaacaaacacaaaggattgaagatttacatggtatgtaaaagaaaactcacaaggcactgttaggaagttcttattaaaagctgtgcattgcatcagactctaattatctcaatagccaaagcttagtaccatcctgtgatgtgggtagactattttaaaaatttcctccatgattaattataacccgaggacaatccatatagtctcctgtatgtttttaggaaaaaccgtgataacaatatactttcaaaaatctgaaaaacacaaatgctttaagatggaattaattttcatcactacattgattcctcattttttttattttatatagagtttttccttcagaggaaatataacatgaagcagcttttattgacctaggattccttttggtattatgttttccaaaaaatttttaacttctttgaaaaataagcacctttggtgattaattgacagtataaatagtagttctggtgaaacttaattgtaagaatacagtaaaaccttagcaaaaaattggctataatttatttttcaatctatgtagaaagaagttaataacatggttgtttcagaagaagaaagtattaatgtaaacacacattcacaaacagttaatagtttatggtatttgtgaaatcaatgaattgtaatgcatgtgtatacctgtataattttgtatagatccttgatcactataatacatataaaagattgtgttctttcattatttcatttaagaatctccatatacacaaaaatacacacagtagactacttcttttttaggtacctatgacattcatatatgaaatcaagttgatatttttccatctgaataactagaatgcaaaaacttaacatattcagaaaatgtattattcagtttgcccttccaatcttaaacccttagattcttacctcctcagagagaaataagggccaatgattttctaaggtctaacactaacagccttatctctgtcgaaatttctttctttccttttttaatcttctctttcacacctaaataagctgaaaaagcaattgaggcatacaatcagacaagacttcattctcaatgacaaaattgcccaggaaatgacaaaagaaaccttctgcttaataacccagtaaaccagccatgtatgacatgaacagaagcagttgagacaattattttttttccttattcctgatgactggtgtcaatgattctaatgatcactttctaatgtcttttcagatttccaacctttacatatatgacacggtgcttctgcttgctaatgcttttcataagaagctggaggaccgaaagtggcacagcatggcaagtctgtcatgtatcagaaagaactcaaagccctggcagggtgggcgctccatgttggagaccatcaagaaggtaacttcttaattttcatgtaaaaaggatatggtaaataattatttgacatattttagaaaaagggtttcctctttaatatttctacaaattctaagcacaaaacagtgtaatggggaaattaaatattgaaaaagaaaaaaggtgagagagtcatcaacatataaaaaggggaggcttccttatttatttataagggagttttaagcaagtaaaaaaaattgtggttgagatatacccacttgactatgtcattagcattagagatactgaaattgttttggtgcctgtcgcaaaatacaaaaggcttttaaaaaaacacacgccatccactaaaaaaattaacagtagacttaattagcactttttcagttagataatatacatggtaagacactggatgtgatggcctttaatttatctcatgataaggataggattcataagtagataatatgttgcagcatttgtgaactatttggggtaactgattgcattattcctcttcactgtccatgtgttgcttattccagctgtgaatctgtttggcttagctacctgttccattcccagaaggcagtttatgttgtttagctcctctcagtggtataagcattctgcagtttattagactctttgtcatgtcatccttcttgacattttccatttgtcttgtaccgcctcttggatttaaaatgaaatgattaataaaacaaacaaattctcctataccctttacacaaaggagacagacatttggaagtttatattctgtattttacccatcctttttctttctgcatgtattttcctttctttcctgaaacccaaagaaaaatagctagtcaattgaaatataaatgcccttaaaaagtcagagtaaaatataaaactttaatattagaagtgaactaggtgtacaaaaactagaagtagaggaaataaatattttaaatagagaatagcctggatctttctcttggtacttgtatcagtcccttttctgctgttctaactgattaccacaaattgggaaatatataaaaaatggaagttttttggcttatgattctcaaggctgggaagtccaagaccatggcacccacatctggagagggtcatctcatggcagaagagcatcacatgctgagcagctgcacaagatagagcgaaaaagggggccaagacttcctggataactaatccactcccattatatgggcattaatctatttacgaggtggcatcctcatgatctaatcacctcaatgtccctatccttaataccattgcaatagcaattaagtttcaatgtgagtttaggaggggacactaaaatcatagtattccatcctttgacccccaatattcacgtcccgctcacatataaaatatattcattctatccctatagttccaaaagttttaacttgtttcagcattaactcaaaagtccacatttcagagtcttatttaaatcagatatggaagagactcacatgattcatcatgacgcaaatttctgccagctgtgaaactatgaattcaaaactgattatctacttccaaaatgcaatggtgggacagtcataggatagacatttctattccaaaacagagaaataggcaagaaaagaacaataactggtcctaagtaagtctaaaacccaacacgaaaaataatattaagtcataaagccgagaaacaatatccttttacaccatgtcctcatttctggatacgctgagacagggattgggcccgcaaggcctcaggcaaccctgctcccagggctttgctggacccagcttctgcagctttcacaggttagagtcacatgctgttttagtcctacagttctgtggtcttagggatggtcccacttccatagctccagtagtcattgccctagtggaaactctttgtggcaagtccaaacccacatttttactcaacattgtcttagtacgggctctctgtggtggtttgaccctggagacaagtctctgcctgagtcttcatgctctttgtgacatccttggaaactttagtggaggaatccatagccagagttcttacactgtatgcctgaaggtgtaacaccatattgatgataccacagcttactacttgcactctgcagaatgacagcccaagctttacctgggtccacttgagccacaactagggcaggtgaagaatgttacactggaataaggggagaagagttgctaggtggccctggacagggagcccatgatgagtgccttgggcatatcccctgaaatcattttgccttccgagagactgtgagggcagcagcagcttcaaagacttttgaaattccttttaaatctttctcctattgtcctgataaatagcacatcgctcctttgtagccatgttaatatctttagcaaatagtacttgactgcacccttgatattctctcctgaatattatatatatataattttttttgacagtctcgcacaggctggagtgcagtggtgcaatctcagctcactacagcctctgcctcccgggttcaagtgattctccagccccagcctcctgagtagctgggactacagccacatgccaccacacctggctaattttttgtatttttagtagagacggggtttcatcatgttggccaggccgttcttgatctcctgacctcatgatctgcctgcctcagcctcccaaagtgctaggattacaggtgtgagccaccatgcctgtccctgaacataggttttcactctttacatagccaccctgtaagtttttcagattttttgtctgcttctgtctttaatataaaatctatctttaagtcgtttatttttctcacatcttattatgttatgtacaggtaaaagtagccaggcagaagcctgaatgctctgctgtttagaaatttcttcaaccagatattctagttcattgcccctaagttctgaattctacaaagtcctagaatatggccacaattcagccagggtgtttgttactttacagcaaggatggctttcaatccagtttccaataccctattactcatttctgtctgagacctcaccagaatgtccttttctctccgtatttttatgagtattctggtcacaacaaattaaataaactcttaagaagattcagactttctctacagctctcctcttccaagtcctcactagaattgttcttaaagctctattcacagcagtacagtttttttgctagtctgatccttcaaattcttcaagcctctacctttatgcagttccaaagtcacttccacatattcaggtatttattataacaacagctccacttattggtaccagttttctctcttgatttgtcttctgctgctagaataccatggacttcgtagtttattaagaacagaaatttatttggcacacagttctggaactgggaaatccaagggcttggagctggcatctgataagggttatcctaggtgaaaggacaccacatggcaagcaagcgcatgagacagagacaaaaaggggaccaaactcttgtgacaattaacccattatagttattaatgcaataacagcattaatccgttcatgaaggcaaaactctcatgatctatttatctcttaaagtttctacttctcaataccattacaatggcaattgcatttcaagatgagttttggtggggatttcaaaccatagtaatgctgtgtcttctttgccaaggataattttaatgagaattttggctgttatcaacaaaagtacttgagaattaaatgtattgaatatattggcagagaaagacttttcaactgaaaaatgaataagtctaatctagcctcaaggtgttgccaaaatcttccagccttatctatgtagagagctggcaggtataaatccaagggaggttgttgaacatgattctaatcctgccaatttattaattcatggtttggctaggatgcaggatcctgaatatatttcttcttctgaagctttcataccaagacaaaataatagtttaggaggttgcttagaaaacactttagtgagaggatcaggaggaaggaaagagagacaccataatatgtcagtatttttcatgtagaaattcaatatgtaagatattgctgttagaaaatttataaccaaaacaattatttaatacaataattatgaaattttattttgtgggactatgtgtacatttgtccctgtcagcttctgccccagtgtcacattttaaagaaatatatccattctttgtgtcaagaaactcagtttgaataatgtacatgattacaaatgttcaattttatatttttgtctcacatttcaaactgactttaaaaatggatttttagaaaaaaaaattggattactttttgcatcatatgagtgtttttggtcacctatttagatgtcaatgctggtgatactccacacattaagtgagaaagaaagttcattactcacatagagactcccaagaagagcagaatggccccagacagattcaggctggtttggacaaaacagagggagtggcctgggcctttttgttgactaggggttagggctggcaaaaggttcccactcatgcgggctggagatttgagaagctcaagtttcctacaggtgtcaaataagtagatgtaggatggcctttcttaatcagactgtacagatgtggggccaaagaaagggagggtaaggcttaaaaagaagtcagcagccagcaacacaaatgaggtcaggctctttattatgatgggaatattctagtgttgaaatttttaattacattcaaataaatacaaaatgcctatattaagggcacgctacatacacattaaaaatccgtgtgctgctgcacaaagtacaagcaagaagagaacaagtttctctccctaaattaatttctattcttattatggggaatgaaacaaaagaattaaaaataatgtcattgacatagtagtataaatgtctagtaatgggcaaggtttctgtttctcaggtactcttgtgtacctgagctttataatatatgaatcggtagaataagtgcctcctcattttcattctttttttaaaaattagcagttaatgcttgcctgtttattcctgccaaatattatcagcagccctgtgccattgttatttacgtggatgttgtatgatatttttgaaggaattatagttttaaaaatattgagtctttccatctataacatggcatctatccatatagttagctttttgtaatcctgattaaagatttatagtgttcttcacacatattttcattctatttatttctaaactttaataggatgtgtgtgtatgcgtgtgtgtgtgtgtgtgtgtgtgcatgctatcataaatgagatatgttccattagattttcaaactggttattgtaggtattaaaggaagatattgatgtttcatatattttttgactgacctgatcaactttccaaacttaattactggttctcttgtatttttcaaatatacattgatatcactgtcaaataaaattaatcactccaattctaatactttacgtattggcatagacttaaaaagcagcatgcaacaagtatactcttaaacataccaggagcattatctgaaaagaggatttttaaaaattttgtaaagaaagtattcttctatttttgttttattatattatgtaattaagttgtttttattagtaacttgtacagttatagagtagcaagtcacaataaagttaatctaacctttttattctatttttaggtgtacagaaccgaaattcagaaaaattaaatgatgtactaagtgttgcgtagctaattagttttaaataccaggttttttggtttctaatttggtgtctgtgtactttaccatttaccatttttcttgttcatggcaatcatttttattcactcctgtcaaagtcacttggctaaacatgcacaccaagaaatcatgggaataaacaccctcaattaatattatataaaccctatttaagttttaatatggcttgtttttcagtctttagtttattatgacaagttacattgttgtagcttctcatgaaaactatatttatatattgggaaagagttttcatgtagtataatttaatttgttagtgttatgtaacctagagcaagctttcaaactttttaactatataaatataatcaataaatttgagctgttctggaaaaaagtaggagaggatttccagagacacccaccacaatcagctcttagagctacaatttgaaaaccactcccctggggtatttataaatcaatttgcccagtgcagatctaccttcttggaatagtgccatgtcattgcaacacgagtagcctgtttttatttacagaagtgtactatatttaaatagaaatcatttttcatttttttcttagtgttaatatttttaatactgaaacaattttcaacagggcacttcattcatgtattaatcactcttttaacaggtatttatcaaatttctatattgtagaatgtactgtgcaaactcatttatggaattaccccgcaccccctgccaaaaaaaaaaaaaaaagaaatttagaggccagtagtgaatattgactaactatacaaagagctacactctaaggccagaaacaacaaaaagacccaaatgtggtaaatataggatactgtagaatcttagagaagagtgtaatgtgctgtggtacatactgagatacttgcttcacagccaagaaagacatctgagcctctgttcaggaattgccatggacgggaattgttccaccctctttctaggggcagcatgaatccaatgaacagtcattgcaaaactagaaatgtctaagttcatttcttcaggggacaaatatgaagggttatctacagactagtacgttggatgatctaaactggtattgtatttgcatcaaactttcatctcttcctctgtccagtccctcttccctcactccattgcaagtgctctctcagtagcacttcaaataaaccttctgcatacaagcaaatctccatctcatacctgtttccttgagaacccaacttagaaaatagattagaaatatttgcatggaactgatagcatcttaatggaaatttcaaaactagcaggcttaggatatataaagctatggaaggaggatatttcaggtggtagaatgctgtagctgatatatctattagactaaatcatttgtacaatgacaagagttgattaccagagtgcagagaacacataaaattgttttgactggaaagtgatttaggaaaaaaattattttgtgggtaaatgtaagacactaaataatttttggataaaatcagacctgaattttagaacacctttacctcttttatttaattttttaaaagctaagaaaaatcttagattcaaaattatgtgattgcacataaaatcactggacattttctatgtattctatattagtaagtgaactaaaatgtaatagatgtttaaatcaaattcttttgcattgtcttaattgaccaatttctgttaaaatttttgtaattatttttaatatggaatgtgggaaaatagaaaatatcagtttatgcaatatgtcaaatatttaagtaccagtacattttcttatattgatatatgttgagcccaacatatatcaatatgatatctgatagagttatcttgatatatgtattctatattagtaagtgaactaaattgtaatagatctttaaatcaaattcttttgcattgtcttaattgaccaatttctgttaaaatttatgtaattatttttaatatggaatgtgggaaaatagaaaatatcagtttatgcaatatgtcaaatatttaagtaccagtacattttcttatattgatatatgttgagcccaacatatatcaatatgatatctcatagagttatcttgatatatgttgatatctcaaaaagtattttttgaaatgataaaaatattgaaattataccatttcttacatggtaatttattcattcaacaaatatttattgaatactaccatatgttgtaccataagatcagagaataaggaaggaaaatagaaatatcaaaaataattacaagcatgatttgttctacaaaaggagaaataccaagtgttctagaaatatgtcattggagggcctacttaggcctgagagtgatagataagtggaaacgtttaggctaagtatgcattagccaagaaaggaaaatgaagagtattccaggaaaggggaaggaagaatgcctcatgcaaatgaaatagaatgtttctaggcttgtaggaaagagagcttaacacattgaagcacctgaaataagcccaaggcagccagaatagagacatggcttctaattagctaaaagggggaaagaccatcaagggtttgataaacgatgttgaaatttccaaattttattcaaggaataacgtgacactgaaggattattattattattattattatttttttttttattttttattttttgagatggagtctcgctgtgtcattcaggctggggtacagtggtgtgatctcagctcactgcaacctctgcctcctgggttcaagtgattcttctgcttcagcctcctgagtagctgggattacaggcgcgcaccaccacacctggctaatttttgtatttttagtagagacagggtttcaccatgttgggcagagtggtctcgaactcctgacctcaggtgatccatctgtcttggccttccaaagtgctggaattacaggtgtgagccaccacacccagccgacactgaggtattttaaacagggtggtgataaaatcagattatcccatgcttgccaagtagagaattctgcaactgccattgaaccagactgactgcatgacagaacaccaattaagaggctaatcttcttacttagagaggacctggttaggttgtgggccatgggatggatagaagtagatatccttgaggatatttacaggattgaaataagatttggtgatttaataagtgtgtgaggaagacaaagattaaaataatgattcctaggttaatggttgggacaaaatgaactctaataagttgtcatgtttggttttgtggccttttaaaacgtctgcatacttagagaaatggagacattactttttgtttaaagcactatgtatcatttagaatttacaaatctgaaggaaagagagagaatttaggaaaacataatctggcttaccacaaacagtattgtcttgaaatataaggtagcctttttacaaaaatgtgtgcaaataaactttttgtcatggggatttaaaaactgtcatccatgctctcggtataggcctcttgtcaattcaccaagatacactccagcttcaggtcattttgatcataaagtaggtaaactggaatagatttaatttaattcagttcaacatgcccttctgagcaattctctatatataatatgttatattgaacacacagtttacatagtccaaaggaaaaaatacgagacacaagatgaaggtttcagtttgggctcctcagttaaccggttgacttagggcctaagggtcccctaagatggagacagcatgatcacaatgcttgtaacttcctgtttacttctcagctggctgtgagtctctattatgaatgactatttgagtgtatatgtatatatgcaaatatatgtatatatacacacacgtaatgttacatggcaactcaaattttcctagatatttcacacaaactagattctttgtatttgtcgtcctcttttttttttttttgcatcttgtatcttagtttctatttacccataaaaatatttgtttgttgggtagaaaatgtggtatttttctggttaggggtttttctctctgaacctgatgctgatgaaacatgaaggcatcagggctccctgctgagtctggcacctcccagagtattcactgccttgctgggcccatgcttatattaacagattatccttggttaccacacacatctgcaggttacaaggaacctagaaatatgtataaggaaattagacgagtatgataaatatttgatgtcccacgtgatcctccaaaagtatctcttaagttcctttgccatttcaagcgtaggaaaagatccttcatcataaacagaatgacataaagtctcagtaattttttttttactttttccccaacttttcctagccataggtgaataatacattttgccttttagaaactcattatccagtggtaaattattctcaacctctgattctcttcttttaatttttctactctttgctctctatatttgatgtccactggtatttctatatcaagtggatggatgaaattaaaacaaattttatttcatattttttaaaaaggtttactctggcagcaatttttactgccaatttaaaggacgtttagaaattatctgtatgtgttattcatactaccaatgtcccattagcttatattgttgaaaatctgctgcatcaccaagagataaaaaataccaccatgcatgcacaaaaataatgaccattcattaccccttggctagcacacattttcaccaaggctctgttttcaaggttaatttgaggatagatggaaaaaagctttaaagcgctggaattttctaaggcaatccaaaatcagagaggttaagtctgggtgatataacaataggttttagttaaagggtttatttgctcgaaatactgacctctgaatcatccctgacatcttcatgagggaaggtttcactgattttacatgccaacggctcattaggaatatagcataaggaagataaatcacaaagtcataaagttgagcaaggtaagtaaatgctgcagcaaactaaatgcaagtcccccaatttattgttttctgtaccttcttcaagtaaactaagtcattcagtggaagataaagtaaaggataaaggcatgacctggagtggtcatgtgggtattgattgaaaataataacacaacaccagattagtctagtgctcaaatgtgtaaacattttagggatatagtagttttatgtagcaattatattgatatatgatatctttttcgtataaataagctactaaaacataaatttaagattctgatataattagaagatattaatcaggtagatgtgtgattatgaacaagaaaaacttgtataaaaatattctgaacacaagtttttgaacttacttgtagtaatataagctatatttgtcaatcaaattcctacagtatttgtcatttggagatactaatgataataagatgcactgcacttacttcagtctttaaaatataattggatgttttgagatattaacagtgagcacataccggaatagattggcaagaatcaggtatattgcccttatcaaaaatacaagcaatcaaagggaacaaaggagaaaaaggaggagacattctgcatggctccccaggttctttcttcccacactggaaatgctgattcggtctccaaggaaggtttcataggtttatttctcaccacagggaggatttacattatgaaacatttccatttttacccgagaaaatgtaaagcttcaggacattttctgaggagccacaaaccattaatccatagatcctgggtttatttactacagtattttttagcctgggatatcctgctaagggctttgtatagataaggaatcttccacctagtaaatattaccagtctgtttacctggagttccaattggcagggaaattagaccaaccttcaccctcagttgctgccctatacacacaccagtgaaaggagtgaatacatcctagaccagctgcttaacttttttctcttcaagtactaatcaatgaaatgtaactgagttgacatttgcaaaaatattttccaaagccatctaaatatttaagcgtataataatttttggcaaacccactgaattttaattaacaaaacaagattatgccaacgatttctaagagaactaaaaatccttcaaaaataaagaattaagtaacagtggaagtaatgatgataatagtatttaagctcttaccacatgtcaagaacttttcaatattctgtacatgtattataagaatcagaataatcttctggggtaggcactattattttcccatttaacagatctagtgtttgaggcataaatgaaatggcttagcctggtttacacatctagtagatcccgaagccattggtgaaacccaggaagtgtgacctatgttcttgactgctaaatcatgcatgaaaatccactaggatttttattaataaaactagataatagaaactggctgattagggaataatagtaaagaattaattttgttgattattactattataaaaatacaatagattaaatattaaaattagtgattcaggtaggaaaacatcaatcaaaaatagtttattgaactcatcatgaactttgcatcaggtgattgggctacaaggcacaaatgaagtagaaggaaaagcaaatagcataatattactaccagccagaaaagactggaaacggagttgcaggttatgtcaagtgagatatatttaaatatcaacatcttagaggtgataattaaaacaatttacaaaactgagatcatttgttttctaaataaatgtcattaccaggccaaaattttaagttagacatattttagcattgaagtgactcagagtgcgattttcatttgtaaaatcctaaataatatgaagactgataaactaaactgagaaaagaatgataaacaagaaagagagaagtatgacctacattgccatctgttggataaatgaacatctgtcatattgaatgaaagatgaagcttggaattcccagagaatctcaacagccagcactacccgttaagagcaaaaacagatttcaagcctaatttaactttcttttatttttgatttggaaaatatatttaaagaaggggcaaaaaaatcaccctctaataatctagaaaccatggattttaagatccccaggtataattttagaccaaattgaatggaattgtgctagaacaaagaagattgttgaaatctatcttatatagattttatgcactccagaagcatcttgttttcaagatggatccattcaagtcacaaggtatggtggcaaaaacttgagcctggaacttagtctgagctctaacatggtttcattttgagcagtcacttgacttttggggtctaaatttctgtttttatgaaaaatggatgagattggattaaggaatttccaaagttaggttcaactgtactcctgtttatgctgtgtacctattttaaaaagtagtctgttaaaaattgcttactttaaatattattttatagatagaagtagagttcctagaagttccttttatgtttatttatttatttttttacttctcaaattttacatcagtatctgttctctcctttagggtggagttagtgggttgactggagagctagaatttggagaaaatggaggcaatcccaatgtccactttgaaatccttggaaccaactatggagaagagcttggcagaggtgttcgaaaagtaagacaagacacactgattaatacgctttttcctatactatggttttgcttgattgttttccatgcagtatgatcacagtacccattaaagtcaatattgtagtgtgaaagagaaagcagggggtgaggggaaattaggcattgaaatgactttaaatatttaccagaagtattaagcaagaaattctatttccgacttagaataatgtaaaggaaaaaagtaatctgaatcttacctagggaaatagcatcatctttcatttgttacaataatagtttttataaaatagtaaatttaatatttatacactttgtagctgcttggtttttaacttgtaacatgtacaaaatcagaataagagcttggataaatttcatatagtaagacagaaagtctactgcaagatgtgacattacagtattttaccttctgtatgtgtcatgtaatatgtagaaaatagtttgcagaaaatgaactcttgttggatactactgatcacatgtaagaagaagctgagtgccaataatgatgtttcatgaaatactgggacaataactttctcaaggagaaatacaaacgcccttatataaatgatgtttctataattcggatttgctatatataaatttttgatatatatatcaaatatatatatatttatagcatttgatatatataatatatatatatatagcaaatccaaattatatatatacacatatacacacacacacatatagatatatttggtagggaaataaatcatatatatatcatataaatatatcaaatcatatgtatatatacacacacatatatatatgatttggatttgctatctatctatctatgtatctgtctatctatctatctatctatatttggtagggaaaaacctaacataattgtgtacgcagagctggtaactgtaaatttctaactgtctaaagttgatgacatttagggtaacaggttcttcagtaggtatttttagtgctgagatgtaagatgcaaaacaacctagacaaaatgaagtgaggagtaattagcaatacaaatttctcaataaattcatgctaatatggatgaaactatcttgatgcatttaaaatttttgttttatagtgaataatatgaaacatatagaaaactgcataaaacacaaagtttagtgaattattttaaaggaaagaaccactactgtggtcaagaaatagaaaatagccaggattctcaaccctcccatatgcttctctctgattaccgtcagaccatccttgtcaatagtgtaatatttagactgatttttacgatgttaatttatttgcatttaaaatatgtttttatcacctgtgtttacatccttatataattgttttgtcaatgtttcaacttatgaatggtctcaagaatgcgtatatccttttcttcttgcttcttgtgttcaacagtgtgtttatgttattgatccttgttgttacatggagtggcagtttattcatttatattgctgtattgttttctattgtatggatttgtcccacaccactgcagtttgtttccatttttagactgctataagctgctgttacaaaaattcttggatatacatcttggatacttttatgcttgtaggtgtatttctgtaggttttgtatccagaagtagaactgcctgcaatataagaaaccatatcttgaactttaccagataacatcaaacccattttcatagtaatttactaatttacataccaccagcagtgcaggcattgccccacattctaatcaagtcttgaatttgtaagacttaaaattttattaacttattgggtggatataatgatatatcctcatgatttcaatttacatttccctgattatgaaacagtctgcaccttttcctacatatttaggctcttcaggtgtttctgagttaattgctcattattttttttttggagaagggtgtcttttgctttttataattgattttagaagttatgtatatattctgaattttagtgttttatcatttaatttttgccagttttgttttcttctctgtggattttatttcaatgccatttatagtatctttaaatttagaggaactatgaattttcatccttattattattgctgtttagtattatctaagaaattactccctatcccccagagtcatgaatatattatgctcaattatgttccaagggttttacagttctgccttccaaattaaggtcttttatctatctagaagttttttttttatatatatacggggtaagaaaaaggtaaaattttactcttcaatactcttcatttgttttattgagatataatttaagtgcacaatgacttagagtagtcgcattcaccaatttaaccactaaccaggtcaagttattgaatgtttctgtcactcagaaagtgccattattcctgtttttattattagaagcacagacagtttgcttggcctgaaagtttatataaatggataaggtagtatttacacatttgtgtctttcttctctcaacatttaaggtacattcttattttcatgtgtcaataattttgcttgtttgtcttttaatttatattgctgagtggtattatagtctataaatataatatggtatcttctaaatgtcattttctgtttgctgctgtatatacaaatgatattttatattgattttatatctagcactcttgctcagacttttaattctgataattcaactgtagattcttgtgaattttctgcaaattgtcttgtcatttgcaattaataagagtttttgcctcttcttttgttattttacaccttctagggatgatgttgaatggaaataacagtagtaggcatttttggatcgttatcaatctcggagagaaaacattcaccactataccactatactactatatatttataactaacttagatcagattaaggaaactccatacgttcctgggatatgcataattttatataaaattgcttatacatatgtaaaattataattatgcttatgtttacataaaattatttgatttgctaccaccttgcataagggttttatattgatacttatgactgaggttgcctaaagctgtcctttctgttggattttgaaattaaggtatgctggcctaacttaaatgagttagcaacaaggcaaagcatccagaaccatgtctagtacatcacaagaagttgtggttaattttcattaataactgaaatttcagtagaggggtaatgccatatgtttaaatagcaacagtagaaaagtaaaaaaaaaaaaaaagtgagtatgtttgggtagtaattaaatgactttgtgaagttgttgggagagattttttacaatgtaagagatttgagtatatttgaatgctcacagaccaagccagtagtgaagaagaaaatgaagatataagaaagaaaggtgataattgatagcgatacagtaggggaaaagagaggattggatcaagaattagatggagtacttaaccataggcaccggggaacatcattttccagggtgataaggggtaggggtaagaaaagaatgctgtgtttgcaagcaagtctttatgtttgatgttaggaagttaagaaaattattaataaattgtctttgcttggagaaataggaggcaagattatcttctaattgggaaaatgcagcagaaggcattggcaataatgagactggaggtttaacaacagtggagaagtttcgaaatagctgctgtggcaaacaagagaggtgactagggaatattgaagaaatgccagggagggctattggctcacatgaggctagagatcaagaaatcactgtagtactaatctacacagttgtggatgtttgtccagcagcattgagcagactgaataaatttaaattaatgtaggcttgaagcttcatcgggttatttttgttttgtattgtgttgctttgtgtttgatagcagtacaacaaggcagtatggttaagaacattggcaaggcaatggttgaagtgacaaagcataaaatctaaactgaacatgaatggcaatgaagaaaggaagagtataacagagacaaagtatggctcgagaggttagtgtgtgttcagcacatctgaagagcttgtatattagtatggattaagtgagagagcttcagagccagaaattatgtttggggagagagagaactgaattcattatcctaaggctgggtaggttctaggcactcatcaagggatgtttgtgagggtggcagaggagagcttcatttagccttctaaaaccagtgtcatttaacggagttctgaggtcaatatagttgtttcaacctgctctgaattcagagtttgtaattgttaaatctctgctattaaaatgatagtgaatcatacacattagattacatctactttgtccttaagtaataactcctgtaattatttcattttttatgttcctatgtcccaactcccaaactgtattgaaatgttctgtgagctggcactatagaggtattatgaaaggcactataaatatttattccatggtaccttgtatacctttgacacttgaaattttttttgcattgttttacaaatttaagcattcttaattttgaaattttcatttttataactcaattatttttctactaagctgcaatttaattactaatttttttaaaactccagatctaacactcaagtaattttaaaagtattatggattaattcatagcttgccagctcattttataaatggggcagttcctttgtataggtattaacccatataataatgctttcaaagatacttatgaaaggaaaataacaccacgcaaacaattgcaatatagatttactagatgtgtgtccaaaatgaaggttccactcccagtttctccatgtctcaaaaggagtgaatggtttttcagttgacggactgtcaagttgtcagtgtttattctgctgccagtggctcagtgtatacaaagactgcagccttatcacctcaagcaggggtattgtcaggtctcataaactaaacagagttttgtctgctcaggatttgaatgtgtgatgtaccaaggattcataatcccaaattttggactagtctttgctctcttggcattgtatgaatgatggtttcatttttttgagtttggtgagaatgtggaagggattatttgattctcactgatgttcatctaaattaaggactttcttactttgataatttttacatgttcttctattttgtcataaggtggtacttatttagcagatggtatatcaacatgttagcacattgtatatacccttgaagataaattcaggtaaaactcaaagtcaaattttgaaatcgctaaggttttctatacccttaaattttgcccaagaatgtggttatttctgtttctgttagtcactatatagaatttctaaaaaaaaaattaatttgagcaaaagttattataagaagacataaaaagtaaagattaaataactctacgtttaaggaatcaatatatgtttttcattagaagagttttacataatgttgtttgcttatttgtctcatttttgttaagtttgccagtgctgctcacatattattgcagactgaattccagtattaaaatgtaatactctagacttagtgtctttgaactttatcacaaacggaataaggctaggaaaagctgattaaagctggtttcacaaccaatcttaattgcatagtaatgcttaatatcttcataaaagtgttttctcataagttggtaaaataaaatgtacgtcagagatattttacctcctaggtacagtggtttctcagatatacttagaatctttattcgggctctccagctttaaattcacaaagtctacaactttgtgttcttgggcaaacctaatgtactgcttcgcaaaggatattatattatataatctattaattaatagattatataatctattaattaatagattatataatctattaattaatagattatataatctattatatattaattaatagattatataatctattatatattaattaatagattatataatctattatatattaattaatagattatataatctattatatattaattaatagattatgtaatctattaaaaatacaccaatttttaatggactaaaatctttaattgctttgtacttataaggaggagagaacagctctgctttcaaatagccagtgattaaatattgcacttgtattcagcattttatttgtattctgattctggaatatctaaaatgacatttatcttttggtattaccctgttttatgttttcttaaagcactttttgcaaactgatattatatcagtctttgtaatataaaacccagttgtaatttgagcccataattggaaaatctgccatagttatttactgtcatagttctaacaatgaattcatgtcttggaaggtttatataatagagagaatctagaaaatattgtgaattgacaatataattatacatataactcttctatgtgtatatgtaaatataattaacttactcttttataatttgtctttcccattacaatgttacttcatgagacaagaactatgtttgttttctgttgtattcctaatgaatggcatataatagatgcttgttaagtatttaatgaatgaactaatgaatacatgtgcatactgatgtaagaatccataagattcttctctgcatctgtaagtttagcagccttgtttttcttctatttacatgaaacataattatttgcatttaaattaaccagaatgttagtgggtgttacactctttatcctcaattcctatcagagttgggcacttgatcaccaaaagtataaacaataattttaatggttaagcaagatatatgtataatttgtttgcaagaatttgttgtgaatagggaaatagtgagtacttaaattgattattccaagcaaaatggaaatacccataaaagtacaagtttattcggaccattagtatttgtacttttaagattattgtctcacagcgagactagatttaacaggctgtagtggaaaaacgtgtagcctttgctgttagacatacctgggttgaaattctgcctctgtcacttactgattgtttgatctttggacttcaaagcaaattgagtttcaagttctataatatgtgaatgtaacacatgtaacatgtgaatagtaatacttatctctcaggatttttgtaaggattaattgaaattatgtttgtaggttacacaataagggaaaattaaaataatacctgttcagaaatatacaggaattaacagaattcattttcaacccaacacaagaactacaaagtctagttgctattctgacaagaagctgctatgtgaggtggtgaaagtaacttgattttagatgtggttgacagaggattatacatgacagtcacagtgatagcatgaaacactaacttttttgtttcatttaatgtcctttatggctccaaaattctacaagtctgttaatcaaggcttggaaactataatatctacagttgtatggaaatctaataacagaaaatctgatggtaaacatagcctgcataaacccagtctttatagtttaagcccataattggaaaatctgccatcttcaattactgtcctagttccagcaatgaattgtgtcttggaaggtttatataatagagagaatctagaaaatattatgaagtagggcctggcatggtggctcacacctgtaatcccatcactttgggaggccgaagcaggtggatcacgaggtcaggagatcgagatcatcctggctaacacagtgaaacctcgcctctactaaaaatacaaaaaattagctgggtgtggtggcgggcacctgcaatcccagctactcgggaggctgaggcaggagaatggcgtgaacctgggaggcagagcttgcagtgagccgagattgggccattgcactccagcttgggtgacaatgcaagactccttctcaaaaaaaaaaaaagaaaaaaagaaaagaaaatattatgaagtaatagtatgttgtgaacacaatagcttttatttctttatcccattctcctttatttataatatataatcattatacatttagctccatcagcttttattctgatgtgtcttcaagaaaatagcttgtaccataaagtcatgagatggatatgcagtctaatactttctaacattaccattgagttagactctcaaaatcattgatcccagcagtctcttgatgggtaggggaaccctgcactcttgaaaagtatattctgtggaccaaattgtttcagcttcttagggagcctatctgatttcactgcagagtagagaaaataacccgtatctgctgatgtttagggttactctgagtttctggaagggttagcagctggttggttgagatcacttctggaggagttctacctcaggtaagcagcattcactgcctcttggagagaatgggagctatctcttctggtggttgggatcatgccaacctctccagtgtggagcaaagatgactgatggggtacaattctgtgtccaagtcttggtgaaaataggaacgacttttctagaaggactataaaatctgaactgtttgcttgttgtgatggttaattttatgtgtcaccttgactgggctaaggggtcccaagatagctggtaaaacattatttctggatctgtctataaggtattcccagaagagattagcattttaattggcgtactgggtaaagattacctcacccatacggataggcatcatccaatctgttggggaactgaatagaacaaaaaggcagagaaagggtaagtttgctccctgtttaagatgggaaattcatgttctcttgcgctcagacatgggcactcctggttctcaggccttcagactccagctgggaattgcaccatcagccccccagttctcgggccttacacccagactgggactgacatcattggctctcttgtttcttaggcccttgggtttagactgaaactataccacccacttttctggttctctagtttccagatagctaatcttggaacttcttagcctccgtaattatgtgagccaatctctcatatcaaatctctgtatatggcatatatttatatttaaatatatatttatatatacatatattcccctggagaaccctgacaataccttggtatgatatcttaccacgtttgagggaagagctaattgtgaggaatttagctactattggcatccatactctcagagaacattcacagacatgaatatgctcataaagagaccgagatagtctgtggtgtcatctgtagtccacatgcttaggattagttgggttaggagttcaagactgtgtctgatacagaggaggcaaagtttagtttccttcccactctactagagagcatcaacagtggggcacactggaatctgtgtcactccaatatctaacagatacacacacacacacacaccagtgaagctccagtccagctcaaattcaacaatatgatgtggtggtacttaacatccactgaacaacctaattcctagtttcagccactagtggtaactaatgttcaggacccagtactatggtaataattattaaaagaacttatattaggaattcacagaattaagaagcatttgctcatatgggtactcctttagcaagatctcattgtcatgatttaattttaagtgacagatagtgaaggtttatttcacagaaattgcacaagtgggcagacagtgataggagagactcaaagagtaagccattcacccatatgtgttggaagcctaccacagacaaatttattacatgacaacactcatgatatgataggttctgttgaaccaaaattccaggggcttttcattacacctcaaattttctgctttctctgctctctaaatttctctgtagtctgagagaaagatatatatatcttgttctctcaggcctatctggacgcctcaaggggattacacattctcttttagcagtaactaggttttatataatttaaatttgaatagttttgagcattaatttcacaaaaagtgctaatagaagtttcatagttcatttatttggcaggggggtgactctcattcaaactaatgaatattatgtccatgtgagtaatgcataattggaattgtaataatggctttaggttactgatgcttgtattgcctcctatgtctgttttttccagtaattttattttccttcttaatcaggacacctgacccattggagctatttagacatcactaagacattagtcctaattaagctattctgtagtgactgaaaattgattgatacttgttcctttgtttttggtacaaactatggtattaaggaaaacttttttgaaactttgggttggctgggatgcttactctttcccattttaagaattctgctttcagttttctgcatatggctagccagttttcccaaaatcatttattaaatagggaatcctttcaccattgcttgtttttgtcagatttgtcaaagattagatgactgtagttgtgtggtgctatttctgaggcctctgttctgttcaattggtctatatgtctgttttgttagcagtaccatgctgttttggttactgtaaactggtagtatagtttgaagtcaggtagcaagatgcctccagctttgttcttttggcttaggattgtcttggctatatgggctcttttttggttccatatgaaaattaaagtagtttttgttctaattctgtgaagaaagctaatggtagcttgatggggatagcaatgaatctataaattattttgggcagcatggccaacttcatgatatcgattattcctatccatgagcatggaatgtttttccatttgtttgtgtcctctcttatttccttcagcagtggtttgtagttctccttgaagaggtccttcacatcccttgtaagttgtattcctaatatccagagtcaaaaaggaacttaaacaaatttacaagaaaaataaacaaccccatcaaaaagtgggcaaaggatatgagcagacactgctcaaaagaagacatttatgcagccaacaaacatatgaaaaaaagctcattatcactggtcattaaaaaaagcaaatcaaaaccacaacgagataccatctcatgcccgttagaatggtgattattaaaaagtcaggaaaaaacggatgctggagaggatatggagaaataggaatgcttttacactgttggtgggagtgtaaattagttcaaccattctggaagacaatgtggtgattcctcaaggatatagaaccagaaataccatttgacccagcaatcccattactgggtatatacccaaaggattgtaaatcattctactataaagacacatgcacacatatttttattgcagcactgttcacaatagcaaagatttggaactagcccaaatgtccatcaatgatagactggataaagaaaatgtggcacataaacaccatgcaatactatgcagccataaaaaaggatgagttcacgtcctttgtagggacacggatgaagctggaaaccatcattctaagcaaactaacgcaggaacagaaaaccaaacactgcatgttctcactcataagtgggagttgaacaatgagaacacaaggacacagggaggggaacatcacacactggggcctgtcagagggtggggtgctgtgtgggggatagcattaggggaaatacctaatgtagatgataggttaatgggtgcagcaaaccaccgtggcatgtgtatacctatgtaacaaacctgcaagttctgcacatgtatcccagaacttaaagcataaaaaaaataataattctgctattgatttgggtactgtttactccaaggttttcttcttgacaaaaaaaaagtggtatattacaaaaaaacaagtaacacatattgttgccattccagagagcaaaacttttctactgaaatcattacatatatatatatatattttatatatttatatattttatatattatatatatataaaatgtgcatgcgtatatatgtttacatgtatatgtgcatatatataatgttatatatatatttatatatatataaaaaaagtgtgcatgcatgtatatatatacatagaaagagagagaaaggctgtgccaaaaccagaaacattctgtttgaaaactggccttcattttaaaaagtataaagtctattaaaacatggttgtgagtggatagtctgtttcttgttatagtcctggtttttgaggggaggttattcaaatgtgcagtatttttactaggaccttaaacacataccccctgttaatgtaaagatgtccttatttacctgatggcaaatatttctgaaaattgagaatgtccccctttagtcatgcctttctttcacaatatgtgaaactctgtgaccttgcattcaagaaacattatttctagctatggaaaatgaatggaataacatttattttctccttgttagttggatagttctgtatttaaatgtttcatatttaaaattatctgtgtattgtttatcagaagtgtgcaagtaatttagaccttgatgatgagtaatattttgcctgtgatttgaagtagctcctctctagcactagcactctgattatttctctctaatataacctcacatgcacaaaaatttttgaagctctatttttttaaatggcaaaaattgatttatttccagatatgatctataacactaggttataaaattcattttaagcagagcttattttaagcaaaactgtatcatgttgaattaatttgtaaccatatttgtaaatattccaattttttaaactttaaagttcaggagtacatgtgcagggtgtgcagatttgttacataggtaaacatgtcatgagggtttgttgtacagattattttatcactcaggtattgagactagtatccattagttatttttcttgatcttctttttcctcccacccaccaccctccacttccaggctccagtatgtgtcgttcccctctatgaatacacgtggttctcatcatttagctcccacttataaatgagaacatgcagtatttggttttctgttcttggattagtatgctaaggataatggcctccttccatgtccctggaaaggatatgatcttgttcttttttatgactgcataatattccattgtgtatatgtaccacatgggcatttaggttgattccatgtccttgctattgtgaatagtgctgcagtgaacacaagtgtgcatgtctttaaaatagagcaatttatattcctttgagtatgtaactagtattgggattgctgggtttagtggtatttcagtctttaggactttcaggaattgccacactgtcttccacaatctgatcccatttgtcaatttttgcttttgctgcaattgcttttggtcttcatcatgaaatctttgcccgtgcctatgttctgaatggtattgcctagcttttcttctagggtttttagagtttggggttttacatttaattattgaatccatcttgggttgatttttgtatatggtataaggaagggatccagtttcaatttcctgcatatggctagccagttatttcagcaccttttattgaatagggaatccttcattttttttttttttttttggttaggtttgtcaaagatcagatcgttgtaggtatatggtcttatttctaggttctctattctgttgcattggtctatgtatctgttcttgtacaagtaccatgctgtttttattactgtagtcctgttgtatagttcaaagtcaggtaacatgatgcccccagctttgttcttttagcttaggattgtcttgaccatttggctcttctttggttccataaaaattttaaaatagtttttcctatttctctgaagaatgtcaatggtagtttaatggaaatagcattcaatctgtaaattactttgggcagtatgaccattataatgacattcattctttctatccatgagcatggaatgtttttccatttatttgtgtcatctctgatttccttgagcagcgttttgtagccctccttgtagagatcgttcacttcccttgttagctgtattcctaggtattttattctttttgtggcaattgcaaatgggagttcatttgtgatttggctcttggcttgactgttggtatataggaaatattccaatgttagattagaataaaaaattctgaagaaactttatagtgtggcaattttacatataataataaaactcaggccggacgaagtggtttacgcctgtaatcccagcactttgggaggctgaggcaggcagatcacgaggtcaggagatcgagaccatcctggctaacacggtgaaaccccgtctctactaaaaatacaaaaaaaaaaaaattagctgggtgtggtggcgggtgcctgtagtcccagctactcaggaggctgaggcaggagaatggcgtgaacccgggaggtggagcttgcagtgagctgagatagcgccactgcactccaacctgagagacagggtgagactctgtctaaaaaaacaaaacaaaacaaaaaactcagttcttaccataaccaaaattatttttaatttatgaaatgtgtcttcaaattatctcctttggtgaaagtttgaaactaaggactctgaaaaagaacatttaaaaattatagatttactagttctaattttaaaaattaatattagatcgttttaaataaaatttattgctacttagattttaattataattaatgtaaaataatgtacagttaaagatttccacaatatcaaaaaggttttaacaaaacatgaatgtccacattgttcctaatccaaaattagtaaccatgttgaaatccaaagatttactaagcattaaataagtatataaataactgaagaagtaatacagactaaaaaacaaacaacaaacaaattaatccatgtctgtagtttccgtaagagcataagtgaacacacacataaaatctcaaattctatcaaaatttctgtcaaattccaaataattctgaaggaccctttttcaaggtgatatttaaatatttttattccaaaataaggccttatttttaagatgcatagtattactatcaattattatgttcatgacacttaaggttgtcgatataggttccccgagtgttactatttctctacttcttttccctctgattttgttgaagctacaaatattttgaggacctgttattctgattttaaattgtcagcatttcttctagagtgttaaatgtctttctagtaaattctctatagatttaataaataatctaccaaagttatatagaaagctgagtttttatagagttcttttcaataagataaatgtttggagatggagatgctctttttgagtaattagagtcacttttattaatcatagtaattcaggtgcaaaaaatggcttttacttactggtagtgaattttgatttttaaaaattcaataaatacacttttcagggttattaaatcctgttataatagtaaaataatatttctggattttgaaaaataatcaaaagtgagaaatgaatctcatttttaacataattccacaaacagcttggattaatataggttgtgctttgaaatgtttaactagtaaaatgaatgcatctagctgagtataatcaccctgagtaagtcacttgatgctcatgaagagaaaaccacttatccactgaaaacttttccaagcaattcttaatcagaaactatggggagttttattgctctggagtacctgaatcaaagtagttttgtggttttaaatggaattgtatttgaaatgctttgcttgagaatttcttcttttgattctttcaaggttgttatgaatctatatcccaaaatgagatgagaaatctatcagtgacaggcttatgcattttagaatgtctgattatagccatttggagctgtaatatgatttgaataagtgcactttcattaaataagagacagtcttttttaggattgtgggggaaattgcatatttctttctctcatgtaaagtgttacgtttatgtatacttttttcttccaaggcaaattggaaattggataattattcttgggacaaacaaagtaattacaatgcaggggttgggttgtcattccaacgtgatttttatttattgaaagtcatgaaataagatttgtttcaccttcttttcctttccgtggttgtcacattctcagtcttttacaaacaaacaaagaaattcaggcctcctaaatgctatttattttctagctgttggtgttagataacctaattatacaatagtctcttccagatattttctttttcttatagcttatagctctcgtgttagctgtatctactttaaaaaataaatacgtgaacattttattcattcatatacatactaatgtttttccaagtaggcattattttttctgatgaatgcgaaacatttctgaaggaccatacattaagaaaaaaattagcaatcatttggtgaaacatctctatcttacatatatatagtgcctaagttttgtgggttgaatggctttcttaaaaaaacctttagtttgttaaaagactagacttctagttaggtatcttttccatagacttgtcttctcccaattccaaaacctttacttattagtgataaatagtaaaggagaaaacgtttttgttttgtttttgtttttcatgtgtttgctatgatgtggattggtttgtccccacaaaaactcatgtttaaatttgatcctcagggtggggatgtgtttggttcatgtgagtggaccttttatgaatagattaatgccttctcactggaataagtgagttctcactctcggaaggctggattaattctcatgggaatgggttagttcttgtgcgaaggggttattataaagccaacaccttgggtcttgtctctttggacatgtctacttcccctttgaacttctgccatgttgtgacacagcatgaaagccctcaccagaaaagatgaaggtgctggtgtcatgcttcttgaacttcccagactaaggaactatgagctaaatagacctttattccttataaattacccagtctcaggtatcctattagagccccacaaaatggactaagacacactgtaagtacagacaatctctatataattacagttttatagttatgttatagtttattgaagtccaagaaaaaatctattttaaaaaaccttacttataaaaattgctcacatttttctataaggtaaatcaattctttcatgcttttctcttgaaaaccctgattgctgaaatacaaaataatttttggctacacttcttcctattcttttgactttctcctacaatattttatgtaatatttaacttttagcctttttttcactgtccacatttttgatggtagaagtaatattcccgttcattttttcaaggctttccttttctttttttgaatggcaaccatgttttaacttactgaggacttcatattcagttttatcttattgttgctaacagaaatatattttgattgaaaatacattggtgcactagagagtgaattgtaattttggacgaagtattttcaaaattatgttatttagacaaataatcataagtagggttttttagcgaaagtgtgatttttaatttttggtttttttttttggtcacaatgtagtcacacaaaaatatgatggggctgttatatcaatccccttttccaagaagccatttgggtgaatcatggcatagcaaggttagacctatattgaggaacaaaagtcacaggttgcttcaagatcatatagcatcatccaaaggttttgagtacttactattggtaatctttttataaagaaaatatgatagatagatagaaatagagataatataaatatgatagatgatatggatatagacatcatccacttgagaaaagaaagataaataaatgtaaaaggcaatatagaccaaatacattctatattactaatatgtactgcgagggaaaagggtcaaatatttttgaattgagttattctgtacagtgtgctatagttttgtgacagacatacaaaacaatttgaaactgcttgggtcttatgcataagtagtgacatagcaggagataccaaaatctaaagttattcaaaacattagaggattgtgacatacttttatgttggctgtatagttttattaaagcatctaatttaatattatttgcttattttttgatgcacgtgggacaaaaaagaaatagcagtaatagcaggagagaagcaagaaatctaacaacttaacgtttaagtcaataataagtagaaaaagaaaaatgaagctcattccgaatgatctgaaacacagaaaatgacatatatgtagtgcctagcattctaatcttgtttatctgatttacttaataatatcagcaatagaaattgcctgcaaatataagagatatccaagaaatgaacagaaattttgattgtttgatactgtagcttggttatagcaatttaaagatcattgaggtagatgaatgatgtagccctgttacattgtaaagagtgatgcatttcacttcagtgcaatgacattgggtttaagataccattcagtagaaaatgaaaaccaaaaatttattgattagtctacagatagtgattttttaaagaaatggcataatttaagaaacattttaatcattttccttatacagactattaactttacaaatattgagattgtttctatagatagaagacatttaagcctacaagtaataaactgaaaatatatttctcttatcttcaagaattctgttaatattaaccatttatcaaaaagaagtatcataaataaaatattccaatgcattttgtatttttaatgttaaaatgtcaaataccttcctttaattttgacagcattttatgaattatctttctcatataatataatgaaaatatactttttgaaagatagcatgatgtgtgagtgccctacttggtaatatctatttattatttcctgatttcctaatttattcctacttcagcaacgcataggaataaaatataattttattcactgcttattgctgaataaaggatttaccacataaaaatattttatttttatagaattattacctctggatataaaatatgtatatatacatatacacacaatatgtgtgtgtatatatatatatatatatatacacacacacacacacacacacacacacaatactggtaatactaatatacacaatactggtaatactaatacaacacacaatactggtaatactataatcaattgcagaccatacattaaaaaattttattctcatggaagcatgtaattcttgattaaaaagatatagttttgttgtgtttgaataattaagttttcagcattaataaaagagcagtgaatgtgccttaactaacaaaaataaattggatggaaataaaagacaaacttttcacttgcaataaggaaaaaaaatgacaatgataaaaactagcaaagatatttaagtttgggtgaaatagaataaaaaattttagtggaccataatgtcagagaagtagtgttacctctcccaaaaagctaatgaaaattactgaaatcattaagaaaattatattggaggacaaactcatgaaagaattaaagttatatcaatattactttcatgtatataatgacagacacatggaaaaaatggaggtgttttatattatttcaaagacatgttttgaaaaaaagactcagagttgtaaagagacaaatgtggctttatgcattactcctttagtgcattatgataagatttgaaaagcagcaggatggtgcttatcttgacccaaaatatccataaggtgctaaatagtttgttattagttatgcagtgccataactaatattaaatgacagcttttaaaataatctgaacctgaaggattgtcatttaaagctataattaaccactacaactaatgcatggatttatttattgatctattctttctataaacaacatgaaagtaattaacaaacacaactactgcaagattcatttattatcctctcttttccataaacagaatgaaagaatcagaccacagggctctactgggaaaatctggccccaggtgaggaatattaataaggactgatgtgctgactagagtaccactgaggcagcgaagtcaggaaaatgagtcttcacagaaagggaaaaaagattaaagaaaaaaaagtattatagagatgctttgcctatttttcccttttgctttaagttgatcttggtgacattctcagagtgtaaatatttgctcaattaatcctgtgtgaatagatgaaaaaaatgcatgatgataggacaagtacctaggagacaagttggttggccttacaaggattgccctacagcaccatgcagaattaagatcccaaactgtgaagggatttaacttgtcactagaatatcatttaatggtattgctgtaaatacacagctccatatcaatcatagttaggcacttacaatcccggagtatccagtctttgaatagttagttttccagaacccaaagaaatcaatattccttttcaaaatagtctcgactgtgttcattaccttgattttttaaaatgatttcacaggtgcatatatatgtcaaatcttaccaaatgataggctttttacatacatgaaatttatactgtcaataatttaataaagagattttcaaagccaagtgcacagctaattaagtaaataaataaaatagcattgatcatcaggatttatatttttatttttatgcaaagcctttgactattcagttattttttaatatattttaccccatatttcacaagaaatgtgaatgtaacggttacatgtaaagttcaaaaactatgttttttcaattcattttataaagaaggttaggctaaatagcccttttaaacatacatatcatcattcaccttggttttaagttgtttttcttgactatctgaagatggctatacttaatattgtctaagtgatagggggcatgtgttaaaaatatgtacatttctactgcctttgctattagtaaagcacacttaaatgagtaagaagagagagaattttttaaacatagcttattgcccatgtgatattaaaatttggttttctctcttagttttcatgggaagacttaggtaaattagtattttacgtaggaggtatgtacaaaaactgtgtccgctattaaattattctaccttgaattgtgattttattacatataatgcatgcttattttggaagtgtgttataaaaaccattgatactttgccctactggagaggatgattcttactagcattctgataaactgtaaatccatggagtttatcacaaaagcaattttacattattttggaaacaaaatttcctatatagtttaaattatttttgattctatatgttatctttataagaaaaaataataaagtttcttaatgtcaaattttaataatcaaaatacatctattaggcacattgcgtacatttttaaaagccaagtaaaccctgtagtaaatataaaaaaaaatattaaaataacaagataaatattatatatttatttatttatttgttagaagttggacacttaaaagggtgacagcctttgcatacgactacattaaaacaatttaagttaatttaagtaaaggaaagaggcattcaagcatcaactgttatttatactcaaattatctgacagctttatgttgtgacatttggtctttgcaaaacactcaaaatataagtcattgctctgtaacctcacagtcagctttatattatggtagtcatgaatgccagtttgtacccaacgttcataaatcctactgcctttttcaacaggccaatcacaggatgatcatagggtttctgattcacttatagtgaatttaggtgaaatggaatataaaccaatttctctgaaatcatctaactataaagttgtgataaaagagacatggtgtggcaagaattatactgcagagatctttattacattcaatggttgacatcctgggctggtcctaattaaaacattggcctgtagaagccaaaagtaacttccaaggcctaacaagcacatcattctgtggcctatggcattcattcttgagagtaaggaataatcagtagtagaatgggcatcctcttcatcatagttccctgggactgagggttagatgtgcatgatatagtatacctataatgaatcaacaaacatagatctttctccaactttagttcaactaaaagtcacttttgacacatgttaaaaaaaaacatcaatactcaagctcggttcccagagattataattgagggcttttcgaaaggagctcaaaaatctgtgtttttaacaagcagtatctgtagttccaccacactttacgaaagtgctttataggaaacttgcaaagtatagggaattaggaactgtcaaaagacatacaatgtgatccttgcacctaagtggcttacagcctctttgtgggacaagtcatgtacacaatctaactcagtattagtgacaggttcttacaagtgccacattacaggttgtgagttctagatgaaatcctataattaagcactcactcaggctggaattgccagggaaaccaggaaataatagaggaaagggtaaagaaaatttcaagtggaatgacctgtatatacagaatagagagatgcgtgggcctggcatatttaagaggataactcttggatagatgcttgaataaactgatataatagattgaacaatatattataaagagaggagtatatattgtattaacagaggaatttgtataggagtatgtattcctgtagtggaggattttgagaaactctaaagatgtagctgactaaccatctagccgtctatttaatctagggtttggcaaactttttctgtaaatattttaggctttgtgggccatgtatgtctcttttgcatattcttccttgtttatgttttctgtatatatgtatgtatgcatgttacatatatatatatgtattttaattttttaaatatgtgaaagaattcttcactcaaatactgaaccaaaataggctcaagggccaaaccatagtttactgacccctgatcttatccgtccagcttctggcttcttccacaaagggtttaaagaaacttggagaaataaaatatgtatattataaatattaaatgtataataaaaaattagcaagtaaaaaaagtcaatacctaataagggaaaactaacaaaaatatcagttactatatttgagcttaagaatttggtttcaggctttcagaaacccagtcaaaaatttgaccagttacttaggtcttatatattagggcaataagacaagccagtctcccttcttagcattcctttctaaagcagtgcctcacataggacttcactctcttcaacagcttctgtaaaccaaatgcaaataagcctgttttgaaataattttttgatgaaagctgagaacgtaaaccataaatgcccagggaggcagttatgaagaatattaaggattgtggcccaaatatggagtcttcagtttctaggctgattcaagaagaaaacataaaatatgaattggatatttgtcaaatcattatatacatatattttccactttgatttacagggaattttaaatcaattgcttctttttgtctaattatataaacttacctacttcttatgcaaaacttggaaaagaaaaagaaaaatcattcgtaatcttactactttgaataaaattcctgttgatattttgatgatttcctcttattttacatacgttttataactctataaatgtattttaatgttatcatttaacttacgcaaatattccaataactcttcattttttggccttttccatttttgcccttttaagtgttggaataaatgcaataaatagatttctaaaaaaaatgaaatcgctatactaaagtctgtagcattctaaagtatttaaatgttatttctgtttactattaaatttttttttccgttttactctttcaccagaagttatgaaagtgcctatttacaaaaatgtaactccttgttccacttatcactactaaggagttacattgctgtaaacttttgataactataggaaaaaaatagtgccagtttccatttctgttattactagtaccaaataattcatttttctcttttatttctaattatgcatatttttctctcatttatattttaaaagcctagtatttttaatcaatttttcgagatctttccatgccaaggattttaatcttttgtcatattttttaatcatgtttatctaatggatgatttactttttagatttattttgttttgacttagaaaaagtagtaatttcaatacagtcaaatcactttccttatgatttcttctactgacttctaaagaatgaagccgttactcagcaagatatcagactcataccatctgcttcctccatcccccattgtgtggtttgaatatttacaattatcttttcaatccatctgagatttttttttgtatggcattctataaagaattaagtggacattttttccaaaataattgaataattttctatatatggaaaaatatatccttctcattgatttatgatgccttaaattatgtattatattttaagtatgcttaaaatcttagtatattatatttgaattaaatagatgacttgctttcatctttgtttcacaatatagttcatttggcttataattagtggatcatcttgacagagtctaggtgactgatggtcttatttttaatttgcagattttcattttcttgtcattctttaggggttagagtgggtaatttgaaaagacatgtcagaaataactacttagttagaaacctttgtgaaaagccaaaagttttatccttcgaaagcaggctactactggtcagtggcaatgactctacatcattatagagaaatatgcttatcttaattgctatgaaatgggagcatagaagtcaactgaaagcagtttcaagtcattgaaatgaatttgtttgttttagggcagttcagaaaagagttgcattttgcatagcttgaaattatcatctgatctctgatgaccattcttgctgaacttgtcttttgcaatgctattaacacacaggttatattcaggcagctaattgtagggcttctatgttgaactcaagtttagtgcagactttttgtccagaaattcaaaaacctagcagtactcattgacacgtgcaaagaatatgttatttttggcttatttataactttgaccacatacaatattgaaagcagtttctctaattattcttcattaatgattgcactaagaatccaacaggtaatttataagcaaaggaatggttttgtcatttcaaggaagatgacttctttattttacttaaattatagtatgagtttttccaggtaaggtcacagcaaaattacagttaccaaggtgacaataattagaccccttgaagttttaaacaatggcaaaataatcttaattattgtttcaatgtaagctttccagcaaaacaagctatttgaggatagatttttaaactttagactgaaaatctcttgggtatgtgaaatccaaagcacttacacgaagacatgggaaacctgggaaaaataagctccatggatgacttttggtttctgtgttcctacaatttctcttctcctgaggacataatttcagtgcctaggtttaatctcattattggtcctgagtcccccacaaggagttatgtttgagttttgaatgatatatatatatatatcatttgaattatatatatatatcatttgaatgatatatatatatatataaatatatataatatatatttattttttgagatggagtcctgctctattgccaggctggagtgcagtggcacaatctcagctcactgcaacctctgcctcccagattcaagtgatactcttgcctcagcctctcaagtaactgggactacaggtgcccgccaccatgcctggctaatttttgtatttttagtagagacggggtttcaccattttggccaggatggtctcgatctcttgacctcatgatctgcccacctcagcctcccaaagtgcggggattacaggcatgagccaccgcgcctggcctaatgttataatttttttataaaattaaaattgcatacgtaactggtagtcttttcaggattctattttggtttttttccctcatgaaactatttaaagctcatttgtcaaatcaggaactggaaagataaggtgtacatttacctgcagttgagacataaaaaatctgttttaaaaccaaaaaatgttttaaaatatttataacaattggaggcaggtgctgtcttttacttacaagatttaggaaagcttctctccatttaattctttacttcctaatctcatcaatctaaccaagttgtggacattctgaagagccaccttatcaaatgagtggaaaatgattaatttagaaactatagtaaatccttacttaaggtcattgctgggttcttggaaaccgccacttcaaaggaaattacatataataaaaccaactttcccataggctaattgatataaacaagagctaagttcttagggcatatttctggtcagagaaacattaccaaacttctaaataaagacccagaacaattctaacatgaaacattgaaataaatgtgacctatgcatacttttaagaaagataaataaaaacaagtaaggtaattatttactcaattttggtgaattagtgagtgacagtgattgtggtggtgagtccactgaaggaataaaggtttacaaagcgaaaatcttaaggagcaccccttcccaccatgcagttcaaaatcaaacaatgaaaaatatggcagactagaggagagctttagtaccccatcatttcttgttgcatttgtaggattattatctcctttaagaatttttattttacaatcatttgtattcattcatttattttccaaccagcttattctagttcagggttttgggtggctggagcctatccctgcagctcagggagcaaggtgggaactgactctaataggacactattccatcacagggcacacacactcctacacactcactcagacggggatcattcagacatgtcaattcatgtaatgtgcacatctttgggatgtggaaggaaacgaatattcagagaaaacccatgagagaagtacatgtacactccaaacagacagtggctctggccagaaattattttttttctcatcaacattataataaaacaacattgaacaaaacaattttattcgaggacctactgtatactaaactatatttcatagaaggctaattaaaatgtagtctgtaacactgtttgctaaaggagagaaaaacagcactataatccctagacctactctataagccacctgtgttgttttatatattcagaacataactactattatttttacacacacacacatccacctgttcaccactcccctcccacacacacatacacacacagcccaaaaggttgagtgtatgacccaagctagaccagccaatcatggcatcccacacgaaccccatcaattggcccagtaatgaacatgtcacttgtatttttagtagagacggggtttcaccacattgaccaggctggtctcgaactcctgacctcaggtgatccacccacctcagcctcccaaagtgctgggattacaggtgtattatcaactggaatccttttccagggtttttataagggaaacttgttaaaaggggatctctttcctcttgagtctaggctttatgaatgaaagcccagaagtacgtgtagtgttgggttttggagataaccagactggtagaataaagtcaatgagaaggtgagtggcatagaaagattacaaatactgttcgaattcttggaccgtgtactcatcacgtaatttctcatttctcacccctctcccaccctcccacccttctgatctccagtgtctattattccacactctatttccatgtatacatgttatttagtgtccacttgtgagaacatgtggtatctgacattctgcttctgagctgtttcacttatgataatggcttccagtttcatccatgttgctgcaacaatcatgattttattctttttatgggtggatagtgttccattgaatagtacacacatttcttttttttttttaattttattattttttttattattatactttaagttttagggtacatgtgcacattgtgcaggttagttacatatgtatacatgtgccatgctggtgcgctgcacccactaactctacgctgggctgggctgggaaagcctgcactcaagtccaatgatgggcacaagtgctggccacaatggggatcagaggacagtcctcgggcctctggagaaatgccccagcagggggtggagcaaccactgctgtgtcaaagacccagcatggagaaagaggtgcagcctggtttccacagcctagcaagtgatattgggacctgatgcactgtcatactgccaacctggcagggctttctcccgccacccaaagctagtgctaagtcagaatacttagctgagtcacacacaatttgccttcagaccacgtaactgcccaaggtccacattcgccacccgggtcaaaaccacacctctcaggctaaaaccctctcagtccagtcccacaaaggggaagcacacaacttgagggcccatgctggagcccatcccacagtcacctctcagttctggctttgggagttcctccctaattcaagacaagatcacaaaacccagcccaagacactctgaagcagtgactgtcattcctgctagctgcttaggttcccatacagccctctctgagctaggattggtgtggcacccaggtgtgagatccttcctagtgtcattcctgctccgtctctctgctactccccaagtcagatctggggtgtggtagggtcaggacgctcccctgcggcctggattgcctggctatctggtgggaatgtgtattgcagagacactcacctgctctcacacactaggaatttactcacaattttctgctggatctcaccacaaaggattctgcccattttcttttttctgttatccaaaattttcttttgctttaatgttgaactcctgtgttccttcttggataaaagttcacagtatcaatctctacacactattttgctgtttccaattgggtgaggggtgctaacaaagcttccattccaccatctggggaaaaacactcaagaaagagaaatacctctgtcttcattgtgcacttgtggagagagagagaatgagctttttggtctcatcttatagggacaccaatcctgttgatcggaaacccacctcatgacttcatttaacctttatcacctcctcataggccccatctccaaatatatttggggttagagcttcaacatatgaatttttgaggtggacacaaacattcagtccataacaaaaactatagggtaaggactctgttaggataaattcaagcctttataggactacatcattaggtcaaatggggcctcccacaatgattttcatgaaataaaaacagatttaaagaaaatgtagatttcataatgtctgccacctcttacatgttacattttacctaactcaggctagagggatcacagaagatataattatataaatgaatatatagaataactgtgggtcaaagatttattaaattataaccacatatctaaactgactgatagcaggtatcttgtctcgaaaaatataaaagcactgagctaaagcacatctatcttctcggagagctgaattaggataggaagaaataaatgcttgttgtatgattctggtagcccacggccaattatgttagattgatggagaactgagtgaacgagtctccctttcctgagcctatttttaaatgatggagagaaatacaagttttatgactggacatcataaaattatgataatgactgaatctatttcctgaaaccatatgtcttacagatatgtaattttgaaatacaaaaaattttaacatgtcagtatcttttaattcagggtcacatccaggcatatttcaggagaattttattaaatgctaggaagactagaatatccatgtctggaataaaattatagtcagtttaatgcagtgattcttaatctttttgcacattaaaatcacctgggaagctgttaaaaaatgccaatgtctgtttcccaccccaaattaataaaatcagagtctagaaataggatcaggcatttttaaaaaaagtttttggttaattttattttacagaaaatcactgtcctaatgtggagaagcaattaagtcattgtctaaggcagcaaatagtttaattccttggtctaaaattagaaggtccagcctgtgtagaccaacatattcttgtcagccaacttcatatgaggtgcaaagctcactgaagtgtcaagacaaatcagtagtcaaaaggaatcaaacattactgagtggcaactgaaaatctcaacccacatttggaatggtcctagagaagtgttatttcctggaactaaatggagattggagacattcagtgtggctttctgtttgtaaaatccattgaggggataattcttactaattagctccctttggaaaagtaattgggagatttagtcataagcagcaaacacaggaaattcactgcaacttagaacctgaactttaatcaaatatcccttcagggacttgagtctttataaaagaatatcctgttttttcctggacactaggcaatggaaaagagcatcacatcctaggatgccttttggtgcactaccaaataaggagtaaaatttgtggtgaccatttgaaatactttctttacctatttgcatatgatttctataatcctttaggaataactttgccataatcatctcctgttaaatacttacaataaggcaaagacatagggatgctgaagtgttcagttttttccagtaagtaaagggaaccattaaaattttctgagcaagtaacttacatgcatagagaagttaaggaagttgactttagaaagatatagttgaagaaggagaaaaaataggcaaagagatcagctataaaatcatcatagtaactataccaaagcagataggacttcaatataatctctctctctcacacacacatacacacacacacacacacacacacacacacacacacacacacacgaggttgcaggattttttaaatacaaatgtaaaagggtggcaaatgaaaaagtttaagttgtagcaataagatgcaatgccgattacactctaaaatagataaaattctaaaatgaaaaatcatcaaaggaggatatagtaactgcttatactattctcaaatgtccttacatcaagaacataagtctgccaaaggttagagacattttggagaagacttctctgtaaaagctcttaatgtgttacgagtcttactgttacagcacatcatcctatcctaccaaggagagctggagaagaattcagcctcacctcgaccgagagaggataacataatatgtattttcttcttcttgtttttgtttttgttttgttttgtttttttttgaggtggagtctcattctactgcccaggctggagtgcagtggcacaatttcggctcactgcaacctctgtctcccagattcaagtgattctcctgcctcagcctcctgagtagctggaattacagatgcccatcaccatgcccagctaatttttgtatgtttagtagagacagggttttaccatgttggccaggctggtctcaaactcctgacctcaggtgatccacccacttcagcctctcaaagtgctgggattacaggcgtgagccaccgtgcccggcccataatatgtattttctataggttggaggactcagaagtgtagtgactgattttttcatacctggaaaatttatgcatgattgactaagtgcttttatagctaattaaaggaaagattgaggctacattatatgatttgaactcgcagtgtttatgtggaaattatatatgtgtcccatggaccagatataagccatttagaagacagaatatctcttgtctgggtcaacctggtcccattctgaagcacgtagacatatctcagtagagagaatctgaaggtcctgatagaatgccaggggttcaggaagaagctagcaaactggtagaataaatatgaactctgtgtaatgagaacatccataaaaatgtgtgcaatgctgggaggtgggggaatgtcatggtctccagagaacgcatgaaagttgtaaatctaggaccaggaacaatgaaggggttttcctcttctgcctttctgtgctccaaacctgagggagccagcaatcccggttaggaagctgagggagcagaaatcatagtcatggcctgataatgagagaaaaagtcaactatattttcccagctgtagatttcccacctgcaaaaggcccagattagaggagggtagaagcctcaatatctaaccagggccagagtttgaattttcactaaggttagaggtttttaaaattgttgaattttaagaatgtgatcataagtcactctattgcttaaaaatacacagaaaggtcataggacctgtctaaattttttgaaaagtaaggaaaaattaacccagcagaaaaaatttgaaagtactctgagatgcaaaaaatatgattatttttattgtactttatgaatgttgcttatgcaatctaacattaacaaagctaaaagtcaagaattataaactactaagaaatacacagatgaataattacattttatgtctttgtagcattttataattttacatgtattctcttatttgatcctaaatattctgaagataaaatagaaataattttcttcattttatagaagaataacctgaagattaagggtaatgagtgacctattatatgtgttgaagtaggttttaagttaggaccagaatccagatgactatctataaatcttacccaagggcacagctccttaggtaagaagtagcctttgcaattttcctgaaagctgttttcattaattcattcagtaaaaattattgaccttctaccatgcctcaggcattgataggaattcattagggaagaaatcagagaatcccacttcttgcatcgaactttcattctaatacagaaaggcaggcaataaacaaacagaacaaataaaaggatatgtcaggtggcaaactttgtgaaaatataaatatggcatgttaagacagacaacaagacagagactattaggaaccagagctgctgtatgttatgtaggccatactagagctgggctgagcagaagggccagaggtgggtgcactttcaaaaagcaaagaggctattgcagctggagcagtgagcaaagaaatgtgctaggtaggagatgatgctctagcgcaagggagtgcatggtctgagaaggaggtcatatagggccttctaagatcttccaaagacttgcaactatgaactattcaccgtgaatgctatgtgaagccattcacgtgctttcaccagaggggtggttttgcctggctggttttgattctgttttttaagataattctagctgatatgtaagaatagatgccagcaagccatggcaggagtgagaagactggtgtggagactactgtaataatggtccagcaagagctagggtggcagtcgacatgcaaaggcatgttttctacttttttaactttttattctgcaggtggtccttcgctggtctcatactgcatttccttaggtcacattggtgcaatctgtaataaaagatgcctcaatgacaaaattgtttgctacatggagggattcctcactcccatgtctggaaatgaaatcttgcaggtcattaccagttaagataacccttgaccatcctttgtagttcactctgcctttgcaccatcatcctgtcagcagatttctctatcactgaatgctatttattttctttatagcactcattataaattgtaattgtacatttatatatgtatttatgcagttattgttcatttttctcactagactctatgcctgcagaaggcaggatctttctctattttatttctatttatggaatgcctagtctacaatttgacacaaagtagttaataaaaattacatatgaatgaatagaaatagtttgacttttactttacttctaaggtatcccagatctctttctcttatctctatctaaatgaaaaagctaaggaaaatatctgaatgatttcatttttaaaaagaaaaattatttaattgaggaagaaagagaataccctcccctcatttttcaactacattgattatatttttgtggtagtcagaataatatccccccccccaaaaaatatccatgccccaatcctccaaacctatgcatatgttacattcctgaggaatgtaatggggaaagaggaattatatgggaaagaggaattaaaggctataattatctggctttaaaatgagggattgaggattatctgggtaaggccagagtgataacatgggacctaaaagggaaaaaggggagacagaagggagatcagagggatgtgccctaagaaagacaggccctgccattgctgaatttgaagatggagggattgggccatgagtgaagaaatgtggatgcctttacaaggtggcaatacctctcagtttaaagctagcaagataacaaaaacctcagagaactgcaaggaactgaattctaccaacaattgcaattatcaaaagataaattttccttttcattcccaaagaatgtagctgtgcagacaccttgattttagcctggtgagacacatttgggactcacttagtattcatttagctatttcactttttataatgcagaatctgccgatattataatgcaaattaagatctttatgattagcatctttgaaaaaatactttttctttttttgtttttaaacttcatatatttttgtaactattttgaaacataatagctgatgttatcggaatatatttgcacctgaaaactgtttcctcatatttttatcataatattaatattcttaaaatcctgcagtggcattgatagtagccaataaaatcaagatttaaattttaaaaatgttctagacacagttaaatcttaattatgccatttgcttaacaaggcactttgtaacaccttcggttacaccaaaggcacttcggggttttattgttgtattattgttattactttacactttctgtcctacaattataactgaaagctacgagactggatttcaggaaatgagaaaagttgaaaagcaattttactgtaacttctcagaagaattactagcagatttaagaaaaaagaagtaaataatcactaccaaaattaggtaatggtctcatactgcatgtgggtaattcatgaatttcatttcatatcacttctcatttctacaaggttttaggtacaatatgaaaaatgctcatagacacttaacatttgcccgagtgacagagactatatcttcttgtttctttcttccatgtaccagtaggaactaagaaactttgaagcatattcaaagaattctgtttctttggtaggaaggctggctgtgcataaaggctggctcctgctgcatggttagaatcttgagatataatttagcttttcagaaaaagacatcatgtacgtgtcacaaagtctagtctctgaattttttttgtttcttatttgctgaaaaatacctattctacttcctgaagcaagttcatatatttaaaaatataacagctttattgagttataaatcaaataccataaagtttatgcttttaacatgtaaaattcagtgctttaaatatatccacaaagttattcaaccctcagggctatctattttaaggatattttcatcactctaagaagaaactgtacatccaatagtagtcacccccgacttcccccttttctcagcctctgacaaccattaatctactttatctttctatgaatttgcctattctagacatttcacataaagggaaacatatgatatgtgatctttgtaactggcttcattcacttactattatatttttaagatttaccactgttgtagcttgaactgatacttctattcctttgcattgataaataatattccattgtctaggtgtaccatattttatttatccattgattaattaataaacatttcagttgtttccgcttttcctccattatgaataatgctgttatgaactttgtgagcaagattttatgaggacataatttttttcatttctgttggatatatacatatatatatatatatatacctaggaatagaaatgatccttcctttggtaactctatgtttaccactttcaggaactaccaagttagtttccaaagtgaccatactgtttagtgtctccattggcaatatacgagggttcaatttctccacatcttcaccaccacttatttcatgttatttgttatcattcttattattattgctgctgctgctgttgttattattgcaatcctagtggatgtgaggtgatatctcattatgtttttgatttgcatagttataataactaataacaagcatcttttcctgtgctcgttggccatttatagatcttctttggagaaatgtcctttcaaatttttcgatcattttaaatcgggttatttttctatatttttaggttgtaaatcttctttatataaattggatataaatcctttatcagatctatgatttgcaaatattttctgcccccctctgggttttattttcacttccttgatgttatcatttctagaataagagttttatattttttgaatctatactttttctgtgcttagaacttttattgtatctaagaaaccattacttaacccaaggtcccaaaacttttctcttacattttcatctaagatttttagagttttagctcttacatttaggtctatgatatattttgagttaatttttgtatgtgatatgatatagtggcccaagttttttcttttgcatgagacatccagtttattccagttccatttgttgaaacatctattctttccctatggaatggtcttggccctttgttgaaatacaattgactataaatatgagttcttatttctgaactcttaattcaatttcatcagtacatatctctgtcctaataccagtccccactatcttgatacctgcaacttgtggcaattttgaaatcataatgtgtgagtcctccagttttgctctttttcaggatcatgttgactcttctgagtctcttgcatttccatgtgaactttatgatcgtctgtacgataagcagtaggattttgatggggattgtgttgaatctgtagatcaatttgggaagcactgtcatttaaacagtattatcttccaatacatgagcatgtctttccacttacttagatctttaatttctttcaaaaatattttgtagtttccagtgtacaagtcttactcttgttaaatatatttctattttgttctttttgatactattgtgagtgacattgttttattaaatttatttttgattgttcattgccagtatgtagaaatataactgatttttgtacattgaacttgtgtcctaaaacctgtgtgaagcagatacctttttttatatgtactgtattgccacttttaaatcaaatatggagtggctagtaaaacttttactcctaagctttatttctttattaaagcttataataatttctttaagcagaggaagtatttacctaataccttctgcttccatagccatcaataaatattttaataaggtactgtacaaagcaaaatggatttaagaagatatttgatatgctccctagtctctataagcttattatctagtggaaaaggggatacagatgcataaatgtttacatgtagtgttacaggtcccatagttgatgcataatacaaactagtaagttatctaccttgtttgaaagtagatttacctgtccttttatgcttagaaagaaacttattgtattttgttttgcttaactcagaattttaattaagtaagtaatctttgaaaatagaataacatgtccattattttgcttacaaaatactgataattgtaacacaatgaaacataagcagggacctgacactggcaaagttagcatatttgtaaataaaggtttaacagttcgcatactttatctttccactataaatgttttaagcacctttctaacttattaaagatatttcaatttaattttatatcaaaaatcacaagacatttgggctttaagactttccatcgtcttattgtctttaataatatctctgtggtcagttaatattttaagtactttttggctatttgctatgaaaactttaaaataactatagttaattttaatatacagtgattattttaaaatgcacctattatgtaattatttactattgctttctaaatttaattacacattgaacatattagctaagtgtaaatatgatatgcatattttcattgcatgtatttaagtaaagcaactcttatttaaaaccaccactcctatccccacttcacccctttcacacatttgtcattcctaaagtatctgcccctctttgcatctgttagtcactgtcatagtgtctggaatagtaagtatttatagtgttttcaaaggaaggaatgaatgaatgaacagagggaacacgtattgaattttcaaggaagtataaatcactatgaaactgagtattgagagaagtttctaaagacactataagacacaaaaagatttataggatttccataattagagaagaaaagacaagggatttgaggtatgaacaagggtatggaggtgaaaatgtgattgcatctgaagaaaatgagcagataaatttgactggattagacacagacatgggcagtatatggtcctaccaaattttacatgccagaatgggaggcaatggatgggaacagggaaacatcgataatgatttcaagtttccatagtaggttactggaaggatagtattgctcatgttaaaaactgagaaaaccacaggataatttggctttgaagaaataattttgactttaaaaaaaaaaaacatgttattcggtgagacaagacacctcaatagaaatgtctggtaggtaatcagaaatgtgagactggcgcttgaaggcaaagactgaagtagtggtatgggtttgagagatagtcgttaaaactgtgagagtaggtctcagaggaagaaatggttatggtgcaacacggggtggaggaatggctcttagtgctagggaaggctaatgccgaatgggcatgaggaagaaatggtgacacaggatgagaagcaagagtgtatggacagaacaaagcatcccattatccacaaaatagtttcaggatgaaggatgcaattcattcaattaaaccttatttgagtatataatgaatacacaaaaaagattttaagcagctcatagtccactgaagaaaacagaattttaactggaagaaaaaagagctttacagatataggaaaactcttattataagatcataggaagaacaactttgcataaagaagttaaagattatttcataatgactttctgatgtcttcaaaggtggtttttgtgaacagaaaaaaactgtgtaggagtttctttgcctttaaaaattaatgtataatatattaaaattgcaaatcaaaatatctgctcccttattaaacctctaacgttataaacctttagtctcagtctctctctccctctctcctctcctctcctccctctccctatccactcattgttttaacaaccgcttttaagtctttgaataatattggtatcatttaaacaattaaacaccttcaagtataaaaactgcatttataaattaattatatttgattacccttttaaagtactgcactttagttacataaataacaaaatgtcccaaatattttaataattccaataaatgtttaagtatatggcatcttgagtttgtttacaagttccaatactatatatataattaataaaatttttactttaaaattacatatctaaattattcagttgtatattacttcacttaggcacactacgagtacacaaaatactgtactagaacataaaatggcaatatatctgacatcaatatgttaatgtctttggttttattctcgtaaacatttctgttactctttaggtttgaaagaagcttatccatcaaaacaaaaagtaggtcatcctaagcaatttgagggatactcagccatgatattgacaggttttttttcagcattattttggaacatactgagatctagaagtaattttaatataattctataaattggaagaactcaggtaatacataatctattatgagtcgagaaactacccctacatttatatgtttgcttgaattttagatatttcgactcctaagatataaaaatgattttgctccgtttaaagacctttgaacttcatgaagacctttactttttttatatatcttcagaatgaacagagttattatgggttaagaatggcaggttaattctgaatatatctcattggacaaatacagttagaaaacagagtcacattaaatttagggctctgtgatactttctatcaggatcttagtatgagtaaagcaagcatagtatacatgactggaaaaattagtttccattttgaagggcattgtatgcgaaactgcggagtttggattttaccccatgtgacaggtttttgtgagtgtaaagcaagatgtatatggcagcaatgtgatggatcgcttagagaagcactaatgtttggcagggagctatgaagttgttgcagaagtacaagcaaaaaatggtgagtgctaggtttaagactatggaagccaggagaagtttggtatctgtgataggattttgtgacctattgattgcaaggttgagagatagagaacaaacaaaacaatatggaaatttagattttggaagatttggagcattatatcataaactgggccctctttagggagtcctcaatggcctttcttcctgccattgcactggtcaacacgtttaatagttaccactacttagccatgcaacacattttatttctagtttaatgcattattattgtacaggcataaacaattatatacaaatacatgagaagtactttctatgttactttctgccttataggcttctgttgaattatgaaactgataggctataaacatgatcttaagctttggaaaatgttttctaagaaagataaatggtgaatttaatattaaataaatttccccaggatataatgcctttatctcttttttattttctgtactctttggttttcataaatcttggtttattattctgtattctcttgagtatgtggtttacatcccacttattgggtaggtgatttctattttatggcttaaatgagggaggaggatttttgttatctggttaatcctgattatgggaaacagattatgtaacagtcaaccacttttagtgatctcttaagaatcttgaagaaaatctaattttcaaagatatgagtaattattcaaatataataatattgcaatttaaactggtttctctttattgtggtttattggtctgaggataataaagtactgtattcagtagtcaacaaatatttgactcctactacatccaaaactctgttctaggcacagaacacagaatgtacagaatacacaaaaataaacaaaaatccctaccctggggatgtggtttacattcaggtgaaggcagacagacaaataaaatttacacatatgcacatacacaaactaaatataaatatatacacacatatatgatacattatactattttgataagtgctttaaagaaaaataaagcagagaagaggaataataataaatgaggggcatgggggcacgaggggagtggagagtcacagtataactagagaaggcctcagagaaaatatacaggtatttgggaaaaattggaaggaagtgagggaaataaattacagtgatcagaggaaaatacttgacaggtataggaaacagcaaatgctaaggttctgcggtggcctaagaaaagtgtccttgagtaacgaagacaaggatggcagtatgggtgtatctgaagagggcagcaagagtgaaagtcagagaaaaaacagggagagaacagtcattgcaggaatgatgggccattttaaaatgtcgactttaagcgacatgttgaggcattggagagtttaacttgtattctttagcagaaacaaggctacaaaatgaatggaaaaactaggtcttgaacctaagtaacctaagtctctaaactttgccagtgcaattcacataatatagtgaagcaatcttagagaattggaagtttgggaaatttaggtcttcatcttgcctttgaatagttccaaagctgtatagttggctgagtattttctctgctctgagtgacctaaatatgtaatataagaagttccttcttgcttaaaattcctcattctacattctcaaaactttgaccatatatagagaaagctaggaatcatgtaaatctttttcctatagataagatttatgattatctttgtaatattacgaaataacagcaagttacaaccctctagaaaattaacagtctattctataaaagattaatgctaaaaagcaagcaaaccaaactagccccttttattcactagtcttaccataacatttgaagtttatgtatacagttaaagttgaataatagaacaaaatatattcttgtattttcattctattgctcattagtggagaaaacagaagaaaaatgagttgtatttatttctttccttttacttttttgaacgtcacattattctttaatatgagctctggaaattgattctactgtatagagtaggccacaaagtttaaaccaatctataagggagaaaattcatgttcatttcctttaaggatctctttgctttaaaaaatcttggcagcaaaatgttaacttttgtgtaagtcttatctcaggtagtaaaaacaattaaaagtacctgccttagtccattttgggctgctatgacagaataccagagatggagtagtttataaaatacataactttatttattgtagttctagagactgggaagttcaagatcaaggagtctgcatctggtgaggttcttcttgctgcatcatcttatggaagaaaacataagagcagaagaccgtacaaaaaggggatgagataagggtcaaactcatccttttatcaggaaactactctccagataacagactaacatttgtgataatggcattaatcaatgatagcagagtcttcatgaactaattacctcttgaacatcccacctctcaatattgttgcattggggattaatattccaacacatgagcttttggggacacattcaaatcatagtactaccctgtgttaatctgttcttgtgttatttataaaggaaaacctgaggctaggtaatttataaagaaaagagttttaattggctcatggttctccaggttgtacaggcccctcacctgcttttggtgaggggctcaggaagtttaccatattggcagaaggcaaagcgtgaacaggcatgtcacaaacaagaggggaagcaagagttgagagtggaggtgccacactcttttaatcatccagctctcacatgaactcagaggaagaactcactcatactgcaaggagggcaccaagccattcaggaaggatctgcacttatgacctaaacagctcccaccaggccccatctccaacattgggaatcacagttcagcatgagatttggaaggaataaacatccaaaccatatcatacccaaagcagttaacaatcttgggcaacctcttaggtccatccacaaccacttgccctacctaatttcgcaaagcatttttgaaatttgtgttcacagtatatgagaagggaaaggatgctatcttaaatgttatgtactgtttcattttattaatgtaatcatatatgacccaatatccacagccactgatgtcaattttgatcaaagttgcttttaaaaaatacaaatgaaacttgttttctttctggaaacaaatatggatttatatataattctagctcccaaattctttccgtctctgctcaaaatgagttaccaatgcctaacatatcagaatcaccttagaatttcataaaaattacaaattcctgaatacacaacccagaaaagataacaaaatatctgagaatgaagcctaggaatgtgtatttaaaaaatgccaaatttttataaattttaagaactatcagcttggagaatgtgtaggtgcagttaatccttattgtcccaggaaattggcacactgaccctgagtagtcggggctctaggatggtacactggtgcaatgagaagaacttatatactacttctgactttcctgatttattgcctactttttcaaaatatgtaaatccccataggtggctaagcgagcactttcaggttatttggaaaactgaacagggagtttagtgaccactgaacttcactactctttcagaaaacaaatacattccagtggccttagagaattcattaacattccaaaacttatctgcgggtagtagtttacactggaggacctagctcaatctctataatattgtgtgtcatagaagtatattaatggttacactatgtagttccaagtgttaaagattttatagttaggtttcactgttcattacttttaaactaacaatcattttttcacatctagtttgattttcttttccttacaagatgacagattttctactttttcttatctttttactggcagcttcttgtctccttttattaatgtttaaatcttcaatttacagccctaatatacctatataatgatagcttgattcttttgcatctaagggtggaaatgaaaacataacaacattttttgctctttttacttcccatttctttaaatataaattgaaaatattagaagagctagatccaaccactaaagcctgtcatcacatggacacatagaggggatcaacacacattggggcacacattggagggtgcaggatgggaggagggaaaggatcaggaaaaacaaccaatgggtactaggcttaatacctcggtgatgacatagctgtacaacaaccccctatgatacacatttacctatgtaacaaacctgcacatgtacccctgaacttaaaatagaagttaaaaataataattaaaatatataataaattaataaataaaagcacatttttcaattatgtgactacaacagaaggattatatcttcaatttccccactccaccttgtttgaagatagcatgaaatcttggagtctataaatgtacattattttgtttgcagaattataccaaattttaaatatataattatatggtgacagaatgtatacattatatagaggaaaaatataattaatttgtatgaaatatatggataacaatacagttagaataataaagaacatattttattatatttcggtacatatttagcttttcagcgagacttggttccttcaaaataaatcagtcattatatctacaacatctgggccatatagatactcaataaatattggatgaatgagtgaatgagtgagtgggtaggtgagtaagtgaataaatgctaattgcagaactggaaaaactgatacatcagtgatgttggaattttttaatttttttaaaccaaaggaagcttttggtctctcaatatctcatctgacttcatatactataccagcaatcacaggcaaagtgttataattaaaagcaacctatgttattttatatccaataggtaatacctagttttccagagagcattttgtaataaaaaatatttctcaagtaaattcatgatgacctgaatagtatttttcacatcactgcatgagtctgtgcacttaagttcctttaaagaccaactttttcatagaacattagaattcaagtttgagaaaccctatatgccctgatacttctgcttttgcaaactatgtataggtacttcttgttattttatatttctgtgtaagaaaaatagtgaatcttttctatataaacctttatcatgaaaaaggaaaaaaataaaacatgtgcattaaaaaataagaaatatcaagaagtacttgtttaaatcccatgtcttaagataatttgcctgtcctatttgacatgttagaaacaatactaaatagctgacactgtgaaattccagtgatgtttaaaacatagatgattatacacttttttctatgtgtactatttttatagaatattttatgtaagaaagggaaagtaagtataaactctcaatttgtctaaaagcaaatgaagtctttaaaaacttgtttaaaattagcaatatcataatatttcaaatgctaaaatatgaattaaaattctgtctttttaaataagcatttggagtgatacaaaagtcaagaattgatggtaatagtataattatttatactgctataggggtaagattgcataatttgtaatcatacaatttatgttgcttgaaaataaaatcctgcactctgaatttgatctacaaagacatctttcaaaatcctgggaaagtgatttttagtctacttaaattattttgtgttaagattttaatacgctgtaagtatcaataagctgtgtagtttatttggagtgaaattataatttatgcctacatgtatcaaattttcaaataacaatacatgtcagaaaaaaactttttctgcatatagaatatgccattgattttatgtaaactatttcagtaagttgtgactgatgtaaaaatcaaacataataggattattatataaacagaaagcttatatagattataaaaatagactgagctagttgttctctgaagtcattatttgtaaatgaagatgactagaacgttgacctgacaataataaatgaaccaattgtagcctattaggaagatggattaaccagaaaatttagattaagccaataaaatctataccaatgattggctcccagtattatcaattttatttgtcccatgtccaagcttagtacttatttacaaattcatcttctatttatggactgaatctgcattctagttttaagaactgcatactccttccagggttcatatcacccttcctcacctctttgtgctttgccattaacttctcctgggagcttccttgccataacttccccaagcctcactcaccaacaaacactaatattgtcttaccaaaacacactgtatcacttaagaaccatctcaaagaccatcacctccggaaacttcaattgtgagcccctcaatggggaaaagcttttgtgtatgtgtgtgtgtgtgggggtgtgtgtgtgtgtgtgtgtgtgtgtatgttcccacattagttgtggaatttatcttaatccaaccagaattatatatatatcatcattagataagccccttccacaggactattctttgccttctgaaaaaattattttccaaattatattcttttgaatgaagttcagcattcttctgaaattaataattaggggactaatatctatatagaaaaattagaataatattatacaatcagtgttttgacttcattctagctgaagtgtttttattcttaaggtgagaaaaatgatagtattattgtgaaatcaaggtaagaaaaaatatatatgatacccagcgttatccttcaatcatagtagataactcagtaaaaattgttctccttctatttcttataacttaagtgagaaaaaaatgaaaagaaaggtaagcagatactgtagcttagccaccaagtaattgattaagttgattaccctattgggaaaaaatatcattatggagttgtaaaggcttatgaagaatgttggaaaaattgtttttctgtcatttagtttttactatttatgagagaaagtctggattagaaaggtgggaagaaggaagtatcaggccttacctgaattacttgtttatccaaggcaacagtgatagtagaagaactgggagcctcactttaggcaggtagaaagttgcagaggaaagagtttccacagtgctatcctgaggcacagtcagacaaaccctcaaaaatcagtttcaaacaaacactctgttattattatcataactctagtagtgctacagccactgagagaagagactatgtcttcggagaattttctatgacaaggagaaattcagaaaaattatactgaatttagggagtattagaagagtttaacttaatgaaaggacagttgcttcttttcatcttgcttcaaatgacattttaaaatattttcctaatctataaacatgtgacatcagcattttagccaaatggctatgttaatattttattgtttaactaggaaaggctaaattcacttgataaagagagcatgttcactatattcacttgataattgttctgatactgtattgccaattctggaggcaatacctagatgggatttctccattacacaagttccattgataccagtctgtcaatattattagcataaaagctcataatgcgttttgagtaaacagttgaaaggatgaaggcataaattaggggccactattctccctttctctaccttgctctccctaataattaaacctaaatgacttagaaatagagacatctaaccctgataaattatccccacacatcaatatttcctaaaatttatttttaagatttgtgtttctgccaataaatttttaaatatagatttgctgtcttttcaaattatattttattgggatatccttaaatgatgttaaattgttcttcatttaatgccttttacattagagacagagatacaggcatcaacagcttgaaattatcattgtttccagtaagatactgttgagatgatgcagcagttggattgatagaaatataaaaaagttccaaaataataatgtgcaatcaaaattattattaaaccatggacttgagccaaatccaaatagagcatttctattcacacaagtgtcagctgggtttctggtgcttggggtccaagacttcagaactcatatgcacttcctggggcattcatgatgctgttggtgatggacaggtggtctcctgcctctgtgtatccatcactgcccttagatggccactatcttgcaggagaaatggagtctaactgcctcaggtgctccatctgtccaaagagaattggcttgctaataactctgagtttcctgggcttcctcacctatatactttttattgcatacattgaaaatgagactctatccttttatataagtttgcatggggctgctaaccatacattgatatgttgtatcagagtaaaaatttgtgtttctaatatttctaacatattcttgtgaaggtttaaagataccttttccattgggcttccaaaatttgtttcctgaattccctctaataattatgttttctatgcttaatttttatgttttccctgtattgtgtgaatagcagtcttgttaaagtgagaagtagtttcactctcttgaaatactaggttgattttctattctttgactgaatctttctcagtgctctaaattttttcctgcaattttctttcaagacaggtatagtatttgttttattaagtgtgaaacaacatgccttattttgccaaaaggctgtaatataataagaaaccttttggaaaattgggtaagactattttttaaatgataaattcattgtatatgtttgtcagtcataagtggttgttgatgatcctgcagtgttttgtacaaaactggtaaatttggtgccaagaagcttcataggtaggtgattaactagtagtcgttttgcttgaatgagaacataatcaaccttttaagtttctattatcatactgactatcaaataaacttctgaaagaaaaaatgatagttgaagaaaataggactaaatatttctcctgtcttttttttaagagactggattcagtgcaaaagcaaacaaatagctacttattacatcataaagctgtttattggaatgcattagggcatgtggcaaatccagaccttatcgggatgccgtagggagaactccttaaaggatgctggctgcctggcttttcccattgtataatagttaattaggtttcctccagttcaggcatacacacatattggtactggtagggattttctattttgataatttaaaataataaaaatggctttgtttctataatgaaaacatatacatatgtaggttgtttatatgcaaatatacaatgaatataagttgtaatattgatttaaaattcctcttagcgacacagactaagcagtcacccttagtctgtgttgctaaggcctattttcttctgtgtgccccacagttagtgttggtatgtccgcttcttgttcccaggccattattgttatttgtgggtacgtacatataacctacattgatgctgaaatatttaaaaggtcttacaaaatgttcgtatgttaaaacaactaacaataagggaaaaaaattggagtaaagaagtccataagataagaaaaatataaaactaggattatggtttgacatcactctttctggcagccaagatagagttcagacagttacatgatttccagtgtatattaaagtgcttagagacacaattattcctggaactgagagaaatgtgtttccttttgtcttcataaagaatataccatgtaagccactgaatcacttacaggtttaaaatctggcaaaactgcccggtagttcataaaaatgacaatctctttacagtatgttaaaaataaatttcatgttcaagttcctcaatgtagctaaaggactgatactaatgttcggtttagtaggagcaattctgtgccatgtgattgcttatgagtgcgtgtttatgagtgtgtttggggtagaaagaggtgttcggatagagctggggttttaggagatgattctgatttttaacagagatttctctggaaaaattagaaaaaattttaaaaaattagaaacttcatgatatctagaggtcactaaaatctcaacctttgcttatacctatgtttatatttcatctttaatgtcaggtgatgacatcaagtgatttatttttcatttttcttttttgtacttttggctttgttcttatatttctttaacactttagtaagagtcatctatgcatgcatttttatatttattctctcttgaacacacctacacaaaaagttacataaatgagattaaatattatgtgtttttatctggtagtatttgtggttttgttgttcttctttcttttttcttttttcatcccatcagcatcccttctcttattcttggcttctatcttggtcattttttgtccacagtaacattttcaaataatattctgtgttttgcaattctgaatactctgaacacagggtaagatgcttcatttatatcttaccatcaaagggttcaaaagcatacaagttactttttttttttttttttttttttgagatggagtcttgctctgtcgcccaagctggagtgcagtggcgcgatctccgctcactgcaagctccgcctcccgggttcacgccattctcctgcctcagcctcctgagtagctgggactacaggcgcccaccaccaagcccagctaattttttgtatttttagtagatacggggtttcaccgtgttagccaggatggtctcgatatcctggcctcttgatccgcccaccagatccaaagtgctggggttataggcgtaagccaccgtgcccggccggcatacaagtaatttttaaaatattttatatatatgtagctacaacctctagagcattacatcatttcatctttctcattccctatttgatcttatgtcaaaaagcatcaggccagaggataggctttagggtcaagggacaaggttgcaattttgattttgccatgtaataggggtttagtttagtttgggcaagttatttagcattactaaactataattcataatatgaggaaagcagtaggactttctacttggttttgttagaattaagtggtcatcacagtgtctgacgtatagtaaacactatatattaatccaattacaattttccaaaactaggttcaaaaagtgaattaattaaaaaatacataattgtgtggcaactaagataaactactagtgggctttttaacactgataaagatcacttggctttccagatgctttaaataggttaaaactgagaagcatgtaaatccaagtatatacttattttgttagtgtgacaaactcatagattttgtatatcctctcttcaacataccctgcctcaagatggcctttgtaaatttgtttatgtgtgtgcacgtgttttcttttttcttttttcttttttaattgacaaaaattgtatatatttattatgtaaacatgatgttttgaaatatatatatgtcatggaatggctgcatcaaattaattagcatatgcattaccacacatagttgtcatttttgtgatgagaacacttcaaatctactttattggcatttttcaagaatacaatatattgttattaattattatgtaaagttttattgttactcataagatggttgaaatggggccaagagagcaccatgtgatatgatggtgataagtcacttattccacaagatgctgctcagaaattgtttttgctcttggtgattaaggacttgtgattttacatactcagaggacaaatttgaatgaaacttatgttgtacaattcatctggtgtttgctgtagtaaaaatttgtagaggaatagctgcagtccttctccccatatcttctggcataaatataaggggctggggtactgtcttccccatagtcctcagccctgtgtcttgcacattatctatgctctactgaggaggtactatgtgctcagcatgctgcttgacactgtggaccatttaaataccaggagaaatttagaggtttggtaatagaaaaagatacaggctatgaacagaactaagaagtaaggggtcacagaaggtaaagtcttccttctgttattgagggaaaacatagctattcttttaggcccttttctttcccaggtagaaactctgaagttacaacaaagctggggacaatttttgaactcatataaatttgtgccagcaactaaatgagttttgctgttcaaacaaaaaatgccagtcactccattcttgccaccaaactgtacatagtgagaggttttaaagacttaagttataaattttaaaaatagtggtttttatcttaaaattatgttggcctttctgagatttaaaactgccacattgttaagaaagagaccattactgaaacataaagtttggcttgcaagttcacaagtcctttctctgcttcctttcctccttaatataggtcccctgagctacattggaaggtgtaatcttctctcttagaactgtataaatacagtaagccccagtaaaaacagacggttggtgtgatcatttttaacagccccggagatgtccatatgctattcagtaatgtggcatctgcatagccctttagctgtggagtgtactttaaacataagcaatttttaagcaacaaggtgtcaaactattcatccatgtgaagcaaatcagtcctgctgcacccctgagtacaatcagtgaaaacccttagagtgctcttaaccacccatcctccccaggtgcacggcatgttcttttaatacagttacattattgtgcctccaagtcagaaaaaaaattgtgaggtaaaatattcattcaattaacactggagtcactaagtcactactgtgctggtgttctccaccagtcacaggagcatttatgtggctggacagctatctacatccgctcccatacagttatacgctgctgagtctaatcgaggcacattcaatactaataagtaaaaataaactttatggaataagagaaatttaacgaagttaattataaaaatgttcaagacaaaaataagtgaattaaaggcaaaataagtgaattctttagtcttgaatatctaactgaaacaaagtgttacagtgttgttctaagacctctcttttttaatcctcctccatccttagacctttaacatcaagcagactaaaaagagatctaataggtagtcatatatcccgaaagacacattattgaaaaaaaaaaatgcctacaaagtagttgttgccaaaataatttgcgggaaatcaacccaataagcaacactacaaaaataagataaaaaatggctagcctctcaaggtgtttttggctgtgttattaaatgttcttttatttgttcatattggcttatggatccacccaatcataagccaaagctcactcagtcatccattcattcatgtactatttattgcgtgcctactatgtgccaggcactgtactagaccccaaatgatatggcagtgaacaaaaaatgcttggtattaaggaacttatattctagtggtaggagacagaaactaagtgaacacataacatatcatgtactgatcacagacggcgattatgctgtggggagaagtaaagcagggacaatggatagtgaatagatgaagggaaagtcattataattttgactagaattaacatggatgacattgttgatgaggtgatactggagcatatgactgagataaaagtaaaggaacaagctatgtgggactaggacatgggtgaagtgagcagaggagggatcaataaattccaaatccttgcattttccttgtttgctccacaaaaaaacgaaaagatgagtgtggttgtgtctcagggaggcagaaaaagagtggcaggagttgaaatcagcagtggaggtgatccatatcaggctagtcattgaaggaactttggcttttactctaaatcaagaagcttccagatggtttggagcagaagaatgttgtaattttatttatgttttacaaggattgctaactagcctatggagaataaatgatgcatttgtatgtgtgtatgtgagagagagagagtgtgtgtgtgtgtacacacacatggcagcaaggacagaagaaaaaacatctaggatattaatgcaataagtaaaatattatggcactttgttttttgattctgtttgctggtttgtgacagagtctcactctgttgcccaggctggagtgcagtggtgtgatctcggctcactgtaacctccacctctcaggttcaaacaattctcctgcctcagcctcccgagtagctgggattacaggcacgtaccaccatgcccaggtaaatttttgtattttcagtacagatggagttttgccatgttggccaggctggtctcgaactcctgacctcaggtgatcggcccgcctcagcctctctaagtgctgggattacaggcatgagccaccgtgcccagttcgtactttggaacagggtaggagaaagtgtccctgtttgtgataactttcaaaaatagagttcctttatttgttaatttatcggatagggtgtgaaataaagggagaagtaaagtatggtttcaagatcctggcctgagcaacaggaaggacaggtgtcctttactaagaaagggaagactgaagaagatgagaaatccagatttagacagaaatctaaagatattaaatcttatgttaaaatgcctagtaaaagcctaaggtggagatgcaggcaactgggtgaataaaatgaaagtttagggaagggatccaggctggagattaaaaataaattcaaagggatcagcacatggggaagatttaaaataaatcatggagtgagtgaaatcgagaaaaacgaggtccaaatgtggagtcttggattttccaacattaagaggtaagaaatatgaagataaaagagtacaggagactgaaaagaaacagctgttcaaataggagtaaagccaggaaagtgtgatatcctcaatgccaaatgtatcaatcggggttcaaccagagaaacagaagtagtagtaaatgtatattaagatatttatgcagagaattggcttatcagattaggcaaatctgaaatctgcagggcaggctgtcaagaatggcaggctggaatttttggggatgagtgaaggatacagtccacaagtggaattatatctcctcttcctcctcctcctcctcctctccccgctcctcctcctcctcctcttcatccttctcatttttcttcttcagacattctcagttttgatattaaggctgttcaactgattgaatcagacccatccagatgatcttggataaagtctctcttttaatgtcaattatttataggctttaatgacattttcacaaaaacactgagattggcattttattggataactgggactatatcctagttgatacataaaactgaccatcacaccaactaaaggataaatggagggaatgatcaaccacgtcagatagcatagccttgagtatgttggatttagctgctaattcatttgtgaatttgactacagcagatttttattttggaatagagctgtatttgtttcctatggctgtcctaataaattaccacaaaaataggtagcttgaaatagcagatatgtatgctttcacagttctggaggccagaagtttaatactggggtttcactaggttgagataatggtgttggcaggccatagtccgtccagggcctctaacctgcctcttccagtttattgtggctgccatgcatttgttggtggccactcaaattcaatctgtacctttattttcacattgctcctcttttcttgtgtatatcaaatctcatctacctccctctaataaggaaatgtgattggatttacggatccccccctcccaccccacagataatccaaaataatctcccatgtcaagatccttaatttaatcccatctgtagagacccattttccttgaaagataacttatggttccacatggtatctctaggtggctatctttcagcctactacaagaagcaaagcctaactgaagtggatccaggaaaggtacctatttcagaatgtttctgtaaaggtgagcaaagaaagagagcagcagctgaggcaagggtgggaactgtatctcccagtcaaactcacagaacttccttcttttacatgcaaacatccaacaaacaaacatatatgattacagtttcatatatttcactctctggccatgtatatctattcatttctgttacatgtttaaccaaaccacttatggtaggttaatttgattattttgcattgaaaaagaaacttgaatgaatctgaccagcaagagatagtttcctgagtctaaatactttttgacaattttgttattttgtttttacctttgtctacaagggtaagtcgttgttctcaaaaatcacagtgaataaattttcaaagcattgcatacatttgtccagtttgacttacaagtcaaatctcttatatctgaatgtgattccccctatattgtattccaaaactttgaattactttactattacattctttaaaaacatatattggtattgtcaattaaaaaaccaattcccatgtgcttgtctctttatttgctttccaaatcatttaagccctggtcatatctatggcatacattataaaaagatcagagggaaaagagagatgatagaaaaaagtcttacttttttgtcctgtaatccatgacaaggtcaaggaaacttattctgaattcccatttctattacgcatgggctgtctgacatagtaggcatcaagagcagtacgtgatacatgtgtaggtgctcaataaatattgatgaatgaataagtaaatgaacaataaaattaccgataagaccttttatgttatgtttattattctatcgccattaaaggcatttataagcatcataatttttaactggcatatatatatgaaaatgtatccttttatatgaaaaaagagtaattactcataggattgatatagtgtagcagcttaaaagagaatatttcttttgaggaaagcatatggtcaaagatcttgtctgacagcatttggctgcacagtgaaattcgggctctgcaatgagacatgctcaatgtagtgatccctaatctgggcttttttagatttataatcttgaagtaattattttatctatctactcatctggaaaactgggctatctattccatatgattttgttaattaataatggtattgcatataaagggcctaatgttgtgccagctacatagtattggctaatatcatgatcatgatcacaggcaaatatcttttcttcaggtttgatagtacaacttgtctttttaactttttatacataaatattattctctttcacttgaccaattttctgtacaaaatttatttaagaaccccttaaaattcacttaggaaatcagatggagcatacataggaagtatataacacaatattatcagattctgttcactttcttttgctttttttctatactgtaccatgtgcagataatcaattgttatttaagtcctagactttggctctggaatccagatccccttatctaattaccttcttgggtttaccacatggatactttaaaagcagtatgtttaataatgcttttaggatatttccaccccatctttgcccaaatatggtccttgttagtcttccctgttcagcaaacaccatcatcatccatctaactgggcaaaccatgaatctagcagttgttcttgatgtctccttcttcctcagtctctgtcttagttagttcaaactattataacaaagtgccataggctgaatggcttataaacaacagaaatttatttctcacagttctgaaggctgaagtctaagatcaggaggccagtgtggtcaggttctggtgagggtccactttcaggttacagaccgccaactcctggctgttccctcaaatgccacaaagagcactagcaagctctctatggtcccttttaaaagaggctaatttcattcatgagggcttcacctaaatcaccttgacctaatttacctcccaaagacccttttagcacaatcacattggtgggtaggatttcagcatatgaattttgggtggatacaaacattcattacataacaccctccatgtccaacttctcacaaagatattctctctaaataagccatcctcagaatttactccaacccttcttcaaatttcagcttaatcaccatttcttgaggaagcctccccttactgttcctcctccctgtctccagtgcagatcttcctgacatatcttcttaattccatgtacctttgctttgcagcaattacagaggtaactttcacattaacttttgaaatgatttgatttatgtttatctaagattctttgaagatacatggcatctgcttttgctcatcattttatcttcagaagctagggtttttcaaaatgtcagttgggactcattagtgagtaatgaaatgagattaatgggtaatatgcagtattttttcttaatgaaataggctaaaataaaataaacttttgtcaaagagaaaaaatgtagttatgatagaaaaataaaggcagccaataaagaatttgttttcaaacaagtcactgctataaggaattggaatgtaatcctacagggaactctggaaggcagcatagaattcatttaggttctgtacctgacaactttcaatcagtcgtgggctattcccagaacctttaattctcaggcactcgtagcccactatgcattcaggtagttcaggccctgaggaaaatagatacagatactatttgtatctacatataaatgcagtagaaaggcaaggcctgaggaagttacagtaagggcaagaagtagggaggagacttaaccacaaactggctgttttaggtttcactttatgaattcaatttaaatgagtatgtaagcgcattttgctgtttgaaacggggaaaaaaaagtcttagttgagtgatctccgtttaattatctttctctgataagaattgaatctgaacaatgagaacacatggacacaggaaggggaacatcacacactggggcctgttgtggggtggggggaggggggagggatagcattaagagatatacctaatgttaaatgatgagttgatgggtgcggcacaccaacatggcacatgtatacatatgtaacaaacctgtacgttgtccacatgtaccctagaacttaaagtataataaaaatatatatataaaaaaaggattaaatctggatttctttaaccttctcctcttgcaatctgtatttttaaatcattgaattattttcaaggtatttaattattttattcctttgtattgtgccttctgtaagagtcccagatatttaaggcataagaatacaagtatgcttcatgcatacacataatattagaagataactgcaaatttcccttgttatctacagcagattgtttctaggacctctgcaaatacccaaatctgcagatgcccaagtcccttatttaagatgaagtagtatttgcatataacctacatgcattctcgtgtacactttaaatcatctctaaattatgtaaatagttgctatacagtatttgttctttatttgtattatatttctctttctcttccttttgtgtgtgtgtgatggggtctccttatgttgcccagactggtctcaaactcctgggttaagtgatcatctctcagcctcctgagtttgctgggattacaggcaggtactcccatgcctggcatatttttcattgttgtgttgcacatatatatttgaaatctttttgatccatagttattgaatctgcagatatggaacctgtgaatatattagggctgaccccatcaagggtcaagatataataaaattaataatgttcactatttcttcaaggacattcttaagtgaacttagcttttattttctttcatactagcagtgttaagtagtgaagaatgcagtgtccaccagtaaagtctgtgcccagccttgatctgtgttgaggtacagcacttttacccatgtcagcttttgctccatcagtacaaatatcaacatagtgaaggcaaatatatcttactattattaggaaaaatatttggccttgaagaactccaaaaagtcttggggtgacactttgtggactattggcccataatactgtagcaggacgagccgcagacaaaacctctcagacaccgagttgtagacggtagggctttattcagctgggagcattggcaagctactgccttaaaatccgagctccccaaatgcacaatttgtgccccttttaagggctcacaacactaaagatttcacatgaaagtgttgtgattgatttgagcaagcaggcagtacgtgacaggggctgcatgcaccggtggtcagagagaaacagaacagggcagggagtttcacagtgttcttctacacaatgtctggaatctatgaataacatcagtttctaagttatgagttgatttttaactactgggtttaggccaggcaggcccaggcctgttttcgggcctgacaccgggctgcctgtctttggttttactgccttgttgttttttcttaaaacaggtactgagtataaaacaatataaaacaatatgagaaggtctctctcttccctcaatacacaaattttctaaacatatatatgaagcattttataataggaaacaaacgttatcattttaagaagatattaaatgtttaattgtaaactgtctttacttcccaaataagctctttttgacataccatttatcaatttatctaaactagtctttaaaaagtgtttatatatttaacctataattatgtggggagtaacaagctccacactgtgggacttcctaaattaaaaagtagttattttctcatattttttactttcaagtttaaactgggattcgttaaaagttaacatgaagaacaacatattatgaattagtaaagagactaaaagcattatgtagttttaaacatctcttgccttttggaatcatttctacactaaagaaaacagatgttaatgatgataatatcaaaaaaacagaaatggtgatcatcatcatattaggcttgttttaaaacagtaactgtttaatttgaagattccattttgtggtttatcaaagtaccacacaagttatttttatgcttagttacataatcctacgtattgtgggtcagtgcttacgatatcagcaaagttatttaatatatttacaatgtctcacattatccacctatttattattgaattagagtgattacagccacttcattttgttttgttgttgttttgaaatgtgttctgataaaaggaggttcattttgatcgtcaaccagaaaacaaaacatgataaaataaaaataaaactcaggaaattcgacaaatttcttgagagccacctacataaggcattttgtaagaagctatgaagtatacaaagatgtcgctaagtaacctgtaatctagtaaagataattacactgtagtgtataagaggaactatgaaacacaccaataaaatcttatgagagctcagagaagggaaaaattactttcaaagaagaaaaaatatgtattttcccttaaatgataaaatttgttcttatgtttttgctttcaaccattctttaaccatcagattttttcaattctcttatcttcgcattattaaacattttatacatgctgttcaaagtattattatcaagtacagtacaggcttctaaaaatatgctaaagccagatgtaaacagttgaaacagttgcaatactgtcttctctataggaaataaatataggtaatcagtgaataaagctagaattttaaaccgtttacttggaataaactgtggctgaaagccccatgggccgcatgaatacagcagccaggggtcttcagaaggtcctgtatgccagttatgccccatcactaacaggcagagtaactctcactgagcaatgcgaacataatattcatgttttccacttataatgtttaatttgtgtaatacacatacatatgtacgcacaactgaaaaatttggaattacaggtaaacttcattttcaagtaatttgaccattcatatacattcatcttctgtacacttgcaaaggtaagtataaaaacctaattttctgtggcagtttcataggctactttattgaaagtggctattatgcctgtttcctattttatgctcatttcctaataaaaccaacaatatatccaactacacagtattttaaagagagactaattataatgattactattgtaagaaagtgattctacatgaatatttccatgtttctgtagagcctgggcttttttagcaaaagctgatgaaacttggttaaagaatgtatattagtccatttctcacattgctgtataaacaactacctgagactgggtaattttaaagaaaagaggtttaattcactcacagttctgcaggctgtacaggaagcatggctggggaggcctcaggacacttacatcatggagggaggcaaaggagaggcaggcatgtcttacgtgaccagagaaggaggaagaggaaacagggggaggtgttacacacttttaaacaaccagatcttgtgagaactcacccactatcatgagaacagcaagggagaaatccacccctatgatccaatcacctccctccaggcacctcctctaacactggggattacaattcgacatgagatttgggcagggacataaatccaaaccatatcagaatgactgaatatcaaaatatgtcctagaagctacaaacggagcattgttccagagagatttacaaatatatcttccccagagccattcatttatattccagtgtgatagagagagaacttcccctccaatttccagagaattgtttacattctagagtagggtccttgtcattcttggggtaggatgggctgatatgccactgtccttcgtgggcttcaagtctcattctcctgtttaacaccactactagcattgagtaatatcaggctctcatcacatcaccttgtggtgatcagggcgcaggagccaatgctaaggtgctgtgtgaataataaatgctctgttctctgattcatagactcatgtttcctgtcagggtatctgtctgcctctgtgtgtttttttgtttatgtatccatacacctatccatctatctggttagccagcaatccattctaccatccatccatccatccatctaaacttaccaactatgacttacagaactggtttagattactcatacatcttatgagtttcttctcttcttagctttatcaaacaacactcaagctatgacaattgaaatggtattaccatttcataaaacaaatattgctttttaatttttacaaattttatctgaggattttaaaaataatacttctctgagtatactaattgaattatatttttcttttctcattgcttatattgcattctcattcaccaacctcagaattattattaaatattgcaaagcaaatattttaaaaagtactttaaaggaaatttttaaaaatatatattaatacttacactgatccacttagaagaaatacatatcaattacactgatccacttagaagaaaacctgtgtacttaactttattttcgtaaaatctgaaatttaatttaaaatcgagaactatttttttaaattaagacaatactttggaaataatattttaaatatatatatatatatatatataagagaacccactgttatctatgttacattaacctggaatttactatatcaaggaaattgtagaaaaagaatgcagtggagagagagttaaaacactagtcaaacagacaagacaacaccacaaatataggatttttactagaggtgcttttttccccccttaggaaaagtatggcttctctttgggaaaattgagattggtcacacttcagagcctttgataagtactttgatgttcaataagaatgaaaaaaacaatgttgcttttgcaaagagaatcaagaaaataataccagtttcagcaaaagaacattgttttgtgtactttaacacacactacaaggaatgtaaagaggccctttttattaaactggggaaaacattttttgcttaaaaacaaataggacaccagtagaaaaaaaaattaaactaaaacaaaacagcatgcttattgctttgtgtgtaataggtagcaaatatttttttaattgaatagaaggagtgcaacaaataaaaagctacatagaggataccattttactggaaggccaaatcgtgtccttctagtaaaaatgtatagttaacagagagtgcaatttgatgtgtgaataaatgaattattttgcaagaagagatattttgctaaatttgaacaatgacatccaagaaatgagatttctttgttgttctgctgggtttttcttttaatgtaattttgacaattttgattaaatgtccaaattcataatgtgataaattattgtggatgcaaaaatgttagtaaaatatttttaagagttttaatgaacctggtagatttagacagtaatagagttctgtgactccccaaaatgaggggacttgcctcttgatatcagggaggaaatcatggggcaaagctcatagaaatgacagctgtagctaagagcacctttctcctctaaagctgactgcagaacaaaaggttaaatgtagttgtcaagtttatagacagggaaatacttgtagtaaagtgaaagtaaacaagcatttaaaaagcttcaaagagagtcaaatccacaattcggggtgatttggatgaatttctctaatatgctaatctgcatggactaagtccatgggttagaggaaagataagctgaatttagggtgaaggggataggaacctctggacaaagggacaactttggctgatgatgcttagggtagagtaaggatagttttaggaggttctttcaatattgagagaggtttaattgaagaatatgcaaaccaaactagtgagattatgaaaaagagttcctagaaatagcacaattgtttgggtagggaaatattggacagaaaaagaatatggaaacaatgcaagaatcgttggaatttagagtgcaaataaaaagaataatctgaggaccaagtaaaggctggttaaaccaagtcaatggaacaggagcagccagcataatttcttattaaatagtttggatggtgtatcaggcctttattgcctcttgcctggattattttaacaattttcccatgaagttgtctgccttggacataatacatctctgatctatatccattagactacttccagagtcaaaagtctataaatcacaagttaacgatctatgtgattcaatggccaaatcctcacgcttccccatctgaaattaattcccataggactctacttggatttctatttccataactaaattacctcaacatacacttgttacctgattatatacatgtctgcagcatgaagttggaaactttgttaacgttacgatttttcttttcaatgtttttttctttttcttagtttgccaaactaaagcacagcagaacaacaacaaaatgttctttccctgaaacagagagagcccaggctaagccagagataacaaggagttgagactaccaaaagaatgctgacttctaaaggttgggctaagagaagagcttttatgtttaggtagaaacaggatgctgattttaaaaaaacttcttcattcattaaacattttccagatgtgagattgctcatttcattcgtctcagaagcttattaaattcccctacactatgttggaaattgattttcacttctggaatacagtgatctggaggcagagatgtgacatgggagaggaagggaaggtggaagaaaattagatattttcctaaagtgctattagcaagaaaaggtaaccaaagaatgagattaaacaaagcctttctggagaagatgacttgtgttggtggtaggggtattgagatgaaagaaagataggaataccttcagcagactgataattgtatacactttgaagtgtattttaaaaatagctgttccacgtttaatagatggggattatttactgttattaaaaataatatagagaagcagattaattgatgcatttatgtttattgagttgatagaaccaatattatggaaacaaactggcaaaacttttcttcccttttgggcgttcttgttctttcttgcattcttttgtgattgtttccaaaccaatgacttcttggtaactataataaaggtttatattttacttgataaaatgtaaatttaaatagtgttttttagaaataacctactgtggggccaggcgcggtggctcacgcctgtaatcccaacactttgggaagccgaggtgggcagattacgaggttaggagtttaagaccagcctggccaacatgatgaaagcccgtctctactaaaaatacaaaaattagctgggcatggtggtgtgtgcctgtaatcccagctacttgggaggctggggcaggagaattgcttgaatggggacccgggaggtggatgttgcagtgagccgagatagcgccactacactccagcctgggctacagagcgagactccgtctcagaaagaaaaaaataaaaaaaaaaaaaataagaggaaaaggaaaaaaagaaataacctattgtggtattgtggtatttttcagactcagaatttcagtccaggaaagggaataatactaatgagtgacattaaatgctcttttttaatctggaaaataagcagcaaatggctttagcttctaaattttctcgtcattttttttttcctttcttaccagtttgacctaaacaatcttagaatgtatagtagctcacagctcttcacagctttgtttatttttaaattttttttagtaatccctctttgaactgacttttacctttcattgtctatgattcttcccagactcctccatgcagggatcttgatgcagattcttccatcagtacctccagatattaacctgagaatggaaaatattttgcaaataataattttaattctccctcctctcaaaaggaacatagtttacccgaaatataacttaaatttaatgataataattaactttccaaattgccaataattccattccaaatatttcataacttattattaacccaaaccattttctctatactcttatttccctaaagtgtacacaataatcagcattcacaaggaaaggggtaaactgtttgactttactaccacttttaattctagctgcatttttaattttttcgagatagttttacaaacacaaatacatacctattgtattaatttctttctgatttttttttttaaaaacttttattaccagaggcctgttcatattagacatcaggtctgtgaagtagatatcaattcaacatagggatctatgtactgccaatgaataattgatccatgaagaggcaaaatcttcctaaatttcacagcttactatcagagaaaataatgtaaatagccataataacaaaaatggactttctaccctcagtgctcctatgattggagggaattcagttgctctgcataccccctttccttcctttagaaagaagatctggccggaagtgatggttcagtgtcgagtcctttgacaaagaccatcttaacttatttttattgtttcacctaagctgtgttttgtggtttcgaaagtgtctagcatgacctgtgaatctattacagttcaaaatcaattctattcctgtttccatagttcacattcatttccgtgagtattagggtcttcataaaacagcagttttttctgagtgttgatcctagctgattgaacgtcttcaagaacaagccactgatccttgttacacaaattgtaaactcagtcgaagtgagcttcggctgcaggttcaacactgcttacttaatgaaagcaaggaaaagtctcttttttccacatgttagtaaagggtttcaacaggctaaaaaaaatattgaataactctacataatggagaaaggcagtaataagaaaggaaaaacagaaaaatagaataagtagtctgtgaatcctttggagaatttactgaaaactagaatttcttacaatgtacacaaaatggctgtcaccaatgcaataagactttttccaaaaattgttctcacaactctaagcaactgaagtgttgcttccttcatcacatcatgtaatgaagtcaacagagtataaaatattccttgtgaaggaaaacttgatatcactataactttaagaaatattttgagggtgggtgtaagtttgtatctgaaataaataagtggttactaagctacaaacagatttttagccaacagccacactatctaaaatgttcaactctcctccatacatagacacctcctctccccttctctgctttattttcttttacttttacatactaaatattttatctagcagtaagtgtatataatacattatatatttatcatgttggtttcctgaatctcacatcagactgcaagctccttgaaggcaaatatgtattcctttaggttcactgttgtttcctcacctcctaaaataggacctggcatataattgtgctcaatcattttttcaagaattaatgaatgaggcagggtgcggtggctcacacctgtaatcccaacactttgggaggccaaagcaggtggatcacttgaggctaagagttccagaccagcttagccaacatggcgaaaccctgtctctgttaaaattacaaaaattagccaggcatggtcagcatgcctgtagacccagctactcaggaggctgagacacgagaattgcttgaacccgagaggtagaggttgcagtggctgagccaagacagagccactgcactccagccttggtgacagagcaagaccttgtctcaaaaaataataataataataataataaataaaaaagaagaagaattaatgaatgaaactggagagtctgctgcaaagagaatcctgaggttttatacttctcttccaaagaataaaagctgtctatcaattctagaataaagcactagcttttgaaatgagtaaagggatcaagaaaatctagtgctacctactggcagctttcccaatggtgggagtagcagttttaaagattcaataaacaatctccttgacataaaattcaacaatggcaaagttaagtgcaggaagagggcatgagacctattccccttatgaggaagagaatttattattaaaattatgtacaattattgtggtgtaatgataatgataaaattgatgggctttgctttattaattgtttatacatattgtgcagggtgtatatatgcttactgccttgtgtaggtggggtgggacacagctctccactgatacctcttcttctggctcccctgatattccactagaagggggtaatgagagattttgatacaacaagcattatcagttttatcttgtttgtttattccacagatatttactagacatgcaaagcaatactatttagtagatgcaaaaatagataagtaaagacctataagtttttggtttccaaagtcaaatgtttttatggtttattaatattgagaacactgagccgggcacagtggctcactcctgtaatcccagcactttgggaggtggaggcaggcagatcacttgaggtcaggagtttgaggccagcttggccaacatggtaaaactctgtctctactaaaaacaaacacacacacaaaaagttaaccaggtttggtggcgcactcctgtagtcccagctacttgggaggctgaggcaggagaatcgcttgaacccgggagatggaggttgcagtgaactaagattgtgccactgcactccagcctgggcgcagaacgagactccatctcaaaaataaaataaaataaaataaaattgagaacacagaaagatgagcaggtttgtgtggaaaatccttaaatctgtttgacaaattgagttgaaagtgttgaattccccagattacaaaagaacaacctgttaataaagcaatgctaaatgtattggaacctaattgcattcagaaactactggaaagagttttattgtctcaaaaagggaaagtcagaaatgagattttattaaattttggggtctgggatccaggagtttaaggtggatttttcaaggcagactttttcaggtgagcagactgttgtctctaaattgatctgcaagaatttcctgaagcaaacagtagagttatttataggattacagtcttatcttttctgtgtataggtttactggaacaaacaagacaactgtggtcccagttctcagaggtagcttttgagacctccacatgcacatgttgaataaacaattggaactcagagggttagtataaaatttaggagtaatcactatatagattatcataaagatctggagatggttctgttcaagattgccaagggatggaactgaattcctgtacggctgctccccacttgaaaagccagacacaagaatcaagagttggtgggaagaaagaggtttattgaagtgctagcagctgaagagacagctggagtcaggtctcaaaaagccatctcaaattctcaggctggctaatggggtttgaagaggaaggcggcatggaaactatgtgcaggagtgatgtaggttgcaggtctgcttgtcattttccagtggctgtcttgaataatgaaccatctggaggccttggtgtcaacttgcttaggtcagggtatggattaactgtgcaccaatttcttctcagaagggagaaaactttaactgccatctccactttacgcctgagttgctttaagattagcctttggaattctcaagcaaacacgtagttagatatatgtatagcaagaaaaaaaatgaggcagggattactttttaaagcaagctagcaaattggctgtactggttactgggagagagcatcaatgagaaaagaaatagattagcacagagtattgagaaacctcaacatttaacaggttattgttggcagacgagcattcagtggagattgtaaagtggttagaaatgtatgaggatgaacaggagagggtaaggagggtacttcaagaagcaaagagtgatcaacaaggccaaatgatgctttgtgttaaaatcatatgaggactttgaaatattcatttagtaacttcaaggtcattattaatcttagcgtgagcggttttggtgatgttattgaggcaaaaaacagagaaggttgaaaagtagtgaatggataaaaaatgaaggtagttcaataatttgggatgagaaagagaagaaaaagataaattcataatgtagaaatgtgagaagtaaaatttttaggcaggagagatttgaatatatgtatattctctgcttccattatcactccataattttataagaaaaaggtaaatacaccctttcatcctctgtgatttcttccttccttccttgtgtctattgattctttcatttactataatcagcaaacagcaggcacagaccatggccctaaggaacttacagaagttaactcatagaaggccaatatgttgggaaaaatgtgaataagtatataaatatcctatcattgcataattagtatgaatgcagattaagtttgagtttttctgtaatactccaaggcgaagagttacgctgccttctaatgcaagtatttggctgaaaattggattgtgttttgaagtctctgtactaaatttcctccagacatagctggcatatacagggacaaaaacttttgacctggagctcattagtgcaatgaagcattcaagtgaactagcaggtacaagcctgaaacaaacaaacaaaagaaaaacatcaattgtttgattaattgtaaatgcggaagttgagggtagggaagtaaaatttcaacccatcaaggaagtagtcactttaaaattcacctgaaatgactatttcaaaacctgcttccatttcaatgctaaaaatatttcttttccccaaaccccttaaacggaaggagttataagtgaactagaatacacataggaagtcatgctgcattctcatgttgctaattggaattttgatgaatataatataaaagcaaaacaagagcaaagtgtttccattagttcactacccatgtttctgcaccttaatcagagcgttgttaatatttaaatatgcgtttgaagccccaagtgtatagggaggcatggaagtttcattaataactataatttatataaaagaatatatgccaaagacaaatgctcaaatatggagtttcataggaatttttcaaacgtattttatagctcagacatggaaaaagaaattgcagcaggatatgaacttatgcttagctactaagatacactatggcttatcatttattgagaaaagtccagatttttgtcttaaagttatatttctccatcagttatataccacttttttttttcacataaggctgtttggaaacaggcaaataggaaaaaaatctgcaggaaaaagggacattgacataatctgaaatgccttgtattctgcagatttcagaactatacagctttcaaaagggacataagggagcagagagaactgccactctagagctgtgactcttttctccttcagtagtcatgctttcaaatgggtccttctgcagaggaatgacttgaagtaacaatcaccattccctcttcacagcagtctgccacagaacaaaacttcctggaataatgccagttgaaatgactaagtgtgtcttttctatacatccacaaggatacttacctagtgccttctgggttctaaaggagaggatatagttcattgttaacaacagctctaagtctctcttactatgtgaaacttactcttttattaaccagaggaaaggaatcagagacttccaacacattacaattatattcaaacatacttccattcttaggatgagctctgactcaaatattgttttatgctaagtactagtatggagtatgccttcaacattaaattcactgtgaagaaacatttttaaagtaatatgataatcagttatgagatgccactagatatcctcaaagctattatgcaaagagcgagaggaaactttaaagcaaaaacagattaagttcttgcagttttcataagggggttggtttagaattcctacagtcaaataagctgtgactgtaatggttctttgagttgatgcacagattgtgcaaaatcagccctacacataagcagctagcatgtgtaaaaagtctacctgactcaaaatatgagtcccactaggctatcacacagtattatatcttggaactattgtataagaatgaagacattggccaggcacaatggctcacgcctgtaatcccagcaatttgggaggccaaggcgggcggatcacctgaggtcagaagttcaagacaagcctggccaacatagtgaaaccccatccctactaaaaatacaaaaattagccaggcatgatggcatgtgcctgtagtcccagctactcaggaggctgaggcaggataattgctagaacctgggaggtggaggttgcagtgagccaagatcgtacaccgcattccagcctgggtgacatcgtgagagtctgtctcaaaaaaaaaaaaaaaaaaaaaaaaaagaagaagaagaagaatgaaaaaaacacattcttccaatgtcctacaagacccaacatcataagtactctctgctccctttcacaatgaatttcctacacattgtattccattcctggatcactctactgcaggtagaagctactttgctgttcactggaacattctctttacaatttcatctaaagacctttgcctgaaatgttctcccaggcaaaatagcctggctaactctgttagctctttcgttgtttccttgaagtttatcttattaataagcctgccccgattgtattattgaatagtacaactacccctctcctcctttattttttcttttcctttcatgcaattttattgagatataattgccaaataatttttataagtttaagatgtacaacacgatgatttcacacacacacacacacactacatcacacatagatatatattgtgatatgattaccacaatcaagttagttaacacatctatcatctcacctatttgccattttttgtttttttggttttatgacaggatatttaatataatatctactcccttaccagatttcaagtctataggagtgttattaacaatagtcactgtattagtctgttttcttgctgctataaaaaacttcctgagactgggtaatttataaagaaaagaggtttaattgactcaccgttttgcctggctggggaggcctcaggaaacttacaatgatggcagaaggggaagcaggagtgtcttacatggtggcatgtaagagagagcatgtaagtatgcaggaaaaactaccatttacaaaaccatcagatcttttgagaattcactcaccatcacaagaacagcatgaggggaaactgcccccataatccataatccaatcacttttctccctccacacatgtggattacaggtccctcgcttcacacatggggatgagatttgggtggagacacaaagcaatatcataagctatggggatctaatgtacagcattatatataaacacattttataatggaaagtttatatgcttcgaccagcatctccccatttccctacccactgtcccctggcaaccaccattctattctgtttctaggagtgtccccctcctaattcttctttaatctgagttaatattttttgtagcacttatcacaatctaacataaaataaaatttccatgtttattatgtttattattgtttgtctcatttcctgcatgagacaccacctccaccatgtaatctctcttcgtaggaatctttgtcttctttgttcactgttgaatcccaagtggtgaaaactctgcctgacacattgtaggcacttaataaatatttatggaatgaatgaattaatgaaaactatgaactatctttttatctcattaccctgaaatgcactagttacatactctcctatactaagtgttaaaaagaattgatttattatagtaacttaatttcctattaacagagttcctactttaggttcaggcactgacaccaggaggtccttaaagtaatgcattttgataagtgaaataacccattgacatacccactagtaactacttgcatattgaatttatcaaattacctaatttgtattaaagagagcaaggatctgagataatcaaactaagaatgtagtttttgatgaggagacttgagaaaaagtttgctgctggagtgtggtggaggcatacctgggtgattccagggcacatccaaaaggaaggagagagggctaggtgttgactttggttttggaagctggaaagaacatagttggggaaaataatctcaaaaaggggaggtggaacagaaagaaaaagccattccctttttacagttgtagtaggtccagcctggcttgttgcatttcaacaaggcaagaaaaaaaagaaagaaagagaaagaaagaaaagaacgaaagaacgaaagaaagaaagaaagaaagaaagaaagaaagaaagaaagaaagaaagaaggaaggaaggaaggaaggaaaagaaaaagaaagaaagaaagaatagaaaaggaaggaaggaaggagaagaaaagaatgaaagaagaaagaaaaaagccttttgttgtcatcagtgtattaggaaatgggaaacacacatatcaaccacagggaaaaagaattacccaaacaggaggttcattttaccctgctcctttcagtgaaagaagagagaattaaaaaggaggattaagtaggcatgtgcttagagctctgatggaaaaagcatttaaaggcagaattcacattccttaaaaggacaaatacacggcttttttctcccaaattatccatcaaggtgattttggtcacatgtgattcattagtttagagaaccaagttacttggctgtatttcagatttgaaaggagagcaacagtgggctgtgttaaatacatatatgtatttgcaccatttctatcctgatgacaggtggcaccattccaagagccaatgtttcctttcaaactatttctgagtacatttaatgatttaaatatgttcttaatcaatttattttttcctcccaaggtatcagaagtcctgactcaattcttcatattaacatatgcattccttactaagaaaccagaccataactaagaagggatttaggtatgagaagtctaaagctcattaccttaatttccttttttataggttaagcattgcaggatcatttttgagattctaatttttgatgtaatattttttaattaccgaatgtgggctttttatatctgaggtgatttttttcttttaaatcaatgtgtccattaaagaatgtattattgcacaccagatggaattaaatgaaccattgtgtgaacttggcattttcagatcgggttacctgaatgtaattacctgcaggcagtttccaaatctgctgttcataagggattagcttgcgtatagagattctcttccattctcctcaggttttttttttttccttgaaatgcttttagtcattttggcttattgtaccatcatgctctgccactgataatagtgaaaattaatcctgaactaccagaattgatgatacagaacaagtcgacagctgtttaaaaaacaaacagacaagggacagcttatagaagagaacgttatgattttgtgccacataaaatttgaattgtctgccacaattctaataatactgaaatttggagaaatttctctatctattaaatagagtttctttcagaaatttatccccaaactgcaatgctgcatttaatttcctgttgttattttaaaatcacatcagttgaagaatatgaatgtctacacattttgaatcacattccaatttattttctttgcgagtgagcagaattatatttcctgtgagtcatctcttcatatagggagtataccctctgggtggcatttattgctggtgtgtcaatcaccttcttattttatctctttaagtagtgaagagaggttatgtgtctgtttcctgcattgatgttaagtgcacaattttctctcactaaataaatatatatttaaacaattggaagaatgggatttcaaaattccattttaaattctcagcagtaaatcagttttatctttccctttaaaagtgaaatatatatatatatatatatatatatatatatatattactactttcttcaagcagttggtgaagagcatctaacctgagactgggaaacatcaagttaatagaaacaatataatttataattttacatgatttcatatattatttttctgttagccttgtaaactttccaatgactcaagtgatttaaatgatgtgtgaatttttttagtaaggagttgaataattagctttcagagaatttaactagtatcattctaaaatacatgatgacctggaaaaatataataataatgaacataaccttacagaaatgaattatggaataatgatagataatcaaatatatgccaccagtttgtgaattaatgttagattatgttgaaaataggtcacttccaaagaagccattgttttcattgttattaatgtagacttgaaattgatattatatagttagtttctaacttgcaagccacaagataaagatttaggctacttaaagcaaaaagtaatttgctgaatgtatgctggactcattaagaggagtctcaagaattaaacctcgaaagccaaagggagcataactgctctggaagactaggaagcagggatggcaggaatgatcacatagtatctttttttaaaaaaaacagctttattgagatataattcaagagcataccactcatccatttaaagtatgtttcaaccattccttctatccttgtgtttctcattcaagagtccacatcttagagaagcatctgttgtccaggcttatgccatatctcctccttctgctggtgtcagagctggtgaggggcaaggcatggctggagtcacagcatgagatgagatatccacaggcagccacctggatttactattctgacaagcaagatataaaaaattaggcaaaatttatttttagtaatatgctgataaatatgttgaacaactcgttctctcccacccccaaaaaaccctgtttgttttgttttggatttacagatttccatcatgtaaatactccaatcgtaatagtaattttaagctaccagtgtgacagtatgtggagttgggtagggatgctaatcattggttcttgtgagctggaacaagctgattacagcacactacttagtatctccccaaaagaacatgggtactttcaggaaggggaaaatgaatgctagccattcaaaatgtacacacacacatgtaatgagcaaagatcttattgaccttaaacacagagccattcaatatgttgtttttcataaattagtgactcagtagataagaatttgggtgcagagatgttagagactactcttacgttttatttcataagaaaatagaggctactgtcccttgtcaatttcttaatttagctcaggaactcaaatggacacattaaaaatattaatagtaaaattgtaaactgttttggtagggagaattctaagatgacctccatgacactcacctttgttttttttcccccattaatatgttatattcatggcaaaagggattttacagatgcaattaaggttactaattaggtgactttaaaataggaagatcacacaggtgggcttgacctaccatatgggtcttttaaaagcagagaattttctctgactagtagaggaggaaatcagagagactcgaagcattagaaagactcagtgcaaaagaggcatgcattgcatgtgggaaggacctgagagcagcctccaggaaaggcgctaggagagccagaccaactactgactgaaattcatcaaggaaaacatggcctcagtcctacaactgaaaataacagaattttgccaaccgttagaataagtttggaagtggattatttcttagaataccagataagagtccagcctacccaataccttaatttcagttttgtgagtccctaagcaaaccatccaggctgcccagacttttgacctatagaactgtgagataacaaatcggtattgttataagctgctaagtgtgtggcaatttgttatacagcaataaaaatctaatataactatctataaggaggtgccttaaataaactttggcactacaagcatctgaacaaacaaaaggatctgtatggaataaagcgaaagaaaggcttttaaagaacattaagtcttaaatcaattgttagaagaagacaattggagtaaggaacatgaagtaagtggaggataaggggtggacaggtaatcatgtcagcgatgattattggcataaaaaagaaaccttactaacggaaatataagaagacaggcaagattgcattagagagtcataaaagataaggtcaaagagctgaggttggtaaattgatgaagatctaaaattctgtgtcaataagtgattctcaacactttgaggaattttaacccatgaggacattttagaaaatgaacaccagaatagcacttcagaaaaactgaatcagaaattctggcatatgtgacagcatctacatttttttaaacttctgtaagtgatttttgaggtgcagccaaggttgaggtccactagtgggaattctggaattcacagatatctaaggactatctatggactaaagctatgctagaaggtacagcctctctccctccctccctttctttatttcttctttctcaatgtaagaggaagacatgagtcaaccatagctgaattataatattgctgggtttttttacagcaaaaaaatgaagaatattataaaagtcaaacaatagaaggtgccaaacatgattcctattgtaatggaaatttatgccatattatttcattaatatagtttttaatctcatgcaaactgtttaaatgtatatatctgtgatattttaataatgtcccaagtttgatttccctagaagcagactctgagatatatattaatatataagatatttattagaatgttctcttgatatccacatggaaggaaggaaagatgattttgcagaaagagctgtggagcactccaaagatagatgtcacccttcatagttgccccaaattgggcaagctgatgtggccttatattcctactgtgatctataattgaaggtaaactctccttgaaaaaagcagttttcctcacctgaagccatccacaatggagaatgtccactgagagccatcgtcacacggaattcttggcagctgggagaataagatttttaatcctgagaaggggtggtcaggactgcacatcacagagcccactacaaatgtctacttctagctggtaaacatacaggatgcatttgcttttaaatgtatttccctaattataaaaaaaagcctgatatctacaaatttgttcaaaatattttaccaaggatcctattttcaaaatatgtttgaaactagttagcaactagttatacaggtgatggtataatttaatgagataagaaatatggaaagaaggatatttttagggaagaggatgtgtacaatcgttgataagtagagtttgatgtatttgcataaaaacaaaacaaattttaaaaatacacgatttcatgatttcatgtgtcattttagattcagccctatttttgaaaagattgccaatagttgaaactttttaaacctaatatattcttacctcacacagttgtcagtttttttttctttgaaatactttttttattcacttctgggatattatattctctaggttttcattttcctcattctaaatatctttcagatggaagtgacagattctttctatgcttttagatatcagaaatttcacatttgtgattaactcagttctacaattgacatctttaccctcctcccaaacaatacagggacctagaatattttaattccaattaaagcgttgttacttataatttctattcagtgatttattttaatttttacttaaatattatttttatataatcaatactttctttagatttatccataagtttaatatttttaattaaacaatctttcttcctgcattttctgggatattttttcttatttctttttttttcttttttttattattatacattaagttctagggtacaagtgcacaacatgcaggtttgttacatatgtacacatgtgccatgttggtgtgctgcactcattaacctatcatttacattaggtttatctcctaatgctatccctccccgcttcccccacccaacaacaggccccagtgtgtgatgttccccttcctgtgtccaactgttctcattgttgaattcccacctatgagtgagaacatgtggtgtttggttttctgtccttgcaatagtttgctgagaatgatggtttccagcttcatccatgtccttacaaaggacatgaactcatcattttttatggctgcatagtattccatggtgtatatgtgccacattttcttaatccagtctatcattgatggacatttggattggttccaagtctttggtattgtgaacagtgccgcaatagacatacatgtgcatgtgtgtttatagcagcatgatttataatcctttgggtatatacccagtaatgggatggctgggtcaaatggtaattctagttctagatccctgaggaatcgccacattgtcttccacaatggttgaactagtttagagtcccactaacagtgaaaagtgttcctatttctccacatcctctccagtacctgttgtttcctgactttttaatgatggccattctaactggtgtgagatggtatctcattgtggttttgatttgcatttctctgatgggcagtgatgatgagcattttttcatgtgttttttggctgcataaatgtcttcttttgagaagtgtctgttcatatcttttgcccactttttaatggggttgtttgtttttttattgtaaatttgtttgagttctttgtagattctggatataagccctttgtcagatgagtagactgcaaaaattttctcctattctgtaggttgcctgttcactctgatggtagtttcttttgctgcgcaggagctctttagtttaattagatcacttttgtcaattttggcttttgttgccattgcttttggtgttttcgtcaggaagtccttgcccatgcttctgtcctgaatggtattgcctaggttttcttctagggtttttatggttttaggtctaacatttaagtctttgatccatcttgaattaattatcgtataaggtgtaaggaagggatccagtttcagctttctacatatggctagccagttttcccagcaccatttattaaatagggaatcctttccccattttttatttttgtcaggtttgtcaaagatcagctggttgtagatgtgtggtattatttctgagggctctgttctgttccattggtctatatctctgttttggtaccagtaccatgctgttttggttactgtagccttgtagtatagtttgaagtcaggtagtgtgatgcctccagctttgttcgtttgaattaggattgtcttggctatgcaggcccttttttgattccatatgaactttaaagtagttttttctaattctgtgaagaaagtcattggtagcttgattgggatggcatttaatgtataaatttccttgggcactatggccattttcatgatattgattcttcgtgtccatgagcatggaatgttcttccatttgtttgtgtcctctttcatttcattgagcagtggtttgtagttctccttgaagaggtccttcacaacccttataagttggattcctaggtattttattctctttgaagcaattgtgaaagggagttcactcatgatttggctctctgtttgtctgttactggtgtataagaatgcttgggatttttgcacaatgattttgtatcctgagactttgctgaagttgcttatcagcttaaggagattttgggctgagacgatggggttttctaaatgtacaatcatgtcatctgcaaacagggacaatttgacttcctcttttcctgattgagtaccctgtatttctttctcctgcctaattgccctggccagaacttccaacactatgttgaacaggagtggtgagagagggcatccctgtcttgtgccagttttcaaagagagtgcttccagtttttgtccattcagtatgatattgtctgtgggtttgtcataaatagctcttattatttttatatacatcccatcaataactagtttattgagagtttttagcatgaagggctcttgaattttgttgaaggccttttctgcatctgtggagataatcatgtggtttttgtctttcgttctgtttatatgatggattatgtttattgatttgagtgtgttgaactagccttgcatcgcagggatgaagccaacttcattgtggtggatatgctgctggattcagtttgccagtattttattgaggattttcaaatcgatgttcatcagggatattggtctaaaagtctctttttttgttgagtctctgccagcctttggtatcaggatgatgctggcctcataaaatgagttagggaggattccctctttttctattgattggaacattttcagaaggaatggtaccagctcctctttgtacctctggtagcattcggctgtgaatctgtctggtcctggactttttttggttggtaggctattaattattgcctcaatttcagagtctgttattggtctattcagagattcaacttcttcctggtttagtcttgggagggtgtatgtttccaggaatttatctatgtcttctagattttctagtttacttgcgtagaggtgtttatagtattctctggtggtagtttgtatgtctgtgggattggtggtgatatcccctttatcgttttttattgtgtctatttgattcttctctcttttcttctttattagtcttgctagcggtctatcaattttgttgatcttttcaaaaaaccagcttctggattcattgattttttgaagggttttttgtgtctctatctccttcagttctgctccgatcttagttatttcttgccttctgctaacttttgaatgtgtttgctcttgcttctctagttcttttaattgtgatgttagggtgtcaattttagttctttcctgctttctcttatgggcattgagtgctataaatttccttctacacactgctttaagtgtgtcccagagattctggtatgttatgtctttgttcttattggtttcgaccataatattttaaaatgtgtcttctttcttcctacatggaacttattaagatttctaattctgaggacttgcatgttttactaattctaaaagtttctcaatcattatctttttcatattggttctgactcattcactctgctctaattctggaaatgcagttggttctatgatagactattctttctagctgtacatctcttaacctgtttttcatatttttcatttcttatctccctctgttgttttctaggtaatttcttaaattttacaatatagattattaattttctattttgttatatgtattatactatttaattaaactacagtttctaattataacatttttcattactagaagttctccctcttattcagtttcaattattcctggtaaattttgatagtatactattttttagtcatatttcaatttcctcatttttcttctttaaacttattaaatgtgcttactatatgatcttatctgatgaaaccattattaacattctttcttattttgatactggaaccttttgttcacttttgtttttttgctggctatcactcacagtcattgatttgattgtttctttagagatttttaattgtgagttagttgaacatttttgtggatttatttgaggcctgaagttgaagtgagttctcaagagatacattttgtgttactccttttcttcactggaggaggtcatgattaactgggtaatcttaaaacttctttggcttgtgtttttggatgcacagatgttgcgaagtccagctgccaaccataaggtatgcgtaatataaataggtatttctaaagcagtttttaacagtcagggtttagtagaggaaataggaaatactttgtatttcaagcagtaaagaatataataaatggaactaggtgctcagaaaattattggaagtgccgaagaagtggaaatcagggggcatgcctagactttcaaaatcaccccatcatggttacgatacagaggtcctgaataacttttgttattgccccaccactgggctgctacagataccttatcctcaagaagctagtttctagacatttaaacatggactgcagttgctgcaaatattcctggtgcttgtgtgaacgttgcatctgccacaggaagagtgcttcatttctgccttctatacctggtataaattgacacacaggaccatggcttccagagaatctaaaaattgagcttttagattctccaatagagaatagaaggagagtaaacttctccaatagaaggggagtaaactgaatgttgagagagccaatccaattattcatcactttttttttttcctttttcttctatgtgaaggcaagatagggagacaggcatgtgtacccgccactttatctattgtttgtattacacctcatgcttctttatatgcttttgatcccagctattttcttctgttctgtcctaagcagttaaatctctaggattgacccaaggaagtcactggctttatcattcagttacccttacgaacttgacttttcctatccaatacagattttctgaaatccctttatgtttcatcaggctcaactgtgtatatagaagatgttttaaaatactggatctggtagttttacttatgatatacagaatgggtttctatcacatctgtttgctaaatgtacaactatgtcttaaggacatttttttctttttatattttttgatatcttaatggccagtacttcttagtctcctttgctaattcctcttcttcccagctgctaagtgttggaatttcctaggaaccagtcttcaggcctcttctcttatgtatttatattcttttcctaaatggtcttattcagtatggttttttaaatgtcatctttatatgctggtgacttccaaattaatatattcaagttagacctttcccttttgctccagatcatttatacaaagactgcatgatattccttcctagaagtttataaaacatttcaaacagacattaaaggtccaaaatataaattttactttctccaacctacccacaatggattttccctcagtctttttcacctcagtcaacaatacagtaatgtgttcagttagtcatacaaaaccctaaaaattatcttattctcttttcaggctgtctagtatccaatccaggaacaaatcctgtcagttctatcttaagtagaatcatttctcaagactctcccttgtatagtcagtatacaagactattgtatatatatacaatggaatacattcagccataaaaaagaatgaattaatgtcttttgcagcaacatggatggaactgtaggccattgtcttaagtgaaacaactcagacacagaaatataaatactgcatgttctcacttataagtgggagctgaataatgtgtacacatggacatagtgtggaaaggtagaaaatggagactggaagggtgggggtcaagtggggggatgatgagaaattccttaatgggtacaatgtacattgttctggtggtggtagatatgcaaaaggccctgactttactactgcacaatatatttatgtaataaaattacacttgtaccccataaatttatataaatagacgtgcccactatcatactagtctcaaccaccatcatctcatacctgtgcttcaataataggttaatagaaatccaagtaggtgactgaagaaaactaactagtttctcctctactgtcctcctttaaaacgtgtcctggccgggcgcagtggctcacacctgtaatcccagcactttcgcgccactgcactccagcctgggtgaacgagcaagactccgtctcaaaaacaaaaacaaaaaaaaaacaaaaaacatgtcctttagcaagcaatatgcacttttaaagatgtaaatgagataatgccacttatgagctaaaacctccaatgtctttccaccttatttagaatgaactacaaactctttatgtgatctgcccctgtttatctctgcagcatatcagtgatatattttgaatttacccctttgcatgccccattctagctgcactgacattattttcattgtatgaaaaagaaagtccatttcatctgggatactctttccccagttctttgattttcccactccagtactttattctgatcctaaacaaatgtcatcttttaggggcatttccttataacactatctaaaataaccactcttgcacagctacctaatatcttatacatatgagtcctttatgacatttatcacaatctaaagctattacatatttgttttcttttgtattatctacattttcaaatttattccaaatttcatgagaacaaagttttggttttattttatttacctttatggcctatatatatgttgattaagtgcatggatggatggatggatggttggatggatggatggatggatggatggatggatggatggatagacaaatgatactcaggtggagctgctcaggatcagtaggttatgtgggaataatgtatatcaggatatatacaggattacagatttgaaaggcatgaattcatcaatcattcattggactggatgaaatcgtccagggatagcacagcaaggataaaactctagagaaggccgatacttattttatgctttctaaagataaaaccatgttgaatttttttcttgctgcagttttagtacctactatagtccttcatataggagatgttcaatcaatttgacttatttaataaatgaattaaaaattggaaagaatatcccaccaaagggaatatgaagcatcaattagagacttaagaggagagctaaggaagtatgagttagttgaaactagaagataaaggggtttcaagaaggaagaactagtcaggaatctgaaaaactacagaagagtcaaataagataatgtctcaatacaattcattacacatatcaagaaaactggaggcattgacattatgactattagaagacatttgtcgctatactaaatattaatacattgaatttatatcagtaaacacccttagtctatagtatttaaatgctcccttcattgcatgctggcatttcctagttttgaagaatgtctctatgtttttgatatctgttaataataatatgtctaagattcttctttagattcaagatctgagtcatgttatcaatacattaggtcatgctatcatgaaagaaaactaataatagtttctcaagatcctaattaaacatttggaaagatagtatgaaataactatttggaaactaataaagagatgactctgttattactgaatatcaaaggatggcaaatttgtgaataagtccccagatttgtctgcaacagtcacagtaaaaatttagaattaacaacagttaaatctcaagaggataccacattaagtgcaactgttaaatattttctcaaggacacagaccttaacagaaaatggtggctactaaaagctgactactatgcaaatatcttggcaagacattgggtatctgagtcccctacaggacacagctgtgataatctttacaaacgtaggattctgctagggataggaaaagagccaggctcactggagacttattgcgaaaaaaaaaaaaattgtactttttgtgcagcttctgctctctgaataatctgattacatctccagggcaatttatatggatcactaaactggccataaaatattataaaattataacctattattagttctgttcctttactcatataaacatttattacaggtaaaatacctggtggttgtgttagacccagataatactaatatttaatcgcattaggtttaagaagaacaaacaaaagtgctttctcctgctcctttatattcaggcttgaaatatcatttaaaataacatagtagtgcatgtgattctgtttaaggggaggttcacaaaaccctatctctcctagttctgatatcaaagttagggagtgaggtggaagacccttatttctccagaaataagagaagaatcaggagttaggagactccatctctgcttcagatctgtccatcccatcacatgggtgattaccaggcaaggttcttcagtgtccttagattggagagagaatatctgcactgattatatatttagttaattgctacatacatgtattgaaagaaatattttcatttcttcattaaaacatatattttatttagtatttgttttaacacatattaatttttaaagtaatgccagcttattataaatatcaaataaaatagaaatttacaaaataaaaaccaagagtcctacctcagttctaccctactcttcaacgctactctccctggatcactactgtgaatgggatgcactttgtcttccatatatctgtttagatgagtctgtatacacacaattccatgcaaacctataggaaggccatttactccatatagacaaccctgtcagaagaatctttcacaccttctctttcttttcaagtatatttcttctcaaatcttctaatctattccccttctctgaggtgttgattggaagaggatccagacaaggtagtgatagattacagaacacagcagctggggccattggtgattttgctccctgaagtcagattactgaaaggcacattctcatagctgtctccctactcttgtctcttttcagtaggagtagccagaaaaattatcttaaaaagtatatcagatcatttgtcttctctgttcaaaactctccaaaatctcatttcattggcaacaaaaacaaaaataatacaacagcctcagtgcctgctgctatctaaccccccccccatttcactcattatctctccagtattatatcctctgcttcccccttttccacttcattctggagactccagagacactatgttccttgaatatttctctctgagaaaatagacacaatcacaaaaacaattgttttattctctctgcttgggagttattctctctgcttgggaaattcttctcccgtatatagccatggctcatttcctgacctctttcaagtctttgctcaattattacattcttggtaacgtggacccagacctctactcctcattcaaaacagcaatcatggcctcaacactcctgataccacaacctgattctttctttttgtaacattgatcacatacaagataggtagtatatattgtacctttgtacatatttgttatgtgtattatctggcattctccaccagaatataatctccaaaagtatatgattttaatcagcacagccctagagcctagaagagtggctagcaatagcagccattcaacaaacatttgtagaataaatgaatgaatacatacacatatataggagttaatatagcaaaatgcattagtgtgcaggaactagagtcagactggtagactctatcaattatcagctgtaaatataaataataattgatccataagtatctaaaacatactttacagggttcttaaaagggttcagttagcaattaggtaatagttgtaaagagacacaagttatttttttctggtcagttcttcctctttatggaactgttcttcttttccccctagctattagtttctataaaattgtcatgttcttactctctaatagctttcattttattcagagtcagagctcgatacttacaagagccccttcagggtgaaagctaattggtctacatatagcatctaacttaaactgagaaatataagacttgcctgaaattttgaacttcagaacacagaatgtattgccaacccacttcaacgatagtaactataagaagtacaactcaagtggaatcgctgtcttgtttctgaacacatggacaaaatttgacttacagaagaaagacaattaggcccactcaaagataagagaagttaaaagccagaaaaagagtgtgtgtgtgtgtgcgtgtgtgtgtgtgtgtgtgtgtgtgtgtgtgtgagagagagagagagagagagagagaactgggaatgtttgcattcctacttccagttggttctaagtcctagctgcatcctgtcatacatatgtgtaagtcatttaatcccctttctgtatccacgcagccaataaattgctcttcttttttccaaagaattttaagttgtttctattacttacaaccagaggagtctaatatataccacatgttttgctaggattaataatattaaaattaaggcagtaatagggattatgtattccctgtagtatctacaagagagctgttcataaagaaatttgttataatgttatattagcaaaagacattccaataatatgtcacattgttttaagacatgccaggagatataaattagttaagaggcataggaatatgttcttgggtacagactctttccacaccatcctttgagaactgcctctctacgttacccagaaagctatagctttcttgttttcttggacctaggggctaaaactaaaactcctaatgagacgcctttctttatgcagccttttcttctccccaggtaattaatcacatgctcttcagaaggctttgcttgaaacagtccctttttgatgtgctgcgatcaccaccagtcataactaaatgtaatagcaatttctccaaccatactggctttgataaaacatgctttattcctagaagattaggccattcattcatcatgtatttgatgataataataatgataatgatctgttgactgttagcttctgggtgctctaagccttttttagcttttaacacaaattacaggtaggcctcccagccacctgtccctttaggaaagtaaacagctctctagaaagccttctgatatgtttttttaactcattctagagtagcactttttaaactttaatgtgcagttgaattgctccaggatcttgtaaaatgcacatctgatttagaaggtatagaatgaagcttgagatactacaaccctacatactaggtgatgttgatgctgctggtctatagactgcacttttgattaacaagttccaaaggatttattatgtactggtcctgttcagtgctctaatgtaatgtcaaagttccataaacttttcagtgtgtctctcctttacaaacagtaacttcccaccatacatttttttaaaatcacatgtggcaaattcaaaacctttttcttgtcttccccttctgagaactgaaacaaagaacccctgtcatacaggcatggttcttataccactactagtatcctttgtaaagacaatacttaaatatccactgggatgagcaaatcaaaccatttcctcatgtgtggttgtaaaggcatagaagagtttattttcattgtgcattatctttcagacttaacttagatcttattattcacctggaaaatggaaaacacttgcaaagaaacatccctggcttctctgtttttgcacttttatattttatttctcctaatctgaaagtttacttatgagtcaataaagtttcttctttttatcttgtatttaagtcttatacaaggagaacctaaaaaaaaatgttattcactgatccagtaacttaataataatagcatcatttcttgtgggggaaaatttacctttttcagttttgaagtgccatccccagacagtgatagctagtacaatagatgcagttcccttgtttgtcatagactctactggaataagagataatcaaaggatatactttcttttaatgtggacatattgccacataatgtctttgccctagggaattcatagcaagatgtagaaagtagctcttctaggtcactttgattccagtccaagttgcttgtgattaatactgctaacatcaacagctgctctagtactaatgtgaaatacagaatggtttcagtctagttcactgtagacaagttcccacagcatgcaaattattaatgcccttgtagacagtgttaggactctaaatcgttttgaaactgaatgccagacctccctagagatgaaccctatgacaataagtcagcttcactggagacttactgtgaaaaaaaaaccgtcgcactttttgtgcagcatctgctctctaaataatatgattagacctctaggacaatttatatggatcactaaactagccataaaatattatgaaattatgatgtgttattagttctgtccctttacccatataaacatttattacaagaaaaggatctggtggttatattggaccctgataatgctaacatgtaatagcattgggtttaagaagaacaaacaaaagtgcttgcccctgaagaaagcagtacagttttagtcaaaatcatgacctattaaaatttctggtcttgggaggctgaggcaggcagatcacctgaggtgaggagttcaacactagcctgaccaacatggagaaaccccatctcaactaaaaatacaaaaaaattagccgggcgtggtggtgcatgcctgtaatcccggctactcgggaggctaaggcaggagaatcgcttgaacccgggaggcagaggttgcggtgagctgagatcacgccattgcattccagcctgggcaacaagagcaaaactccgtctcaaaaagaaaaaaaaaaagaatttctggtctttagctgctgtttttcataaacaatcaatcatgttaagttttttctaatgtagctatgtactaatatactaatttaattggtgatagcaaaacatctctatcattttaatatgtcaatactcacatttgcaaacaatatgtatatagttgatgtcattcactagatttaactgtgtgacgcagtgatttataactaatacttaattagcaatacccataatttaaaaattttgtgtgatattcacatatttcaatgaaaaggaatctctctgacactttaggcaactcagaggtaaagtcaatgatctaataacaggaagatggacttttgcccatactgtagtgagaggtaattgtgtcttttctgagttctttatacttccggtgtgcggtgggaagaaagagttaaacacctgtctaggcacccttgattacacacacccaaattgaagagactggattatctttgtactagatagaatatgttgtcatttggtaattttacagatcctaacaacatgttttatattgtcttaagcacacttatttgggcacaggcaatacaaacctagcataaaaataccaaccaacagtaacaacaataacaactaaactttgtgcctactcccaatgaaacagaaaataatttgaatatttcaaattttaagtttttaaaaattagcaacatgtgttttgcttcttgttttttctctctctctttctttcttctttcttttttttttttgagacagggtctcactctgtcattcagcattcaggctgcagtgcagtggcatgacaatcagggctcaccacagcctccacctcctgggctcaagggatcctctcacctcagcctcctgaatagctgggactacaggcacactatcatattcggctagtttttttgtagagacagggtttcaccaagttttctaggctggtcttaaactgggctcaagcgatctgctcacattggcctcccaaagtgctgggattataggcgtgagccaccacacctgtccttcctttcttatcaaagtaattttttctctaaaacatttcaaaaatatagacaattacaaaaaataatataacacatatctatatatttgccaccaagtttaaacagctattaacatttgccatatttgccttaatgaaaataaaattgtagatacataaaagcgtatatctgtcccttctcctctctttctttacagaataagttggtgtaaataatttctgtgcagtcttttgaactgtattccttttgtatacccccaaatttataccattattatattctatattttaagaatttatagcaatgatattctatgtttttaaatatttctttttttctttcaacatattttttatgctaatgtaggtagctctatttcagtcatgtttactgctatatgacatttcactggaagaataagccacataaatcacagctttctggtaatgtggttctacaacgaatatctaggttatttaggttttttcccactaaaacaagcaatgcttcatcaaacatcatggtatatatgctctcaggtatatgtgtgggatattctctaggataaatgcctataagtgtagctactgatacagggtatgagcatctgcaaattccctaggtgttgacaattgctccccaaggtgatgtgccaattgtcactctcaacagtagcatgtaagtccctattttgcctcattctaaatagctcctggtattgtccaagaaaaaaagggtgattgtaaatgacatcatatttgttttactttccccctgaaatatcagtgaaggttttgtgtatcatttatattacattaacccttactgttgatttttcatatcaaagtccagttttctatttctttgtttggttctttatttttatttatagttgtttctatattttaatattgattattttcaattaaataaattttaactttagtgtaaatattttgtaaaagatgtggcatccaaaaattattgaagcaattcaaatctttacttatcccttgtggggagaagtttcttaagtaattatttcagtttatattactagtacttttcatgtatctcagtattaagtgttaagccacaattcttgtaattttataacattccatagagaagtaaataaatataggaaagaggatttacttatgttgcctgagataaacacgaagaaagtaaataattttttttcttgataatttgatggatttttagggttttatttttaaacattttgaaaggttgaattttactgtacttgcaggccaagaaattaaccttccgcagtttcataaataatgccaagagacatgagattcctgtctaaggaagtggcacaagtttcatgtttgcttcagctcccctgccccactcccatcaccaccaggaggtgacacagaggacctcactgaggtgacacagaggagcccacatgaatgttgaacacatcacagatttgcattatcgctgaggaaccccagccttagacaaccccaatcttttataataagcaggaggaatgactgctctttgcttcgaagggagacactatctttattatattggatagcaagcaaacctgttctttgctttgaagggaggcattatctctatcttccaagatcttctctatataagcatccttgaaaagctggtcataaacaaaaaagtagttatggcctctgctcacaagatatacagaaatatgagagaccaatgaagactaatctctcaaaacttgtggccggacaaataaaaatgtttatatgagtaaatttaaacgtttgctttacattgaattttgtaaattacatgcaaactttttaaaactaaagctttccattcaaactagtatttgtacatttttcaaaaataatttaaaaagggcttgaaatacaccctttgccttccctagtccctgctccaccctttgccttccctagtccctctcctcagaagtaaacactttgaactcttaggttttagttttctgatttgttatctctaacaatgtgctggtaaattaacagctggctctccaggtttagtcccaataacaatgttggttgatatattttgtttatataagatacaaattaaatgatgaagtatatgtctaaatttgaccattcatcagtgatgtgaatttttttttgctacaatacataacagtttttgaacaggaagcatattttctcatttttttggtgctatttatattttagtggccacacaaatcacacagttttaaatggaatcaccgttattgacagtttctccatgactttcctaaatccaatcaacaaagcaatatatcaagcccttatatgcggtgcaggatgatctctgtggtgtaaatgttctcgattacaagtcgccaatttgccatagcgaagcatgcagttgggaggggacgtgcagtagcattccattgcatagcatgctgccatatggatgcaataggtgtgaatcattctcaagaatgtagataacagtaaaaggtagtaaagtaatttggaagtgacaagtttgaatataatttttataatataaattttgtatttataaagttttacagtttgatttttagtcatggctatgtttattaaccagctcacaaaacttctgaaaatttaacatttggatcttgtgagcttgttcaagctggctctatcacaccactgactacctccataccttaaaccagtatgcaaaccactactttttgatttatcagttctatacattatcttctgatttcctgcaataatgaaaatttggctcatttatgttattttttctctccctgtagtagcctgtgtccaatatgacccccaaagagccttttttcctggtattcagctctttgtgaaggctcctccctcacaaaatgactgatctgtgtaaccaataggaaacaattgtatgtgactttaggatgaaagagtcattgtgatttcggcctgactttcttgaatcacttgctttagaggaagctagctaccaagttgtgagaacaccaagcagccatacagacaggtccatgtggtgagggtctgaggccttctgccaacaaacagagctcctacctattctggaggcattgcttcatgttattagcatttattgttgctaacaagaccactaatgccaacctgattcttatttctgtgtcagtgactgttatgggttgaattgtgtctcctccaaaaaagatatcttgaagtcctaacaactggtatttcaaaatgtgactttatttggaaatagtgtccattcatatcttaactaattacattaaaatgaggtcacactggaaaggatgggccagtaatctaatatgactggtgtccttgtaagaaggacccactgacgacagagacacacagggaggatttcttgtgatgaagaaggtagggattggagttatgtagctgcaagccgagaatgccaaagtttgccagccaaccaccaaaagctaggaagaggcaagaaagggttcccctgcaggtttcagagggaatatggccctgaccataccttgcttatggatttccctccagaactgtgtgacaataaatttctgttttaagccacccagtatgtggtactttgttataacagccctaggaaacaaatatagtgaccttgtttctttctctcaggaaaaaatttttctttatctgtattagctcattttcatacagctataaagaactgcctgagactgggtaatttctaaagggaagaggtgtaattgactcacagttcagcatggctggggaggcctcaggaaacacaatcatggtggaaggcgaaggggaagcaaggcaccttcttcacaaggtggcaggaagaagtgctgagccaagggggaaaaaacccttataaaacactcagatcttgtgagatctcactcactatcacaagaagagcattggggaaaccgcccccatgattcagttacctccacctggcctttcccttgacaagtggggattatgggtattatggggattataattctgatgagatttgggtgggaacacaaagcctaaccacatcacctatttatcttttgttgtttgcagtttcccaaaggtgtgtctaactgcaattttcctttttgatttttttgtgccttgtgctgtgtaactagtatattctagcacatgaaaacttttaaattctggaaaattctatgacataatttgataacttcaacccattatctcctctcttttttttttttttttttaactttctgtagaaaaatgttgaagctcctaaattggcccactatgccccttttctgtctgtctttctttttcttaaagttcttttttgtcattctaggctattacttttttaaaattttgttaatcatttaaaatttctttgggttcctgctgttttatttctttttaattttcagatgttcattttaatcttacctttagggagccatatatacttgaatctctctgaagtgctaattagaaggggaggagtttttttggttgttttgtgtaagtgtattctggtttctagattattttcagtttttggttccttctttgattttaagttgctctttttctcaaatgtctgatgacactagttcctctttaaagtgatgcactacacactgttctctgatatttctatgggtttactgactggtggagaggtaagaggtccactattaagctggagtcacctaatgtcccgaagatgaaagagtttgtcttaggagcagtaacatttatacctagagctctcagagggctttctctttggagggaaaattgaatggtaaatacctggcagcaacatggggaaagagatgggagtcttaactgcccatatagattttcatttaatactccagtgcttaggcccatcttttacttgtacccttctttatgcctggcatttccaaggcccaagactctccttgggcttctcagagtatattgtgggtctatctaatttattctgttttgtattcttgcaacaattttaacagaatctcaatagggaaagtagataaacagcggtttaaaatcttgaaccagatatacagaaatctttcttttttcaaagcacattttaattcagtttatttaaatgataaaaacatatccataaaggcataacatatataatttaaaatttctatagtaaacaagataaaaggtccaaaatttcggtagatactacatatgaccaaatgtaaaacagcatgtcttccattttgcttatttctaaaacttttttttcccctttaaacaattgtaatttgtagcctcttagtccttctactatttttttttttctttgagacagagtctcactctgtcacccaggctggagcgcagtggtgcaattttggctccctgcaacctccacctcctgggtacaagcaactctcaggcatcagccttgagtagctgggattacaggtgcccgccaccacgcccggctcatttttgtatttttggtagagatggggttttgccatgttggccagggtgatctcgaactcctggcctcaagtgatccacccattctcagcctgccaaactgctaggattataggcgtgagccactgttcccaacctttagtaatggtttttatgtgtacatcttcttatttgtgatttcatcctgaaactcaacatgacatgacataaagtggagtagaccaatggccacaggctgggaaagtcctggatttgcctaggagttgtgggatttggggcaaggtatttcagctttcagaaccttgagtttctctatcatgaagtgagatattgaactgggtgaaatattatgttcttatcagactttgtgattctgtggtttaaatagaaatattttattcttctaaatatatttttgcaaaaattttaagtgtaatttttgccatagaatagaacaaaggattttatccagatctactctcttatcttctgaattattatctgaatcttctctccttctattccactattatcttggtccaagctatgcaatattgtatcctacccctctataatccatctctgtatagcactgtgagatagcatcttatactgcaaatcaaatgatatcactctactactaaaaactcttcggtgatagcagtaataaagtccaactccttaccaacacctgtaagtccatgtaagtccaacacctataagtccatgatctagaccctgcctaattttccatccttagccctttgcactagctaaatttgctaaaaccaccatggtcatttttttcttccctcatatatgccaacttttcctgtccctgctgtctttctgccaagactgctctctcttctgcatttcccagggctatgtatttcccagggctagtttcttcagaacttcgcttaaaatccatttcctcatttaaaaagagaaaaaaaaacttattattatcattccccctcctaaatccatggtttccttaatcatactcttcacaatttgtaatgatttgttactttggtgagggcaagaaacaagtttttcattgatcactttatcccttgtgcctggtatcatttctgggacaaaacaagtgtgtgataaataattgatgaaagaggaataggcactaaaatgaatgatttgtatataaaacctagtattaaaatgaattttattttaggaaaagtgataactggttatgcagagcaaaatcaactatggtgcaaagaaataaagaaaaacaaattgcaaattattatgtttccttcttaacttgtgtatttttttattcaaactgcattaaattaggcctgcttattttcagattttttcaggctgaccttgcttgaaattggaagcatttttagaataatttatgcatcaagaaaagggtataatgctttagtgatgcaaggcccccgagggcagagtatcaagtaaaatattcatgaagcttaagtgcaagagacatcagattttctgtagtattttaacactgcatttctgtacaagggaattgtaaagtgcaagaatatgagagaagataaatattgaggacaataaagagggcctgtaaagtgagttcttgcctttccgattttacagctattattctcccaagtgtgaggtgactgtgtgtgtgtgtgtgtgtgtgtgtgtgtgtgtgtgtgtattgggtcatattagaagttattagaagttcccttataataattataaaattaagaaataatataattggctatgtgggttaccatctgattttcattcacatctgactatttgaattgggatgtgttttctttaattattttgtatgaaaaagaaaagatggggcatagtgtcatagtagttgcatacgttttgtaagaaatttcaagttctcccagatgaaagataacctttgtttttcaacttgttttccactttcaactgtacgcttcataagacattcattatttcccaagatgttcaaaaaagatacagtgaaagggcattgggaaatatttaatatgcaataatctttagagtccttcattttgaaaatggtctctaaaagttaaattagtgataacataaaaagaaatctttccatgtaaatttgtctacaggtatttatttatctttctgatgtcattgattcctttgttctgattattcatcaaaaaaatttttttaaatgtttggtagatttggggaatcaaatattatgttaaagatagaaagctctacctcatcttgaagactttggagaggatgctgatctctgacctgtggctaaccgtcagattttaggtcatcgtgcaacatacaaaatattagattatagaatgtgtaagcttagaaattagaaattagtgcagtctacaatatcttcattttgtaatattcttgaacatttaatctgtttagaatataatggtctattagtatctcagattaataacatcttgcttcattatctttctttttgaaatgtttagaccacatttttctttcagagcagtagccataacattgtctgaaatttcaaatgaagacctttccaaagtaatagttataagtaaattacacagtcctccttgatgcatggagaagccttataattgttccaagtaaattcagaagtaataggtaataggaaggttatattcaccctgatagcccttacaagactggtcatcaacattcagaaccatgttaattgccaacactgtcatgaatggggtatttatatacctaattttgctgcatggccaaagattccataaaaataagactttatggaggtagacatgactggaacatagaaaccatagcataattaagcagaaaattccaattacataacatttatgtatttatttatgattcctcaactgtggccatgggtggcttctttttcttttttcccccctcagctttattaaggtaaaattgacaaataaaaattgtatgtattcacagtatacaaggcaatgttttgatatatgtacctattgtgaaatgattaaatcaagctaattaacatctattgttgcacatacttatattttgtgagagcattggagagcttaaatcagcaatttctaatttttgcaatatattaaatatatattttatattgtatatatttaatatatttacagtatatttttataatatattattattaactatagtcatattatacagtagatctcttgaacttattcatcctgcctaagtaaaactgtatcttttaaccagtatctccccatttccaccgccagccttctctagctcctggcaaccagcattttaccctctacttgtatgaatttgatatcttttagattccacatataagtgagatcatgtagtatttgtctttctatgcctagcttatttcacttagcaaaagttcctccagttttatccatgttatcaaaaatgacagcatttccttctttttaaaggctgagttgtattctagtgtgtgtgtgtgtgtgtgtgtgtgtgtgtgtgtgtgtagctcacattttcttcattcaatcatctgtcaatgaacacttaggttggctgattccgtatcttggctattgtaaataatgctgctgtgaacacaaaagtgcaaatatctctttaacatactgattttatttcttttgtatatatactcagaagtaggattgctggatcacatggtagtccaatttttaattttttggggaaactttttattgttttctataatagctatactaatttaaatttccactaacagtctataagcattcccttttgtccacattctcaccaatacttgttatctttagtagtagccactctctctggtgcaaagtgatgtatcactgtggttttaatttgcattccctgaatattaatgatgttgagcgttttttcatacccctgttggccatttgcatgtcatcttctgagaaatgtatattcaggtcatttgcccatttttcaatcagtttatttgttttcttgctattgagttgttcaagtttcttatatattttggatattaatagtttgtacggtttgcaagtatttttttcccattctgtaggttgtctcttcactgtgttgattgtttcccttgcttgaggaagctttttggtttgatgtaatcccatttgtctgttttgttgccgttacctgtgcttttgtggttacagcccaaaaaaaatccttgcccagatcaatgtcaagaagccttaattctatgttttcttctagtagttttatagtttcagatcttatgtttaggtcttaaatccaatttgagttgatttttatttttagtgtgagataaggattcaatttcattcatctgcatgtggatattcagttttcccaatgcacatttattgaagagattgtccttttcccattttgtgtacttggcaactttttaaaaaaatcagtgactgtatatgcatggatttttttctaggctatttcttctgaccccttagtctatatgtatgtttttatgccaacaccatgctgttttaattgctatagctttgtagtatatatcaaaatcaggtactgtgattcccccagctattttttgccaaagattgctttgactatttgggtattttaggtctccatgcaaattttaggattatttttcttttttctgtagttaccttgaattaaaattagtagtttgatttcaaatgtgaaacttgtgacttttttatttatggcaacagatttttacaattatataatgaaaagcaaagagaaaattatatttgaggtcgaaattcctattactattacatttttagaaatgcctcatggttatatatgtgtgtggaaatgagaacaaataggactggaagctttgacttcctgctccctcttcagcacaatactccaaaacagcatttcctcctttctctctcacaattcatcttcttttcccccttctctgatcttgctacatttttatttttattttttgttccacactgattgtagcccaaaggtgataaatttgtgtggactaagtgcaagaggagattggggaaaatttgtttcattgttgtgtcattaaactcagttttcccaccaaagcctgttctaataatttaatggccatgaaaattggttcttttttagagtaaaatatctttcctggctcatttgaaagttgccacattcaatgttgcatttttatctgaaattcggaaataactgaactttcctaagcgaatctcatctcaacagatttttagtataatatcaatgtcagagagatttgaatagactggattaagaaagccttgggtaaatgttagaatattacaaacctgtcatacctctttattattctgtttaataattcataaataggagtcctgctaagttttgataaataatatccctgtagggagcttactgagctgtcattggtatgcttgccttccaattttcctgccctgctcctatcagagaccatcttcagggttagtggtaacctagcagcatctttcggtctttccttgcctcaccactgcggcgcggagctccctggagtggaactggctttgcagacccttcaccagcctccactcagctttcactctcactttctgcttgctttcacaccaggagtgggatctaactctcacactaccatgggaagctgaatttatgttgtactatttcagaataaatttcaagttgttaaaaaaaattaataacttttgaagtacttaaatattatcatttaggcatttttgctaatttttcttggtgtttggcaatcaaccaccaggattaataatctgatacacttttttccttcaaacacatttaatttgtaagtacatcaaaacataattttattacaccttttaaagtttcatgtctttattagtaagtataaaatagttgttgcaaaaataaaaaatataggaacagatgatatgtcatacttttattttagacttggagaaaaagcagagatttcctataagtggtagttgagaaaaaattattccttatatgattttcatcatagtgtttgacgttacacttaaacactacactaagataatagtaatcataacactctattaagtctactgtatgccagttattcatataagcgctttccatatatttgctaatgtattacttagttaacaaccctgtaaggtaattactatttgttatctcattctacatatggggaaactgaggtacaatatatttgtgacttgtttaaggtcatcaagttagtaaaagtagctagattcagtcccaggcagttgcactccagagtacgcaacttaaacactaccttatactgcatctctgttgaaaaaaatgaaagctggttgctgcattgaacaatatcaaaaatttattatttggagaaattttctaatatctgtgtctctaaaatatgggtcagtgacgtttttggggagcaaagttcttggagatttaacatgtcatgataaatctgggtctttatatacttgtgaaatgtttcaatccataaaccagaaaattggatacttactttgattaacatttctgtaatggcacaaagatttgctaagaaagcatctttgaagactggcattttggctgtattgatgcataaaattttctaaccatatatctactatattgcttatcttatttaagtaaaactattccaaaagttattttatataacacaaggtcaaactatgctgacaaaaatcattactcacttcatacacatgttattgaaggtaatatctgtttaattctattctatatcctaagcattttgcaaaacacatagcaatgtatatttgaacccaagctgaaagtgaaacatcagtttataaagatgagcttcctcaaatttgtatgtcataattacatattagaagtgcaatgaagtacaaataaaatgaataatttatagttagtgtcaatgcagttaatgaaaatgtccgaagcaaagtgtttaaatcataactaatcctgcggggctcatggccttcacctatgctttagaaaatggataaatgccatctcctggaatggcctccttggaaattattctttggaagatgaggccccagactgtgctggggttacctctagaatttgggggacattggcactcatagactgcttcccacagaggaactggagcattcatcattctactggacctctgcttagcatattctgggtatatatcagcatgggtgcagaagaccaactacacgtagagggaaaacaatcaaataaaatataaaaagatgcttggttttataaagcagtaaatatagtcttctattcctagtatatgtttgcaaaaatattgttttaaaaatcagatctacatagaaagctgcacagaatggacaataatgggtactcagcagacccaggcagggcctgccttcttggctggctatttatttatttatttattagcttggatattcttctctcttgctgctgaaactgcctctaaaagcaaattccattcacatcttcgcttgatagatgcagtcagaatggcaggcgagaaagaactatcagagttcaaggagaatactaatgcctcttcatatatacaggcacattttcacatcatgtgaatattgtatgaagatgtcacaaattatatgttcacatgtacatatattatcattttcacatgaaaatgaaatatgtcttatctcacacaggagaaatgaaagtcaaatgcgtagtttgccatctactccattacttggggctttctataaaatgagctctctaaacctgtattttcaactgaataatctcaagaggtaacacaactgcatacttttttttcttttaccatccatgctgatacttgaatgaaatgattaataatttggctgtattttgaatattttctatatttcttttttctctctcattcatggaaattttcagaatattctcaaataaagaaagcatgctgaaaaaaagttacactagaatattgctccttctagccccatagaatttagcagagttttgcacataatagaaaagcaaaattttaaaaatggaagagtcatagtctcctaattgtattccttcattttacacaggagaaaatttaagcttatatatagtatatgactttgctaaaagtcaccttaatgtaaagtcacatattagagtgagcatccagctctcagtgttccagggcaggattatttctagtgcagttcttttttatttaaaaccgaaaacaaataaactaaaaaatcctaatggaacaataacaataaaaatgccttctctatgccttaaactcagataagtagacaaatattataccttaattatgataaaataaataaatgtaagaaaataatatgtgtgggatgggggtataaaatgatttatgtttctttaaaaatatgtgtggagttgatattcataatctgatatatggtgacttaacagaagaccaggtatcagtggcatgtgatacgcacatagtgtgctcagaacattttacatcttgtgcagaggaaggtagaaccattttgtttaaagaaaacccagaggattttagaaaattacctaaagactgctgagctgtcagcaaaaatttaaggcttccaggaaaagtctgtcatttatctgtaaaacacccatctaccactgcctgcagcataaaggacaaacttcttagcgttatccatgcaaccttcgttaatctttcccaacatgcccagttgcttttctccccaatcacttcaacagaacctatgctttagcagtcctcaagaacttttagttcctagaagataccattgcacatgtcattccttctgttggcaatatccttccaagacatcaatcatagatggttacagaagatattgcagagaatatgaagaattggaaacataatcaagtgcaaaatcagtaaacactattcaggagataagatgcagattgtgatccaagctttataattattttgtaggggaatcagcaaaaagcttgagaagtagatagtacaaggcagggagctattttttttaaaaaaaatccctccctgcctgtttgagtatcttctagttaacacatacatactagttgcagtcacataacatataatttaattttcataataaccctaagatataggggctaataagtcttttttgaagaccaggaagccaagtgtaaagcatcatacctagtaatcagcagaaccagacaccaaatcccagtcattgttgaaataattgtaaccttaaaaattatttaatgtttatcactgtattagtctgttctcatgctgctaataaagacatacccaagtctgggttatttataaaggaaagagttttaatggactcacagttctacatggctggggaggactcacaatcatggcagaaggcaaaggagaagcaaaggcacatcttacatggaggcaggcaagagagtgtgtgcaggggaactcccatttataaaaccatcagatcttatgagacttattcactaccacaagaacagtatgagataaactgccctcatgattcaatgttccacctgtccctgcccttgatatgtggggattattacaattaaaggtgagatttgggtggggacacagccaaaccgtatcaatcacatttttaaaacacaggtcatgcattcatgttaatacgtacaagtacttcaaaccttcttttcacagcaaatagttatttagttggtagagagttttatagaaaatttggctctgcatgcaaacagggcctcacagagtgacagcacacagacagttgttagaaaatcccagcatctgatccacagctttgcagattttatgattgaaattggtaataaaacaaaatggattagcctttgagactgatcaaggttattgacattcacaagtgtctgatatatacacttctgaattattcatttacatttacaattagaaatacaactatcaagcagaccagaaatgttatgggcattattctctacttgttctctttgtaggcaaatctacaaattacaatcagaactttgtttcatgaaaatggagttaagtcagtgataataggaagggcaactacaatgctccatgcattgtgctaagctgcatattgctaaactctatatttgcattattttatttagtttttataatgttattatgtgaatattttatagataaagaatgggagactcagagagtttaagtaatttgcctacatttacatagccaataaggattagagccagattttaaatctaaatttatttaacttcagagaaatagatcttaatcatgacccagtgctgcctaccaaacatgatataagctccttgaagtcagggagaatcataacaacattaacagctcccaatggaggagtgtctctcatatgccttacactttcattcatcctctatgactcactctaactctcatatcaaccctgttatatagatactcttatcatcattttacagaaaataagacagaagctcgaatatgaaatctaagcccatattgctgacaagtagcaagattagagagcacttaattcctgactttgaagcttgcagtcattctcttgctgtatgctataattccaagccaggcattctcatcagagggacaggtggagatcattgaatcataatcaaggttcattgttgtgaactttaaaatagttaataactatattcaaatattaactattttaaagttcaaagtttgaagaactctaaaatagtattatctattttaaaaaacctattaaagaaggaaaagtaccaggaaccctggaaaaattaatcttgttgccctgcaatcagagccagccaggaaaagaagcagtacacagagtcagaaacagctacatgtgaaaaatcacatagtattaactattttaaagttcataacaatccaatcagtgcaagtctataagtattcacatttcctagataggtaagcttagtgagaagttaaataatctgtccacagtctcacaactagcaagtggtgtccctgtaaaacagaccaggcagtctggctccaaagtcctacactctattgaatgatcttaataagaaatgacaactagttttatggcctgatgcattcaatttcattctagaaatatttatccatgggcaacagaatgtctccccaatacagagataagaaaaatgatgcaaagtaaatgtattcctaaagagcaagactatttttgtagttgtagttgttgttgttgttgtagaacatggtggggtacaatggagatgcttggaccaaagcttgactacctaccctaatttcagtcttgcctccttaagacttgatctctatcagtttgatggaatttgagtatgcataaaaaagatgtattgtggtcaacagaagcaatcaagaagggcagaaataaagcggagttgtgaagagctacatgtgcaagtcctgaaaatatcattgtgtctgggtgagattcaaaaagaaggagaacaaaaacagttccccaatgggatgtgctttagaaagccaggtgaggctgaagacatgactcaggcatccttgttgtaaaactggctttgaggtaacacatagtagtgagcgtggacttccatggttcatacataagaagattctgtggaaactagatattttaatcaattctaaacttaataggagagctgtcaccagatgtaacttctaccaaaagagaggaacctattaaagaaggaaaagtaccaggaaccctggaaaaattaatcatgtttccccgcagtcagagctagccaggaaaagtaacagtacacagaatcagaaacagctagatgtgaaaaatcacattacagaaagcttagagaaagaatggctaggagatcagataacaataaaatgaaaatgccacaaaagaaaagagaaactgtcaaaatggacttcagaccacacaatcacagatggtgctgataaagaagaaaatgggcatccaaagagatcagcacagcagcccaaggagctagcaataaatgtgagaacatggaaaatgatgaaagtagaggtatataagtaagaatgataatggaagaataatatagacacctaaaaaaattgacagtgagtttaaagcaagaatggagttgagaaaaattccaaaggtgttttaaaaatcatgcgtaatacaagaaagataataaaaagaggaaactctgctacttggggctgaggatgacatattaacaatggccaagggaaagcagtaggcactattttactccatttagcctcctccttagacagcaaagaagataatgttcacagtagcaagaaaatgagccccatgtataagagtaggcacctacaaactttgataacatccagtattattgtgaggacttgaaattgacattgttgaattatcgatggtttattcatgttattgaataaatgtacacacaagcacacacatgcacacacacacacacacacatatgccagacactgtattaagtaatttacaattattaacttattttatttttaaagcaactctacaaagttgatgatctttctaccattatggagaatagaaaatagatattaaatatgaggataacttttttcccaagatctacttgtccagtaacactaagccttttaaatgaggttctttggcataacttgttttcgttgaattcatgttgcatgaaagaatcttatttatttttcataatttcttataatttaaattgcactaatcagttgaataatcttatgctgtttagacattaaactgactaattattgagaaataaagattatgtcacagaagctaagaatgacagacttgtcaagctacagaaaggactaaatgtaagatgaaacaggaaagaagcaaatttttttgagggaaagaatcccataattctggtagaaaagattgagtgttccctgaggacaaagattatacattaccaatccctgtatcaccattatcgtatacagtgacagtgatttatagctcaaaaattaggacttttaaacacttaacgtgattttaaactacgctaaagtaggtataaagttcagattatttactcccctggggtggctcatccgtgtgtgtgtgtgtgtgtgtgtgtgtgtgtgtgtgtgtgtgtgtaatctttatgtatatgtaatatttatgtatatgtatatgtagtctttatgtatatgtaatatttatatatgaagatttatatatatattttataaataagatatatatatatatataatatatataaaatgttcaataaggcctgtaaagtgaccctagacatattgtgttgaagacctaaatgcctactagatatttttgcctggttgccccctgagtgtgtgaaactgagcttatttttaaatttcctccacaacttatttcttctagatattctacatttataaatcaggacaattattgtcattattattattatcatcaacatgtaaaaacctcaatgatttaatgcaagagaggtatatttcttgctcatgcttataaggctactctggggagagtgttttctcctctcctcaacattcttattcctggatccagactgtttccattacttactactgtggaacaaaccaccccaacacttggtggttttgacataacagtgctattatgacttcttatggttctgtgggaggaatgggctcagtgaggggggtttccactccatttgatgtctgctgggattgctgtcatctgacaccttggttgagctggattgtccaacattggtcacttgtgtgattggcagttaatactgaatgttgactgggggctccagtggggctgtctgctggacagccttcatggagtctgtttacgtggattgggtttctcacagcacagctgaagaatttgcagaggccatatctcaagagcaagtgttccaagagggaggaagtggaagatgccaatactctttaagactacacctgaaattggcacagcatcatttctgctatgtcctcttagttaagcaatcgatcttgtgattcacgaactggaaaaacaaactccacttctttatcaggagaagtaaaagaatgtgtggccacctttagtccatagactgaaaaaacagccactatctagaatttgcttgtaattttatcagtttaagaaagagagctctgcaggacctcgcatcagcaaaaaatatatttgccctgaaagtgacacattttacttcaactcacaattccttggccaaaattggtccaatacctacatgctaccacagaatgcaagaaagtatgatcctactacagatcttcagagaacagcaaaagaatgtaactccagtttgtctcttactctcaaaatccgctggtgccctcattaattattacccagaacatcacaaagactgacttgtctctcttcctctagctgagcttctttctaatttattttacaaacctgacccagaaagaaagaacactgtaaaatataaacattattgtttaaaaatcacataaaatcataaacatataaaacccgtataaatataaacttacctacttatcatctttcactaactcaccacatttgttgagcacctccaatgggtaagacactgtgctacttcttgccatcacaaattttacatttttaattttgtccctctgccattgttatcaagtatagaatacttaatatgattcataaagtatataaaaacaagggccctggcctagttctccagcttcattttaggataagcaattttatttcttgctgttcttgttaatttagcttagttcttttatgattatttttttctcaaagaataaatttttttttcaattattcattctactttaagaaccactaatttttggtgtctgcttttattaccatttgtttcatttatggaaaatgcttttatgatttttttctaagttactgaattgaatgcttacttcatgtatttttattctaactctcctaatcataaaggcatttataaaatgaattaaacagttatgaaaactttggctgcctctcatatttttatatgttgtagattcattctaattatgtacaaaattatttatagtagcattttattaaaacataacgtgtaaacaaaaaaagttgtacaagaaagacagaaatcactgaaattccatttctataactttgatacatattttttcatcagaatcagctatcttgttcatatttttgagtaatatggggtcaaacatttacattattttgcaattatttttatgtacaagcattttggaacagtttttatgacaacaaatatgtgtgtgctttgtgtgtctttttatttcttttatttctttataaggacaaatgactatttgtctctaaggtactaaggttgattttaattttttcactaatgaaaataatttggaatatctatatttaaattcttatatggcctgttttcaattttttttatgtttttatagctaggatttagggatcaaatgatatttaagtctgaaggtttttcatattaagtaatcattttccctcttacaggttataacaatttactctcccactaacaaaaaatgaaaatgtctcttttctcacctatcaaactatattatcctgctttttaatttttaccaaactgacaggttgaaaagtatgtacatttctttgattactaatgccactgattattttgccttagctaattatttatttcattatttatgcatatttttcttattaattcaagaggactccatgaattaaaaaataatttaattattaactccatgaattaaaaaatattctgtcatatatgttgaaaatatttattcccaattttttcatttttctttaaatttttcctatttttgggggaagttttgaatgttttatgttatcaaactattaattttcctttttatagtttctgctctggctgttatatttagaaaggtctttcttttggtttccaagtttattttatttatattgctacaaaatatttcattattttgcagcaatatagtttatattaaaatttatattgctacaaaatattgctacaaaatattttgttattttgcagcaatatagtttatattaaaatgtttttctttaaatatgtaaaggatcttgattatgtttgatgtaggtgtgaaataggaatccagctttattttatctgtcacaacttggttgttcaaaagtcactaattgagtaatccattccttcccacctttttgtataataaaaatttcattttgtgtttgtgctatatatattttgttttattgacctattttgatgcaaatcatataaagtttttactgcagaaactttgtgatatattctaattacaattttggtaaggtaaatccaatatatttttctttttcaaaatattattattcttttttattttaaaggagctttataattaatgatgtttacaaacaaagtctttaagatagtttcattggacttatcaaatttgtagatcaattttggagaaaaatggcatcttcaaagtatttcttcttctaatttagaaagaggacactaacctgggtattccagataggcaattatatcctcagtaagaaattatgtctttagttcctatattaaatgttttgtttttatcaagctttattagctattactttaaaaatattaattaacagtagcaaaaatgactcttttcttgttcctgattttaatgagaattgcttcagcataaaatgatcatttattttaaattggtacattttaataagttaagaaattgtacttctgtttttaagtactaattgttaaacaaataaacaaattgtatataccaaagagaacatagcatattggtaagcatccatggaacattgacctttatattagtaaatgaaataactgtaaatattctgaaattctgagcatgttagaaaatagataaatggggaaaattcacattatctgaccataatgcaataactctagaaactaataagagattttaaaaaagaaacaaaaaagtgctgataaaacatttaaataaaggtcttgaaattttaagaaaagattggattacattgtaccaaattctacttcagcatctacccagatttttcttctttgatctagtaatgaatcatatctggaacaaataagacttagttactacgttatttttaaaagtaatactgaattaagtctgctactactattaatacagttattttacataagggaggttaattttctgttttctgctatttttgtcaggttttgaagtctgtttttattggctgtatttaacaatgggaagaaagttaactgttgccatgataatgctgtgttctccatcactcaattagcagtttaagtaacaccatttattatttatcatgagtctatggttgatgggatgttctgctgaactggatcaggtttgactcacctcagctgggcttgctcatcatctgtggtcaactggcaagtcacctaagatagctgatctgggataccttcagctgagataattcatccctctttcaaatgtgtctctgacatccttctttccaacaggctagatcaggcacacatcctcacatgtcgtcaggggtccaataaagttaaaccatgcatgtgtcttttgaaacttgtttgcaattttttcattttttttttcatttgaaagtaatttttgtgagtacatagtaggtgtatatatttatggggtacatgagatgttttcatcacaggcatgcaatgtgaaatcagcacatcatggagaatgggatatcctttccctcaagcatttatcatttgagctacaaacaatccaatcacattcttagttattttaaaatatgcaatgaaattattattgattatattcaccctgttgtgttatcaaatagtaggtcttattcatttttttctgtagccattaaccatccccatctctagccacccgctactcttcccagcctctggtaaccatccttctctctctgtgactataagttcaattgttttgatttttagatcacaaataagtgagaacatgtgatgtttatctttctgcgcctggctcatttcattcaacataatgatctctgggcttggctatggtatttgcttagcaaatgaaacagtagctccaacatcatggatagcgctactgtttcatttgctaagcgaataccatagccaagcccagagtcagtaatgggaaggcagtaggcattacaaaagggcatagataaggaaggtgtaaaaaaaaaaaaaaaaaaaaaaaaaaaaaaaatggggtcaataatacaatcaagccaccatttgaagcatcacttcttttatattctctgcaatctcttaaataatataggaattatctgttccatattacctttgcaagtcttcttaaagtcttgacacgtaaatcttctttaaaaatagcttttaaaattcattaacagaatttcattcctagacatttcttaatgagacaacttctttatagctgcgataatattttatttctacagttgtttattttctactcttaactggtcttataagaaacttgttcattttaccaatgttttaaaagaatccgttcttggatttatttatattagtgttatgttcctttttttctaatgtattcatttcttccttttgccttttgcttttatgtattccattctctatcttgcgaaataatgtattctaacctttccagcttcttgaatggaatacttagttcatttattttaattttgttgtgctcaataatgatatttttaattacttgaatatttcatctgagatcaatttggctttaccccataggtctgatatgtagtgtcagtatttctattttctaaatatgtgagatatcctttttaaatgaatttatatggtgaaaatccttatttaaatattttatcagtagttttaaaaatatatatctgttattaatttctagtattgcattgtggtcagataatgtgaactttcctatttattttgtaacatgctcagaatttcaaaatatttacatgtgttttgttgcaaatataaggtcaatgtttcatcaatatttaagagcatgctatattctctttgggatatccaatttgttttataatttgtaattcaattatattatttatgatatttttcatatacttaatttttcacctgttatcagttatagatgattagtgccattttaaattttttttactccacatgcaattttgtctatattttttctgtacttctctttgtctatatttctttgtttttctttgtatttctaagattttcacattgtatatttgtgctgctttttttagtgtacaaagttttatcaaatgtacttttataacattttgcatattgaataatttttctccaaattctattttatctaatataaccattgctatactggcttcttttttcttttttcattacaataggtaacacttattgacatctatagtgggacatgcataattactaaatttttttacatgcaataattcatttagccctcaagagaaccttataaggtatgattatcatcccatttactgagggttacagttgagtgaagcagagggaatttatgtaagttgttcaaagtcacaaaactagtaagcaactgagctgaaatttgaacccaagctctctgtctccaaactgaggttttggcaactatagtctgttgcttctttataaatatgctgcttggtcttgtaagaagtaagctatttttctctcttgttaaatttgctcagtcttttcagggctgtatgaagtctacaaatgagcccatcaaaggctctttttaaatgttactgtgattattattattattattattattattattatttgtaggatttccatttgattctattagagcctatctctctgctgaaatttcctatctggtcatgcatgttgtccacctttttaatagagccttcactgtattaatcatgattctttaaaatatcctgtgttttgattccagcatatggattatatctgcatctagttcagtgattaatttatgtcctaatagtgggtgttattttcttgcttttttatgtgtcttataacatttgaatgaaagacagacactatgtaaggacagcagagactgaggtaaatagtattaatgtgtggaaacaggcatgcctctcctgctgctagtttttttttagattatattttattttaagttccaggaaacgtgcaggatgtgcaggttggttacataggtaaacgtgtgctatgcaggtttgctgcacctatcaacccatcacctaggtattaggccccatatgcattagctatttatcccgatgctttccttcccccttcccccaccccacaggccccagtgtgtgtttttattggagatgggctgttaaatcaatccagtcaacagtcaatcttgatttacactgctgttgcttgttacactcagtgcaccacaggtttccaatcttctagtgaaatcttatgcttaggttaggtgttgggtcactaaagagaatttgtaacttttctcgatactagattttcctgtgagcctgtgcctcagtgagtatattttttataccgttgcttctctctcaatggtagaatgccattacttgttattcacaccacttactagtctgcttgtgggtgtgtggggagttgttgccgggggacgggttgtggacagttcttaggcttaggcaggcagtgtgtccctggattggggatctggctttcttggtgatcctactcatcctcctcatggcagtcaaactttgtcttaaatgtttggcaggtctcatgcttgggggagattttaccccttttggaatggttgatttttttcttttaccctttacacagtttcattgagttttcacctgtttcctgagaaactatagcaaagctattaagctttgcttccccttccatagtgccttaaagcttttgttcaataagctatgtagggaagaaaaatctgggcaagggtttacccctttctcacaacagaaattgctcctcttctcaggcctgcaccactgagagaagttttctctgatctttcattctgcctccagtcttcgttgtaaacacatggtgaggtctgtgaaagatagcctgcaagttgggtggaaattgcctttgtgcctgtgaatcccagtagttctctactcttatgagtgtactcttacaccatatactatcatgcaagctctatactcatgcaagctcatacttggattaggcaatttattttaaaaattaaaatttccttacctgcagcggggcacggtggctcacacctgtgatcccagcactttgacaggctgaggcaggttgattgtttgaggccaggagttcgggatcagcctggccaacatggtgaaaccctatctctactaaaaatacaaaaattatctgggcatggtggtgcatgtctgtaatctcaggtactcaggaggctgaggcagaagaatcacttgataggagatgaaggttgcagtgagctgaaattgcaccactgcactccagcctggacgacagagtgagaccctgtctcaaacaaacaaacaaaaatttcttacctactttcatcaggacctcaatctcctttcatgctctactccagctgcatcagtacacatgtgcctctttgtccttggaggagcctgtctttccttacatttcaggctatgagatctacctgcaatcccagccctcgatgtggttaagaggagtgatgattttgtccattacagcttctttttttcttgttgagaaggaattaatgctctttccagacatctacatcctaagcaaagactggaaatctaatatataaaaatcaaactacctctgttaatgatatatgtgttttttttctaattaattcttgttttgttgttactgttgtgtgagtgcttgcatgcttatgttctctttcttgcaatgtatgtatttaccttcttttgtgacatagaacatatgaattttgtttttaatttctctagtgaatctgtttaagttgatttaacatgtacttaaattaatataccttaattatgaaaaacaatactacaacaatctgtttttctttgtgcatgaaaattaaggcacccctttacttcctcttcatatattctcttccaaaactatcataagagaaaatattagttaatagaaaatatatgtatatatagtcatccaaaatattatttttaggcctagcttcatatatgtaattgcttccaacttctcttccaatcattttatacttttatattctctattcttcagttctgtatttttattcatctcatagtcatctcagttaaattctcttgccaaagagtaagaaaaatatatatatgtgtgttgtattcattgtagtttgagaatgttttcctattgctttttctcatgaataacaatttggcattcttagttttttctttctaaaaatctgaagacatatatacattttcaactgacatctgctgctaaggagaaaaatactaaagctacgttttcataaaaatctgaaactagtgctatttttatttgtttgtaggtaatctgtttttgtgcttagacacatgtggaaaaatttttataactttggaattaaaaaataatcacaaggttaggtctaaaaataggcttttttaaaaaaatcaattttgcctgtgacttagtgagctcttttaatatataaactatcatacttgggttagaaaatttttcttccattatttctttgagtattgaatctattttcattgacctattatttttttctgaaaaatcttattttgtttttaaattatatttagagacaagagtcttgctctgtcactcagagtagagtgcagtggtgtaatcatagctcaccgtaacgttcaactcctgggctcaagcaatcctcccacctcagcctctaaaataactgggactaccacccagtcaaatgccaccacatttgactaatttttataaatgttttgtagagatagggttttgatatgttgcccaaactagtcttgaatttggggcctcgagtgatcctcccacctcaacctcccaaagccatgggattccaggtgtgagccactgtacctaaccctcttctggaaaatcttaaggccttagattgcattcctgtctttataggtcatatttctcattattctcttctttttgaccttttctttgcaacttgagagttttaaaagttcacttattgtgtaacttattcattagtcctgatatatcatttgcattctttactactcccaactgttatttttattctgcagtagaagtttgtctttattcttttttgttttcttttctcatattatctcatcttttatatcattaccttcctttcagcctattctctttgttggttctctactgatgtttcacctagattttcattgtttaaaggcattcatcagattatattgcaacatttttattgaatgcagccagaatttatgtgaggtatgtactacctctgagacttgagggtgatattctgatttgtttagggtgcaatgagtttttgtgtttgtttatgtttctataaaccatccaggcccaatctttatttttgtcaatagttaaagaaagtgaagcatcttttgcctcctctacaatccatttagttaagttcagtttttctttctcagacctagagttaaagatcaaatagatatgttcagcatttaatcaaatttaccatgcatagtaggtattccatgtataggtttttgacagagatttactaaagttatttggtctaattatgacagagcatttattccagacactgtcttgtttatactacttatcactcagtgactaaatcttccaaaacaaaaattattgtcatctcaccctctctacttccataaccttacggtggtttctgctttgagtagtagtctctggatatttgtgaaagagtgtaactgagaaggcagcaggtagtgaataagagaacaaagtctctggatactaataaagatagttctcatatagttcaggatagcttgctgcttacttggccataaagctcttacagcctaaagttaggcataatcaaaggaaatattgttgcgggaagtcagggaccccaaatggagggactggctgaagccatggcagaagaacatggattgtgaagatttcatggacatttattagttccccaaattaatacttttataatttcttatgcctgtctttactgcaatctctaaacataaattgtaaagatttcatggacactaaccacttccccaatcaatacccttgtgatttcctatgcctgtctttactttaatctcttaatcctgtcagctgaggaggatgtatattgcctcaggaccctgtaataattgcattaactgcacaaactgtacagcatgtgtgtttgagcaatatgaaatgtgggcaccttaaaaaaagaacaggataacagcaattgttcagggaataagagagataaccttaaactctgactgcctgtgagccgggtggaacagagccatatttctcttctttgaaaagcaaatgggagaaataatgctgaattctttttctcagcatggaacatccctgagaaagagaatgcgcacctggggataggtctctaaactggcacccctgggcatggtcatctcttatggtcgagactgcagaggtgagatagactccagtctcctatagcactcccaggcttattaggaagaggaaattcccgcctaataaattttggtcacactggttgatctctcaaaaccctgtctcctgataagatgttgtcaatgacaatggtgcctgaaacttcattagcaattttaatttcacctgggtcctgtggtcttgtgatcttgccctgcctccgcttgccttgtgatagtctattaccttgtaaagtacttgatgtctctgacccacacctattcacacactccctccccttttgaaaatccctaataaaaacttactggtttttgtggcttgtggggcatcatagaacctaccgacatgtgatgtctaccccggacgcccggctttaaaatttctctcttttgtactctgtccctttatttctcaagctggccgacgcttaaggaaaatagaaaagaacctacatgaatatcggggcaattccccgataaaatatattatatagggagactcaaagcatatttctaccttccctgtactaatttgaaaaagaatatatatggttgataaatatatatatatatttagaataagtattaagccccaatgttatgcatactcaaaggaattatacaacataaagagaatcaaagtatatttctactttccttggactaattcgtcctgttctggttgtaagtatgggatatgaaatacatagatgaaatgtatgcttttgaatctatccccaatctcaatttagttgtttcaaattatttgagaatttctcatttatctttctctaacttgaattatggagcctgtggctttatttttttttttttaagtttttttttttttggtcagttgttgaaatttttaaacagatatttggaggaggtgtatcagagccagctagttttaagtctcagactggtcactcttaaaataatcccacccagtcatgccatcatcaaatttagttgcctctctccttggcttaaatttaatacattttttccccaatctattggactctttagaaatgttttaaacaaaaatgactaatttattttttaaatgtaattaattttgttgattgaataagaatgtttaaaaatgaaacattattgtgaaaattaccacatccttggtttaaaatagcctgagaaaggaaagcacagccataagaaataaatatacgaataggttaatacagaggaaattgtgccagacaaagctggttgcttttttgatagctttacagccttagtaaatgaacagagtggagtagacataatgcatcttgacttctagcaaagtactggagacaatgtcgtgtgaaattttgattgcaaaattaatttgagttggcttgaaaaacactgttaaaggaaatataagctggttgaaaagacatacagagaagagtgttgattaatgtcagtgaactaatgagttgagtgatatctccagttaaatgtcacgattgtgagtgttggattgaattatttttgttatctgttgaaaaaataaataacatagggttgattaaattagagcagaaaatttatcaggagacaccagtgattacagaaaatctatataaagacatgaattcatttcagagaaaaaccagtgaaacaatataattttacttaaagagtccatttttttaatcacaaaatggaattctatgaagtatcaatgcttaaagaccttcaaactacagaatttctcaaaactaattggaaaacaaaattaactatctcagtaaggctagaacatcattttaatccagttagtagctacattttatcccaaccaataaagtgacagttaattcttacctagaggatgtggttaaatgtataattattatttaccagaaataaaaaaagtatctagaaaatcagtaacctctagaaactcttgggcacaggagagggagaaaactatggaaggggaagtaattatgttcttaactatgttacattcttaagttacattcttaactatggggatatagtaagactctaaataactaaagtttttttttattatactttaagttttagggtacatgtgcacaacatgcaggtttgttacatatgtatacatgtgctatgttggtgtactgcacccattaactcatcatttacattagatatatgtcctaatgctatctctccccactcccacctctccccacaacaggccccggtgtgtgatgttccccttcctgtgtccatgttatttttgaaatatccagattaaatgtagttaagtaaaacaataaactttttcaatgtaggttttttaatgctaatgaaaagctagtcagcatggggtaaattagattaaattagattaggtaaattggaataagaatcaaatgatcacaatcataaaatgggattagtcttactataagtcacacctgcaaaaggaagaagataacctggaaaaatttaaagagtcttccactttacgaagtcgtagtgagttggcaagttttaataatttaaaagaaaacgttgatttcatctaaaaagagagagagaaagttttagttattgattcaacatgtatttattgaataccttaaatgtgcactatttttggttttgtgagcagtcccaaacgattaaaacagagtgacttgttccctgactatcttaaattatcgcaaactgattggcttaaaacaacggaaatttattctctcacagttttggaggccaaaagttcacaagcaaggtatcagcagggctgcactccccctaaaggctttgggggagaatgattttgagcgtttcagcttctgttagctgtcagcattctttgatttgtggcaacatcactccaatctctgcctccatggccatgttgcctcctcttctgtctgacaaatctccctctaccatagtcttaaacaaacagttgtcattgggtttagtgcatattcatgtaatctagaacactctcccctctcaatacttaacataattatatctgcaaagatcctttttccaaataaagcaacgtttgtttccaaattttaggatttaatatctctgggtgaccatgatttaacctactacaaaagcattttctaacaagcagcttaaaataggtttcttttttctttgagacagggtcttgctctgttgtcaaggctggagtgcagtggacagtcatggctcactgcagcatcacactcccagtttcaagcgatctttccacctcagcctcccaagtagtttagaggacaggtgcatgccaccacacacagctaatatttcatttttttgtagagacagggtctctctgtgttgaccaggctggtctaaaactcctgagatctagcaatcctcctgccttggcctcccaaactgctgggattacaggtataagccactgtgccaggctcaaaattaggtttctattgctgcattaatatatacacagggccatctctttctcttctaattattttacaaatataaagagcatctgtaacacaatgaagctgttttccactttaggaaaagacagttttgaaaatgtgattaattatttgttgcaggttaggcttcatacagtcatattcccagtgcacattgtcctcaagatctccccagtttggcactgaagccttattgactctgtctctgaaagaggccttaaatgatcccccttccttctaatcctcactgaaattcccttaggttaagcccaatttatccaagggctatggtcttctacttgatgttctgtttttaatccttgatgctatccttctccttccatacaaacagtagatacacatattttcaaaacacagactttcttgtgttctctacttaaaaatctgtctagctttcagatacataaaggaaaagcaacctggttttaagagcatgcaatgcttcttcttaaatttccgatccctgtccttgtctgcagatttatcacttaacattcctctccttgcttcataatactacacacacagacatacacacacacaaacacacacaaacacacacacacaaacacacacaaacacgcacacacaggcacacacacacacgcacacacaaacacgcacacagagacacacacacacacgcacacacacacacacgcacacacagttccttgatattgcagtcacacagaattgttcactgtttcttgaaaataatcataaactgcatttgctcatgttattttttgagatcagagtgttcttccctcttttttctgctttaaggttttctctttttttgcacagctattaaaacttggccaactattatattttctctatagttttccctgatccttacacatcttcatagctccttacatgtaactctattactgtgtgcatcatatgcgatcgtgtttattttccctgtgtgatttgttttttagactatgaccaccttgaagacagaactgggtcttatctatctttacatctcctagttgtttgcatggttcttgacacatagcaaatgctcataaacttctgatgaactaaattactgtaaattaaagtcattgatacatttaaatggcacgatttacctatatctgttttataatcatagttaacaaattaagcaaaatacttctaggaccaggaactcaatatggagacactccattgtaagagagaaagatgcattgaatcgtttattcagaaagaacttattatgtcactgtaggcactgcacaaaggctaaaaatcccaaaatagaattgttaaaaaattagggtttaagattaaaggcaaaggaaatcatatttgttgagactattagggttgcttgaagtaaactaatgccaagtttaagtaaaaagattcctgctatatgatataattgttaagcctaagagaccagcaggcaccaggtacagttacattcagatgctcaagcaatgccattagggaactgcccatgtttagccattactgtgttctgttattccttttttttttgttttgttttccctctcaggcagattctactcatgtggtaacaagactattattctagatactgtactcatatttaacagtctcagggaaagagtgaagccttttactcaatcgttccagaaaatatctaatggatgaagggaaggctctaactggccttcgttggaccacttacatttctttgaaccaattactctggtcagaagatgaacatgtctgatctttcaggattagattcacatgcaaaataatgttacaattcaaactaggaaaaataaattatatatttttaagagactggatgaaaatactccatacatcacatgtgcttttctttttctgtatattggtatatacataatcactatttctttttttttttttttttttttttggagatggagtcttgctgtgttgcccaggctggagcgcagtggcatgatcttggctcactgcaacttccgcctccaaggttcaagtgattcttctgcctcagcctcctgagtagctgggattacaggcacccaccaccacacccggctaatttttgtattcttagtagagacggggttttaccatgttggccaggctggtctcaaactcttgacctcatgatctgccagcctcggcctcccaaagtgctgggattacaggcgtgagccactgcccctgacccaccactatttcttttgtaattaaaaagtacatatacactttatattttgatgtagatgtaagaatagcctctgcttcaaagacctcattataatagtattaaagacacacaagtaaacaaaggtaacaataaaatagtaatacatatcaaatattaagtatctcaggaataattattccttctaaggaatggcaaagaaatttttcacaccacaaagttaattttgaattgggtcttcaaggaacataacaatttgaaaagacagagaggactttccaggaaaatgtaactacatatgcacaaatgacagtagggattatagtaagaacacttttattattattctacctcttcactctattcaatttccctgactactacaatgtccccatgttggtttctcctttcttgtattccaagatattgtgtcctgcttttgcttattattctctaccccttaagcttctcattgcttcctccttcttttctcttttttctgggcctccctctttgtttttacgatccctgggaggactcatttaattgactcctaaatggtttctgtgtctctagtgtcttgtagacattagaggcacagaaaccatttttcactgtctattttccactcggcatccaaactaattttccataaacattgcttccatcatggatatgtgctttaatagcattggaatcagacagatcttaagcacaatacaatagtatatataccagataccagttatatgactgtgagaagatagtaacttctgagagtctcactactaatgcccaacttgtaagataattatgaaaatatgtacaacatatgtatcactctcagcagtgctagccactagatagatgtgcaatatataagtagataatacttttgtgggtatctatattactcctttgcccataaccaacagtgaaccatcatgttcctttttaagcttggtggtggatacaggtgttcactttaaaagtctcagtctcagatttcaagtcttcaacccatctcctaagctgtcagaggcctttacaatctttacctacctcctttattcagtcttatttcctatcatttccccacaggaactatttgctggccctttaatttctcccttacctcagaacttgctaatatttatcactcttaaatatatgtttttgcttgtgctgttcctcaaactagaatttttctgccatcttttgttatcctctctcttcttttagtttaaataccttctgttctctaagttttttttttccaggacaacctagaaaaaaatatctctttagtttctacagtggcagaaggtaatgtgatttaccaatttaattacttcatattacaatatagtgaccatttatatcagtgtatagtacaaatatgtatactgtggtcttactactgattatcttattcttatttattgcctctccaacaagatgttatcacccatagacaagaatcatattttatatatctttataacccaaagtgcctttttaaaattaatgtatcatgtttgttttcctggaacaggaactgaaatagagagtatgaattcatttgtaactgaatctttgctgtaatagttatccccagcatccttgctaatacagagaatgaagccttaatacctaaagcagccactgtatgtgattaattaacttctctcctatgcatcttgacaggtagtggctatgtgccattcttgggagaactgggaaaatggtcactgaaatcatttttgttgtttctagttccaatgagaaatgccagccgggaaaggctgctacagtatgtagcaaggtgcttttgctgaaataataaaagtatttgcaaggaaatacttgaaataagtgctaaatttccaaagattgatctacactacagaaggcttattagggtatattgatactagtatgtgttgtcttaagtggtacattgtagtttccatgccaattcttggtttaaaacgcagcatgcatctgttatatgccactttccacttaaatgcctaagacaggtagattgcactgtcaagttaggtcattataactccaacagatgttgtcatgtagatgaagaaaattcattttaaatgatatcatttataaaatgtgtttttctttgtacctaaaaaaggcaataatatgtcatattagctcttcagattcaggttgcaatcagtatggcatgttttgattaaacacttcacaatttcaaaatcagtgcaggataatgatggagcacatgtgaggaaacagcaatagcaggggtgtttacagtatcccagttgtttcaagcttaataacacttcatgttatcaatcagttacaaaggaataattggtggataggctgaggaaatggtacagtaagaaattgtacttattctaaactatagggatggaagtgcagccaggtcaatacttatttggttagtatattgtaactaatcatttgagttttgccagctggtatcttatttttgcttatttgtttaaccgcttttaaataagtatataattttaacaatttaagtcagttgaaatcccccccatagagctctcctccaaatgcatccctagctacattcttctttctggagattaaccagaaattggtggtttcatcctgtttatatgaatacattcctagaagataaaatcatattgtagatatttgtgacaaaattttcctcacaactatatgaaagagaacgaaggaaggtgtgtggttaggagttagctgtcattaaaagtgtgtaaattttgcacgttccctacatttattttccagtaaattttactagtttctttctaatcagttgggactaaagtcaatcgacctgtctctgcttctttcaatttcatttcccaaaagaattttagtgcttctctattattcttaactctgccttgccccaatacattaatcaatgctttgggtaacaacattagatttgtacagggaaggaccagggaatggcattccaaagcaacacatggaaagggcaagagctgaatttcataaaccgtaacctaatccatcactgcagctttccgttgcctctacccagactgcagccaaacatactctaagctgccactttagagtatctttaccctccatgggagtttttctttttttccctttttttttttttttttgagacagaatctcactctatcgcccaggctgaagtgcagtacaggatcttgtctcgctgcaagctctgcctcccgggttcaagtgattctcctgcctcagcctcccgagtagctgggattacaggcactcaccaccacgcccggctaatttttgtatttttagtagagatggggtttcaccatgttggccaggctggtcttgaactcctgacctcataatctgcccacttcattttcccaaagtgctgggattacaggtgtgagccaccgcgcctggccaggagtttttcactgtgatgttgtgtaggtctctggaatgtatgtttccctctgcagtttccccagtgttgattttaagggaggaagccagagcacttgctatttcaccatcacacttgtttgaagtgtgagttaccatgcaatgtttaaaacatgagttacacctttttggaggatgctgtagaataccgatttattttttgtgtgaaaacaaactctacctcaggttaatcaaataattactgaagaaaaggtttttctttattcaaatatttcagcacatgaatgaagaagaaatggtaaaagtaaaacatgaacatttggccatcactaattatattagtttgtagaggctactgtaacaaaattccacagaccaagtggctgaaacgacaaaaatttgactgggagttcaaaagcaaggtgccagtggattgggttttccctgaggcctctctcttcagcttgcagatggccaacttttccctgtgtcctaacatggtcttctttgcacccgatggctctctttatggtctaatctcctcttcctgtaactacaacagtctgattagttttgggcccacccatatgatctcacttaaccataattatcttctttaaagaccctatcttcaaatgcattgtgaggtactgggggttagggcgtcaacacctaaatttggggaaacacaattcagctcattaaatgaatggaagtcatacctgaaatcaatgacggatcgtatgactacaaaaaaaggagacaaacattatacacctgctgtttaaagtatacaacacaaaattattgacaaatattaagctgaattaggtcaatcttctagatttaccaatttgcaaataatgcaatccacagagcaagatgtggatatgggggattcagacagcacaatctagctcgggaaactacagaaaaaaaaaatgacccattttgtgacatataattgaaggaacaaatgaagatagatgaatggagaacccataaataaagcaattcaagatacacatgaactcataaaacataggtcctaatttgagtaaagaaagaaaattttaatactgactggttatttgatgacactgagaaactattctaactgtgcagctatgaaaaggaatgagatcatgtccttttcagggacgtggatgaagctggaagccattatcctcagcaaactaacacagaaacagaaaaccaaatgccacatgttctcacttataagtgggagctgaacaacgagaacacatggacacagaaaggggaacaacacacactggggccttccccggggtggagtgcagagagggagagcattaggaaaaataactaatgcatactgggcttaatacctgggtgatgggttgataagtgcagcaaaacacctttgcacacatttacctttgtaacaaacctgcacatcctgcacatgtacctgcacatgaactaaaaataaaaataaattattctaaatcttgggaagtatgataatggtgtcatgattatgttttaaaggacttcttaacttttagagatatataccagaatagaaataatattgtataatgtctgccatttgtttcaaatcaaatctgaccaaagtaggggcaagaaagagtaggcgcataaataaataactcattgataatgagttgataattgtttcagtaggatgatgaatatttgagtttataattttattctatttatatatttgaaaatttttatactgaaaagttgaaaaagctttatattggtattttaaactttgtaaatgttcactaaaagaagatatgtctttttagttgttttgcctgagttatgatgagctttgatgagtcaatcaggctgcctcttgagttttccttgtaaggttaattgggtgcactggagagctagctgaggttaggagagcaggctctggttgaaggacagggtttcggcttggcagactaactaccttctctgattattaaactttgatgccacccacattagcacagtattctagtcacctgtgataacctgtccagaagttgctctgatcgtgttcagctcaataagtttagacttcacacaatagtgcttgtcattttttaccctcttgtaccaaatatatttcaaaatatgtccaatccagctgttaatttgactgaataaaatattataataacacttctgaggattgagatgatgtttgaagtttttcaagagtcttttccctctggattagagaacatctctgccagaatcaaaatgagtctcaaaattgacagtttttactttacttgctacagtaacctggcattttaaaaagcattctggaaaaaaaaaatgaatcttctgattgtgtaataaaagaataagaatagaaactaagataaaatgattctacatgtatatcttgacttatgtctatattttataatttcaacttttacgtcaaaaaattgtaaaatgtcactaattttataaggtttaatttaacagatcaaagctcataggactttgttgaaaacaatgaatgcaaatcctcagtacagttccaggtgtgtcatgagccctccaaaaatgatagttacaatgactgtttcaaaaaatttataccttcaacaaaactttaatcctatttttatatgcctgtctgctctgaaaataatttaatatgtttaaattcctagaataaatcttactttaaccaaattaataattcttaaacttaaatttagatttcaatgaatccccaaaatggtttccacataaagtaatgcagctaatatcagcactgctaacagattacacagaaaggtctattataatgattgagtaaatattcctgggaaatcaaccttgttaaatctatatcctataaggaaaggtgcatatctgttttttctagtaaagattccgtaattgttattacaagttaatcagcttctcccaggttcatttactctggattttattaatttattacaggaaattattgggtaagtaaaccacaattataataaaatctcatacattttattatatggttcacaaactttataaacacctgtgatgggattctgctattgatatttaagtggatatttattaaggaactagagatacttctcagtaagattagcttagagaacggtcctgtttttgatctcttaagattccaaatttttattccaaattttctgatattgcccaagtgtcttttctgaatctatgtctttattatttggcttaaaacctttgtgcatctggtgctctattctgctgtgactttggagaaaggttacagtttgtttttgctgggaggaataacttcttgaatgatgtcccaactgaaaattatttttttggttggatagaacatccctgtacaaaacttcctctattatcccttggataattcctgctgtatatagaggtccaagattgattaatgattttatcttcagtaacctgtgatctaaattaccattggcaagacaagagtgatacctgtttttttattctctacattaataaaacatgccttaagaaatctatatacttcatatagaggatatgatttgccactaagcaaactctatgaaaaagaattgtgttttcatagtaaggctttattataaaccaaatatgaccaactttcagctaaactgtattatctaatcaagtttattccgtcactttacttgctattatcaataagacaagtaatatatttaaatatagaataagtaacaagcaacatgttaactgaattaatatattggtaaaatatagattttaaaagttttttgaaaatatttgaggagggttgcacttttgctccctctgattttactacgtatgtctctgactgtatgtaatcacacctagcttatgctgtcccttccattctctacacttgactttagaaagtcaaacgtagactggagcaaaaaggggagagatcttttcctaccatttagcagattaaaaggtagattggaaatgcatctcagtatctcagccataaatgtctaagggataataatcccgctacatatttattaaactaattacaacatattgcgcaaaataaaatactttgaatcagaatgacttatgaatggtcgattgcatacaaaagtgctggagatatggtgataaaaagatgattcagccatcacaaagctcaaaattctactgggagaaacaggtaaagtgactgaagcccaggataatatttcaaataataagtacagtgagatacttatttgagagatgcaaactcaacaacagtttggtaagtactttctctattctaatttgaatacattctagtcaattgagatacacaaagcatcaattctccccattggatttggatcccataaaactacccatttccccaaatagatagtgttttaacttaacagacctcataaaaagcttgacactaaaatgagaatttataaattgtgatctgtagtaagttaaatggtgcccaaccctgcgaaaaacaaaaagtatgtccatgaactaatccctggaacatgtaaatgtgatcaaatagggaaaagatatctttgcagatataattgtaaagaatttcaagatgagatcgttatggaatatctgagtgggctccaaatctaatggcaagtatctttattagagaaagacatacggggatttaaaacagaaaaggaagaggagacagccatgtgaaaatggagacagagattgaagttatgcagccacaggtcaaagaatgcttggaaccaagagaagctggaaaagacaatgaaagattttcccctagagcctttggatagagccctgcaaatactttgatttcatatctgtcctctggaacttggagagaataattttttgatgtttaagcagatgactttggggcagtttgttatggcagccattgaaagcaagtcgtgatctagtttgccttattttccaaagcatagataattttcaatttcaattaggaaaattgaaattccacaaaatgcaagtgcatacagaaatgtctatctgagttgcagttgggaaacattttgcatttaaaaaggaaaagttttaagatataaaagaaagtcttgagaaaacaagagaatatccctcatatatgtacaacttcttactaatagaagccttagatgtctgatcaatttcagaggcaaaggctaccattgactgttcattgaccattgacaagccatgtgtttcaatgatgaaataccacataacaaaatactctaaagcatattgtcttaaaacaactgttttattactaaggttcctgcggatctgatattcaggcaggattcagtggggatagcttacctctgttctacatggcgctcactgggatagttcaattagggtaagaggattgaagatggtatcatttgcatgtctggggctttggtcctggctgttggctgaggtgctttagttacccttttctctccacatagcctctaattactcaatattctaccccagcctttaaaaaaaattttattgtggtaaaatacacatataaaatataccatcttaaacattttaagtgtacagttcaatgataataagtacatttatattcctttgcatccatcatcacccatctattttcaaaactcctttcatcatgcaaaactgaaactctatacttagtaaacaatgattccccatttccctctctgtccagcccgtggcaactgctattctttctgtttctatgattttgaccatttcaagaaacttatgttaagtggaatcataaggtatttgttattttgtgactgattcatttcacttagcataatgtcctcaaggttcatccatgttgtagtatttctatcctttgtaaggctgactgataaggagagacttacttctgtcatttaaaaacttgttttctatatggcttatagcatttttgtcccttgcttcctgcgtgactgtcttcttttgtgtttagttgattattgtaatgaaatgtttatgtatctatgtcattgacttttgtatattttctatagctattacatttaacatcctacagttataacactcttatttagatttatgccagtttaactccaataatacacaaaactctctcttttacatttccatacccacttcttttggttgctgatgtcctaaaactacacctttacacattgcaggtccaaaaacaaaaactaataatttttaaatatatcagtttcttgaattaaaccattgttacaataatagtagcttttataattgtccatatacttacctttactgtgatatttatttcttcatatatgacttcaaattattgtatagtgtatttttatttccatcttcagaactcacattaacgtttcttccagacaagtctagtgttaacaaactcctctcaacttttgtatacctagaaatgccttaatgtctcccttagtttgaaggaaatttttgccagatataggattcttgcttgacaggtttattttctcttagcactttgtatatattggcccatttctttatggtttccaaaatttctgataagatatatgcttataattttatcaaaaatcccttgtatgtgattaatcacttctcttttgatgtttttgatattctcttttttgtcttcatcatttcaaaggttgataatgtggatctctgagctcattgtatttagagtttactgagcttcttaaatgtttatattcatattctttgttatatttgggagttttggccattatggcttcaaatatcctctcttcttttctctgtcttcttatggactccataatgcatctgtttgtccacttgatggtgtaccaatggttccttattctctgttcacttttctttaatcttttttctttctgttccttggattgataattcccatggtcttctctttacatttgctgagtctttcttctggctgcttaaatctacctttgaaaatctctggcaaatttttttcatttcacttgtactttttagctacaaaatttctttctacttttaagttttctatctctttatggacgtttataatttattcatgtattatttcttgatttcctctacttttcttttagttctttgagcatctttattacagttgttttattacagttgtccagtaggtcccccatcatgtctttttcagtgacagtttctgttggcttattttattttatttttaaatgagccattctttcctgtttctttggatgccttataatttttttttgttgaaaattagacatgtgactgtagtaatgtagtaactccggcaatcagattgtacttatttctcctaggttttcctaggagaaatttcctaggttttccccttttgttctaaatgttgtagactagactgtctctgtgcaaaggatcaatctgagatgtacgtaaatttaaggtcttctcaagtctcttttgagcctgcacctttccctgggcatacacagcaactttctaatttcccgtgtgtatgtggttgcttttaaatgtcttagtatttaatgtctacctccaaaaagaggaaaagagaaaaatgaaggtggcaagcaggcactggccatttaaatcccctggaaattacttcagccagaggggtaggggtgtgcaacaatggaggggaggtgcaacaacagtgactacctagcccttcgtctacaagtccgtgattagaagcagcagtaagcaatcagagcacagatctccaatatttggattataacattccttttgcccatgctggcttttgtgaactgcatgtaagttgctcctgaaacatattcatggctgcctgccattggactaagggtcaggataggtagctgctactgttttaagagcttaaattgatcaaaagtaaccataattttccttataagctttccactggaagtttcaagccttcaatagactccagaactccagaatatttatatcagatagattctgccagtgcagttgttgcctacatggggagacagatttctggtgctttctattttgccagcttcccaaaatcttcctttctaatcttgtttctctccttgaaagctggggagaaccagctgtaattctaatttttgttgttagtggactatggctgtgagaaatgtcctctggatggggatgccactaccccctacacagctcacatctcactcacaactttggttttcccctgctctggaccagcctttttttatttctttatttctttttcacttgattggcttccaaaaatgagaagagaaaacctgtgagatctcttaagattcatgccaccaaatcatatgtcatcacttctgccacattttactggagaaaactcacagagcaaactcagattcaagaaaaggggctgtcttagaccttttgagcttctataataaaataccttagtttgggtaattcataaatagtagtaatttatttctcagagttctagaggctgagaagtcaaggcatcagcagattcaatacctggtgaaggcttgctctctgcttcgtagacggcacatcttgcagaaggggtgaacagtatcctcacatggccaaaggggaaggcaacttccttcagttcattttataagggagctaatcctattcatgagggaagaaccctcgtgaattaatcaccttcttaaatctttaatacaattgagttccaacatatgaattttggagcgcaacaatattagggaagtggactccatctcttgaaagaagaatggtatgtgtgcacagggataggaggaattatctgtggccatcttgcaggcagactaccacacagtgctctgctttttcttatcattttctttgatgacatctgatcctttctcacaaatatctcctttgtaaaacactcagcacttattatttatatcagtcatttgggaattagtcatatgctgcctagtggaatttgttgtcattaaaaattttttcctgttttgtcatttcaaaaacaatcacaaactcttggaggttaaagatgatgttctatatttccttgtaccccgtaaaaccagcatagtaggtatttaataaataactgtcttcttaattataaattttaagtggtgggagaatgatgtatttacactaatgcacggtggttgtattattatccactagattgtttcttgctgcatatcatgcactgcattatttcttgctgcatatcaatcacttagtactgacctcctttttaaaatacgcctgactttctcatgcttatcttacatatatggttatagctaagagttgtgaatggacacagatatgggaagcatatttaggaggattaacaaaagagtaattagaagaacacataaatccacaaggaaaaaatgactctttttgaagtatgctagcattttcaacatgcctgttgagttaatgatttatgggagtttcaattgtttaaatgtttggaatactctgcaataaaataaaaattctcttcaaagttgataaaaatactcagaggcatacttcctcatctgatgattcatagttaccaatgaaacccaagaactccatgcacattttcagcaagagcaaggcatctgatagcaagagagctggaaaggaagaatcatacagtgacctagacaagtgtcatgtcggtcttagcatcagataaactgattgcaatggttgattgtactatctctagcgagagtaatttagaaaacctgaataagaaaccctctcttgttcatcatagggatgactcttggtgtgaacccaatcatattaaacaattgtagaatcaccaagctagacattttatgagactaactgatttattcctcatcttgaaataaaacctgcatgccacaaaactcctctatgctgctgagacttagttctttctttgagaaaaataagagccatttattcatgcaataaattttcattgtgtgtgaattgtatactaggcctgttccatgtgcttgccatacgtcagtgaatagaagaggcaaagatctttgcctatggaacttgcagtctagtaggggacataagttatttcgtaagcttcccctttataaatatcattaatccttactaataataatacttacatcaatgtttatatattttacattggttttctgataatataaaaaaaaattcacaaaataaacccaaccactaataagctgtgagttttgagtgtagaattcttttcattaacaaaccatttcattttcagatcgagaaactaaggtttttaaaaaactgattttactgaaaataaaatctaaccacccatcctaatgttctttacttctttatctgtctttcaaaaatatcttcctttctctatgttgagttagatatgtattcacaaaatctaccatactgtccatatatgttagatataaatttttgagctcatgtgaaagaaaccaagtttgaatagttgaagcaaaacagaagggtttattattaaaaaaaaaatgtgttttctcaaggaccccaaaacacaaagctgaacttgagaagtgagcgctcaaaactattaaggctgtctgcatgacccttgctctaattcctctctgaaatagtgtctcattgattgaggtaaaaaatgacagcagtttctagagctacactgcctgtgttcaaatcctagctatgtcatttgttagctgagtagcctggaacaggtaaattaatccctctaattctcaatttccacatctgttaaaattagcataattataatcatatcaggataattctgacaggattatagcaaaaaaagattaaataatatctaatgactggcacaatacctgcctcataaatataagtcttcagtaaatataaaccaccattattaaataggagatgttaagaattgagctgagctggggagggctgagctgccagatgtgggagtattcagtaagacaacaagccaaaatgaaagtaacgattaagcttttattccacttactgtgatagtataatcaagagtccagaaagaaagtgccagcttcacctgtgtttcattttccctacaaatggcaccacgcaagggtcagatgcattagtacagttttggataactgtcttactgctcagggaaccccaaacaaaaagttcctatggttttatggacctaagggcaggagaagaagcaaggggaagatctaggaatgggaaagtaccaagtactaagtcagaatggagaaaagtgtcctccagggtacccactcctcccaacaagcaggtcttggcagaggctcctggaaaggttcatctcagagtccccagtaaagaagcctctgaatggaggctcctgggctaagaatgcaaatatgtataaaacatggctggccaggggtcctaagtccttgactgcaactcccgtcagacactgcagcacattgtctgtgcaagtcagtttggggagggaagctttcctctgtgaaggcctcccaggcaaagcctttgtattgcctagggcagggcaaaatcatacagaggtttttgacttggagctggattccttgagaggatttctaggagaaatcctcccaaaagtttcaacagtttatatttcatttgtatgttggtggttctctttcaagtgagatataatatagatgaaaagtatctaacatagattaggtattactcttattattactatagctatggttgcttgtatataactgttcagattatagctccaataaaacaacttattttattctctccagagttaggtaatatcattattcctcatactgaaggcttttgaaaaatgttccttggtctttactatacagagtttaacctttctgctctcaggaagaaagacagttggaaattcaccatctaaatttaaaagggggaaaaatctcagctgatagctggtaacacagtgttggctatgtattgagatacttacttaaagcatcatataagaaatgatgtacaggccaggcgcggtggctgatgcttgtaatcccagcactttgggaggccaaggtgggtggatcacctgaggtcaggagtttgagaccagcctggccaacacagtggaaccccatctctactaaaaatacaaaaattagccaggtatggtggtgtgtgcctgtaatcccaactactcggcaggctgaggcaagagaatcgcttgaacctgggaggccgaggccgaagtgagccgagataatgccactgcactccagtctgggcaacagagcaagactctgtctcaaaaaaaaaaaaaaaaagaaagaaatgatgtacaatcactttaatgtgtattaaggttcttgtttaaaaatcatctaaatttgtttagtatccaataaaaattgaagtctcactttgtgccaataattatgtatttaataaatgggaagaggaaacaaaacagtaatttttcttgaacacgtggaaatttatagataattgctgcaataaatattatcatacaaaatatatatttaaaaaacttaactacaatattactgtaaaagagaggaacatgattctatattacagtgatatgaggtagcctggggtgggggcaggagatcaaggagagtttaccccaaactacaggtgtttatattgagatctaaaggatgaggaaaaattactttactaattcattaaagaattgcaggtgtcttaagattgttccagtcaaggaaaactgtatattcaaaaccactgattctcacatttggctctactttggaatcatcttcataactttacacaatactgatgcctagatttcatgcccagattctgatttcattggcatggggtgtggctttggtgtcgggatctttttttataactcccctagcggttctgataagctttagtcagtgctttagaaacaatgtttaaattttcaaggtaggagggttatgccttactcaagaaaccgtaggaagactcatatgatttgaattcaaagaatgagagggaaggcattatgacatgaattgatgaatataaataataacaaatcatgcaaattctggtaggccacatccaaagtttggcctttatcttgagaatactggaaaactatggaaagactttaagcagatgttataatctcagaatttatgtttgcaaagaaagactgtaaagagaagctatgaaattagcttcggctaggatggtaggaaggaacgagttaaatagattcaggagacatttttaaagaggtgaaattggcagagctgggcaaaggattggatctgagaggtggtgagactgacagcttgatttttggctagtgggactgagctgatagtagggatagatagtgagcttaatcttagagatatctgagctccctttgaggtatctaagcagagacagtgaagtgatagtgaaatataaggagattgctgagcttgagatttttattgtttaggagtaaagatctaaattgcaatagagatgctttacactaaccttgtcagtttcataaaaattactttactggtacaaaacatggtaaaaggcactgtaatagacagaaaaatgattcagatggtacccatgaccttaagtggttaattatttaatggaggagataggaaagacagtgagaatttaatgtgattttaaaatgaacatcttaaaatgtctcaaggtagaatggaatagaagagaagaaaatccagcaacttttatcaggttgtaataattaaatgctaaaatattattagaaaaaataataatattgtgatctgatagaaaaggaaagctaatagaatttgagggaggggaatgaccccgaagaatcatgaaaactctcagggatacaacatcatattaggacacggtgtctagttggaaacattttggtttttcattcagcttgaactggagaaccaaaaagaaagaagaataaagaggacagcaggagttttaaatcatggatttgtttattcaaatctgccatgtaccaatacaacaatactatgataagagctaggagtacaactgtggacaaggtagtcatcattctggcacatagtttataggttcatatcatatttattataaaaaatagtttacttgagacaatatccctagttagctttcacaaaggaaaccagtcaaaataatgactttattaaaagaggttaagtagccattctatgagtttgcattccctgtgtgttgaagcaagtttttttttttcttttttttttctttttttgagacagtcttgctctgttgcctaggctggagtgcagtggcaccctcggctcacggcaacctccatctcccaggttcaagcaattctcccgcctcagccccccaagtagctgggattacaggcatgtgccaccacacctggctgatttttgtatttttagtagagacggggtttcaccatgttggccaggctggtcttgaactcctgaccttaggtgatctacccgccttggcctcccaaagtgttgggactacaggcgtgagccaccgcacccagcctgaagcaagttttagggcagtggttttcaaccttggctatacattggaattacctggaaaggcttttaaactactgatgccttggttatactcctggggattctgacttaattgtcctggggtttggatggagcatcagaattttttaaagctttccattctaatagtcaacaaaatattctaatagtcaacaaaagttgaaagccacagttttaagggcatgttttatcactcagactactaagtcacccgaaaaatgagactgagcaaggaacaaaagaattctgattatataggaaaaataataacaaacatttctttagtctcagtgtgtcatgaacacttctaaacacttaacatattttaaatcagttagtggtcccaaaaactgtatgaggaagtcacttttactattcgcatttgagagatgagaaaactgaaacccaacagcacacgcaaagtaagtgttagaacaggtacttgaactcaatcagtcttcttctagagcttcttatctgaactggtatgctatattgcctctaaatgtagtgtaatggtaattttataccagaagaattataaaagaaaggaaaacctataaaaataggatatcattaaatcagttaaatgctagttgataatagagtgattattatgactgcataaaacatctatgggttatacatatgtgtatatagacatatatatgtatatatttattcaaatatgtctatatatagatatatgtatacatatttgtatatatatgtgtgtgtatatatatgctggttctcatgttttcttcatttgtaggaatcagttaacaagttcttgttacatagtatgaaggttctgttttcagtagtgaaacagggagataaaagtggttgaaccatgtgattttttttctgacttttcaaagacattttctcctgaaggaagctcaagtgctaaggctattccacataatctcaagaacgactactactttatagtaatgaccaaactgtagtaatagaatcttaggagcatataatcatcctctagggaacacattttacaaattgaacctatcttgcaggtggaaataccataaagaaaattatcattggagagattactggcacactgcattcattcacatgtcaaagtggaaaacattccaatttacttctataaaacatgtatctgagtcaacctgccatatgtattttttacactttctatccccttacagaatatctaccaaataaatgctgcacatttctaagtggctggcttttaagctgctttgcctatggctttttgttccctctttttctcagctgagaaatcaagtaaacaaaacattgtggctggtagcataggtcctcagtgcagtggatattttgtgtccggcagctggagcattggtcgtacagatgggcttcatttgttccatatgaatacaagttaataaatggagagaattccatttggtattcaattaagatctcccctgactcctgttattaaagcctacaaactattgagcataaaattaaaatcgagcagttcagctctttttgacattataacactgcctgaaaaataatgtaaaacccaagagtcacaagtcattccttacagcccatggcaaataagaagtggaaacattgaggaagaaagagtaaatatttaaaacttgatcattagtacacatgttaggagcaggctactgtgctcatgcaaatacatcaatccagtttgttgaacacaagatattacattaattttaacagaatgttacaagattattattgccaaagctccaatgaaggaaataattaaagcactaggcattttaaggtcttaaaatgacagaaaatactataggaaatcaataaccagaaaatactatagaaaatcaatatactgtaattgaaaggaaattgaattgggtttactttttttatcccgtctaaattttcttcagattgccagaccactgaagatagtgaatcttgttttgccatcagcagtgtgactttctctaagtctcatgtgctgcaagggccatctttattgttttttatttaggaagcactcagctgaatagacagtatgagattttgtgtgtgtgttctctttactagtcttggactcattgttaaaaaaaacagaaacaaaatcaaagacacagcagacaaaaacaaccacctccacataaccagagaagtcaaattaatgagaattcagacatcgaaaccagaggacttgttagataagcctcacacttgaacctaagtgaaattcttctagtttttatcaaacactatgcctgtcattcttgctatgcaataagaaacattaccagttgcagatacaaattcaatttgaatctatatgaatctaactcattttcattgcttattattttaaaaagttattataatcaaacaaaaaagcttgaaatgaacctcagggaggtaagtggatatgaacagaaattaaagaatgttaaaatgagaaatccagactgggtgctgtggcttaaacctataatcccagcattttgggaggctgaggtgggagaatcccttgagcccaggagtataaaacaaaacacttaacaattctgagtctcaatgtcgttgactataaagtagaaatatcttcccttcctaccttaaatagatcacatttatgaaaaagattcataagttataaaacaacacctcaatgaaaaatgctgtatctggactttaaaaagaagtgaattaaatactaattttacctcttagtatatatgtgatcttaatgaagtccttagttttcttgtctgttaaataataatggtaagggcaccttctcatatggtcattgtgaagcttacatgtataaaaagctcagtaccatggctgacacatagaaagtatttaacagtgttcaaaaacataatcaatataggaaataagtattattttatttccttaataatttcttagttataccccattatcatatgtgataagagaatgtactttatttctagttttccagataatctgtatcctaaacattctttactcccaaattcagtctttgagcatcctaactcttgacatccacagctaatatttaggaaacattaaaatttgtttgtacatttgaaggaagaactaagtaaatggaacttaccaatcctaaaatccagactgctgttattaagaagaagaacaactgtacaaatgctgttatcaaaggatgtatgagtcaggcggaaaaaaaaggagaacacagaaaggtgaaaagtctttgtcaagcagaggagagaaattattgtcttgtaatatatatgagagagtctagccaaatattaaacatttttaaaatgaaaagaaatattatacatggtatgaataatatttaagtcattgcctaggttagaagattagatatatttacctattctacctacttcaaatgcttttttgctgtcattgtttggaacctccaaatactagaatgctttagaattataaaaccattgaccatgttcagttatgtttaaaagaaaacatcattctgaggaaactggaaattatatatttataaatgtttgtccatagcattgttgaaacaaatggctcaggtttcactgttaatccagttgctgatatttttgactactcaatacaccaaaatggtacagtcaagttggtgctaatagatgtcatttatttacacaaactgacaataggttcaccaaagttaagagacgaatttaagggggacagaaaagaaattcctgtgtgtgctttggcagcttagacatacttaccacgaacaagattatatcttaaaagctattcgttaagcttaaaattaagttatatggttgtaatatgtggagaaagcacattggaatagctcttcacttaatgttatagatcactttttccaccaatattatttggtctaggaaagtaaaatcctcttgaggaagtaattagaaaaagcacacatcagggaatgtaattgaagatagacttttgttgacctcagaagagaaaagctcaaaagaaatttcgtaaagttttaaatatggcaagaggaccacaatgtctttgataattagactttcaacacatttggatttgctaattggatctaagttctaattaggctttttatgtaactaagaatgacatatcattgtatgaatttaatgtgcttttacagttgaaactaacaattagcagccttttccaaattattttaataaggaaaaagctggctctgctgtttatactgtgacattcccttctcttaagatatattatgtacattttcattttcttaattaaacaccttttggggagcttaaagggaaacttgggttttaataggaagcacctaaattgtttatttgtgggggagacttgccagccagtatgtagatgactttggaagctacagacaaaccgcaataaaaagaaataaatcacaatcatcaggaggaaacagcacaaataaccatttgcccctatgaccattcagttaatcaaaacagtctctgaatatgatgaaagatctgttacatttttaagtgtgcacatgcggaatatgttcccaaatgtgaaggctcatggatctgctttcaggatgaataataggaaatttcttctcaagatgtgcattacaacattctctctctctgtagccttgttctgtaaacagttatctgctaattcaagtcaaatcatctctttctttctccatatttttgattgagagtcatcaatttttatcccattcagatatatagacagtaatttaaaaactggtagccctcagatttgtacattccaagagataagacctatataacagcataaaattaaactactatttgggtgagtaaagagcagtgagtcattgcaagactttaagggaaaggctgctgccaaaatattccaagcaaattgataacactgccaaaaaggcaaattatattgttttatgtgctatgaatactttgaaaacaaagacatacacatgatttttttcaaataaaagcagttgcccttctaaccatattaaaaatagtgtcttttttcccagtaaaagccatataagatcaaattaaaaccattgaaactattagagaatctaacttacagtaattgatatattaaaaaagacattatgttagagttatatgtgctattatttttccaattagtacattactgggactgagtgattggtgtatacataagtcctcattaagtaaaatgtcctcaatgagcctcctaaagcacattgggtactgtcatgtgccatataatgatatttaagagcaagaaatggcatatctaataacttcatttcctatttaaaaagaaaacctgtgcagtactctttccataccaattattctaagagctatcacatagttctccataaagactatacagaggtgatgggactgttcttcaggcagaaaaatgaccaaagttgtcttatctttcagcttggttgctggaatcctgtcacaggtctgaatgggtcactgactgacaagaaattggagaataacatgcgtggagtggttctacgtgtagtaactgttctggtaagtattatctgagcctcgtggttttgacttttggaggttactttatcctatatttctttctttattaactgatgacataatcttaaaagagattttaacaaattctaaatacgctttctaagattttttaatggtcatatttcacagccttcaatttacgtggatcaggatcacagttttgcagacttttaactacagtgtatgtgttaggaattttcttagaaattttaggctcaatttccatcctacagttttctacacatgacaaagtaaaggtatgtctcaggccttctttcattaaaactgtagtgaacatagatagtcaacatatagtgaacattgaaactataaatgaacataaccctgaccatgccaaacaatggtagatttggtaaaatgtacattctctaatagtgaaatattaacaaactaagaatctttttctcgtaagaacctacttcaaagggaagctgttgtttaataggcatctactgtcgactgtattccaggctcagtgctgattactgagaacattgacaaataaaatgacagatataattctgtcttgatagaacttatcatctagtgattctgtgaatgttgaataggattacagtagtttccctttatctgtgggggatgcattccaagacccccagtggatgcctgaaactgtggatagttttgttttcttccaacacaatcacattgtgtagggcttataggttatagagtgtggatatgctggacaaagggatgagtcacatccagggcatgtcagtgggatggtgtgagatttcatcatgctacttagaacaatgttaaattcaaaacttataaattgtttatttctggaagttttcatttaatattttttggaccatggctgattgaggagtaaccgaaactggtgaaagagcaaccatggataagaagagtctactgtatacctgggaaagatctgttacaatttcatttacttattaaaaagtcaataaatggtaactgttataattctatacattatagttttctttcctaatagatacatacaataagatgttaatagaaatattcttaaacagtaaaatactcaaatgggctctgtctaaatagccataaaccacgaaggcatacattctcctttgctattccaatgtgtttaatcatgtgctagtttatagcctgtttcaaaacgtaatagtccatagttagtactttatttttcttcagaaaagtctacttgtttttaattttgaaaaagattttcctatgggctaggtaaattgcagaattagtaaataggagaggaagactttttgatacgttgatgctaattggatgttcatcaaattttataacaccagttgctgccctttgtacattgtttactacaaattaaatatatgcaatgtaattttattgtcaaaaaagtggatttgtgcatattttctatgaaaggacattcaagtgagtgacctattcttctttttttgtggcccataaattattcctagttattatttttaaaagggcttaattgcttttggtaaataattgtaagtatttcacaacttaaatgtgaattcgcttctgtatgtacctaagggtattgatatgcatttacattgatgcactaatattaaaaaagacagatatttaaagtacagcaaattattaatagtctttcctccagtgattagcatgaaaactccagtgatgattgcagtgaaagacggtatatgtgctttgttttcctttgagaaaagaaagcaaatctttaagtccaattaacctcagtcagttttaagcaaatagttatttcgcaattactatatgatagactcagtaatggatataagagaaataatatacagaccttgtcctcaaagtattcatagaatcttgttaggttgatgcacatagagaaaaacagctcagattgattaaatatggttgacccttggtgtctgtgaggcattggttccaggaaacccccacaccaaaatctgcaaattcttaagtttctgatataaaatgatatagtatttgcatataacctatgtacctcctctcatatgctttaaagcattttagattactcttaatacctaatacagtgtaaatgctatgtaagtagtggctctaccgaattatatatttatttttgttatttttattgggtttttttcctaatatttttgagcctcagtttgttgaatctatggagttgagtctagatgcagaacctgtggatatggagtgttaactgtacttactatgtgcaagctactctactaagtcttttgcatgtattgtcttattttgtcctcacaatattctcaagaaataggtaatattctgatctcaagaggaaactgagacatccagaagttgaaatacatacatgtatgtgtgtgtgtatatatatatatatatatcttatcattaagggaaggggttaaggtctagaatcagacttcctgaatttgaatcctaactctgctacttactatctgtataatgttcataaatacatgaacctagaagaaattgaagaataacatgcaaggagcgattctacgtgtggtaactgctctggtaagtattacctgagccttgtggttttacagacagtaagtagcagagttaggattcaaattcaggaagacagattctagacgttaaccccttccctcttaatgatacattatactgtctccagtcctactgtgataagtgtgagaactgaggtgtctatagaattttgtttgacttgagagttgaaaatgcttacgtctgaataaggtgaaagtgagttttattgggaaggattgtaggtacaatcatgttaaattcatttccaggctgaataaaacaattgctattttgttcatgaaatagtagcacttcacacagtgttaacacctgcataccccaggttcaccttcatgactcttaataatctctatttcctgcaagcttagccctgcacagatattgaatatggttttgtgactggagacatggaagcagtgtttttttttttttttttcaagtcttctatgatggacttatcagttgggtgccagttgagtaacaggttgttatacttattacattactacaatatacaatcattgtgtttaataattttgcatgcttcctatgtctttctgtaactactctgagaatggaaaccagtcattcccttcttatttattttctacaagtgccttttcaggtctagctcttagttatatggccttgcaagcttcttctactcaacactgagaaccactctcccctcaccccacccagcaactcccgaatcttgaggctttacctcactaaaccctgaaactaggatttaatctatactcaacttgatgttgtcacctaaacgcaacctcccacccccttatattccaagtatttacgtccaacactttccagaagagaaaagggaaaggaccaatgtgtacatgggaagaagctatttcctcctttcttctattgaaactgaaatctagtcttagctctacccactccctcttttcttaagaaattttatattatcaattacaccaggttaataaaatggatttttcttaccaaaattttgaaattcccattcttatgactgttgatattttattgacttgaaagaaataacttcatatttattttaaactacacaattcagcactctactgtttgtgatcccatgggcaaataagtggtgctctcaaacatttcattgaagagttaaatagaggtattattgacgaagatgtaaatagtgttaaaggaatcaacaaggagtgttgaatcaccagaacctacctagatgacttacatgaagactgataaggcatgggaggaagcattattactagacaaagcaatagagccatgggagagagaccatcactcatagtagtagtgagctacagtgcagaaaaagaaagagaatcactgccaataccaaaatcaggctatgaggaactgggaataagggatacactgatctcactcctcttatctatctcttttcatggtctccaactgcaaatccaaccagaagtcagaggttatgggagcctaagtaaggaagaccatgaaagttagtctttcaggacacagaggaaggcagtgaagccctcagtgaatccagaagaaaagtagagaaaaaccaacacgagcatctaccatttgataggacctattataagaaggttatatatattaacttatttaatccttataaaatttcatatgagtggcactaattacattataaggataaaaatagggtacataagagttaactaaatttctgcctccatatagctagcaggagccagacataaatttcaagatcagagatcctggttccacaaaccatgtccttagccactctgataatcttccttctgaatcagaatggactcatgttaggtataaatgaaatttgatataattattgagatgtgaggattgcatatgttggattgataacttaggagaattttcctaaatttcttcatatatagatttctttgtattcaaccatcaccaaagccacagaaatatgtcttagaaatggaggaaaagaaagaatgataataaaagcagtctctactacttggtgtctcttctaatctctttgtttccataatttgcccactgatctttacttcttaccaagtggtccaagtgtattactacaaaggaattatgaagattttcccgtttttaacttcctgagttatgcaatgtagatagcaataaatgaccaattaagtcattcaattgttttcatggtaattcatgaaaacactattggaaacattactgagttataaacataatcataatatatatgataataaaatggaaaggaattggttacaaattaaaagaaaggcgtgcgaagctatgctgcaacaagtataagatatctgagaaccataaattggcatttgggaggagctcactgattagtaattcttatttacctactttgattggccttaaaaaagacatatacattcctaataaacatacattcactcatgaattcacacaaaacagtcaaagatcctgactttagagagtttttttgttgtttgtttttattgagacaggctctcactccttcacccaggctggagtacagtggcatgatcatggctcactggagcttcaaactcctgggctcaagaaatcctcccacctcagcctcctgagtagctgggactacaggtgcatgccaccgtgcctgactaatttatttttcgtagagacaggggctcgctatgttgcccaagctggtcttgaactcctggcctcaagtaatcctcccaaagtattgggattacaggtatgagccaccgcacccatccagggagtttgattcttgcaagatatcttctaaagctctcaaaatagtcttgaaaaactgcagtgcagttgttctccattaaatacacaatagagcatttttttgcctagaattaccataaaaataattcaatatataaattgaattcatatataaatatatgactggaagtctatagtaaagactgtgatagtgatttttctgcattttataaattaaaaaacatagtttttcatattttaatctctctaaaattaggatgcatccttcaacttctatttgcaattgtaattagcaccatgtttgtctttattagtgatgtgtaaaatagttgcacatcttacaataggaaacattttagattaaataatgtatggtatttttacaaattaagttaatggatattcctggaaagttaagttaaacgtcactgggcaagaagccacataaagagaataactattttaaagaatacctccaaaagaaaaggcagtaggaaatataccaattagaaaacataggacagtaatagcaatgagaaaaattactgtctaaattaaaactgttgcctcaatcatagaaggatatacacagaaataggaaatacacagagatagcttatcttgaatcattaccacaaagcaatatccaaaatatctattgagagaatggtaggtttttctaagcaactcaccaaaggaaggattgtttgcctggctgcagcagacagccacctactgagttatcattttgagtaatttctttttcctaaaaaatatccatcattagtctcactttttggaatttctttttttttttttatggagattgtgactgatatatgggcaccagagtcttaatttgtacaaaaacaaaaaaaaagtatttaggttagatttagttatttatatacatcagcatgaagtaaagcaatgtacttaatttcctcttaatataccttttaacaaaggaataaataatatataattcattttttattcaaagtacttcacacaattttgttgcctttatttcaccaagtctcctctatttaatacacctatgctaagaagctttggcacacactgcaaaaagcactcaacttgcagtcaaaaggtatgacttttagtatcgtactagtttttctgcttaattgatctttgaatttatggaaaccaagacgctgttctgaacttcaatttttccatctgtaaaacaggaataataaaaccaatcacaaagggttactactatattaactggatgaaactatgtgaaagcaggtagcaaaatgaacagtgcttctacatacattatctctgcagtaaaactatgatgtgtaaactcagtaaagaaaaaaaagcatgagtgatcataaaagtctaattattcattgtcatcaaacttcagatttttgtgggagattggaggactctaagggagacaaacaaatgtaaactgcagaataatgagttttaggccccgtcactgttacctcaatttgaaaacctgctaatgaggaccacaggaactcttctgccagtgaagctggtacttcctagaggaaaaatgcacaaaaaacacctaccaccgaaaacaaaagcaccctgaattatgattttcaaaaatatctagaagtttatatatcaattatattatctcatataaactgtgtttgattccaggctagctttaaatagactctatattttaatatataactaaacaaatgcctccagtgatagttctgaaacgtcattgtccttaaattttttgctaaggacattgtccaagtgtttgctacttagagactttcagaattttcatcgctacctcaaagttcaagcttttctgaggtcccagcgtttgagcctcttgaacctggaggcaaggttaggggttgggaaagtaaacttgtcaagagactctactgggcaagccctcacagcaaggagttgggaagagagctgacagcaagctctggtggctcccacagcaatgtcttacgagggctccttcggaggagttaataaataataaagtttggttcaggactccaggcaagaatgacaactctggctgaggaaatttccaggggctgatatctaaaataaacttaaagtcacaataaaatatgataagtgccatgtaataatcctacaatggaaatacacaggatagcattgtggttaagaacacagttcccacagtttcacttctggggtggcaaatgaggagttccatggacccactccccagcaaaataagcagagatgtcaaaaatgaaaaagaaatgaacaaaaaacaacactaacaaaaaagtttacattctctggaaataattgcaaatcatatatctcataagtgatatttagcatatacaaaaatattataactcagtatgaagaaatataaacaaaattaaaaaaaattaaaatgggcaaagatctgaacagttctgcaatgaagatatatttatataaatggtcagtaagcaaatgaagagatgctcagcatagttttccatcaaggaaatgcaaatcaaaaccacaatgagctatgactacaagcccactaggatggctatattcaaaatgacagataataacaaatgttggcaaggatgttgaaaaatcagaatgctgatacattgctggtaggaatgtaaaatggtacgactccttcagaaaacagtctagcagttcctcaaatggttaaaagtagagtcactacatgattacaaattccactgtatatataatcccaagagaaatgaaaacatatgtccatatgaaaacttgtactcaaatgctcatagcagcatggttgattgcagccaaaaatggaaacaacccaaaggtctatcaactggtgaatggatacataaaatgtagtataccataaaatggaatattatttggcaatagaatgaaattacatgttgataacagtgtgcagcatggatgaaccttgaaagcatgctaagggaaagaagccagacacagaggatcatgtattatatgaattcatttctgtgaaatgttcagaatagacaaatctatagggactcacaggggcaaaaagtaattcgtgattgcctaggtctgggaaagttttggagattggcagatgacagctaacaagagtggcatttttgagggggagctggtaataaagttctaaaactgactgcaatgatgattgcacatatttgcgaatatactaaagctattggattgtgcactttggatgggtgaattgtatattatgtaaattatatctgaataaagctactttttaaaaaagagagagtctggttccccagactgcctatgtttaaatccccacctctcctacctgtgaatgtaggccaggtatttaaactctatgattctgtttcttcatctgtacaatggagataatataaattacctacctcataaagctgttataaaaattcaaataactagtacatgcaaagaacaaagaccttctaacagaacctggcacatgaaaagtgtgatatgtgtccattcttcttatgcacagactgttaagggagagcatgaaagaagtatccaacttatgggtaaggcagtcggcaaggcttaaaggatgatatttaaattcatcttgaaagatgagcagggattatcaaggaatagataagagggaagggatatccagcattagaaagagtatatgcggaagtatgtagatatgatattctatcaagaatttaaagtatcctaaaagtaaattcaaatattttctgaagtatatgaaattgaaatacagaaaattccagcaacctatgtgtcatgtcttctcttttttaagagttcctttagagacaattcagtaagaaatttctctgtgactatgaaggtaatattgtatgatgtaaataatattcaccaagttaaaaataacattgctacaactctgatccagtgtaaagtttaggtaaaatagtactcatttttattattgaaacagtgtaatcagtagacatagctctgtgttgtgtacatattttgttttgtctcttcttctgagtgtactcatcttaggtgaatggggaaaatatgatttttataaacagactcttaaagaaaaatggcctatgcaaatgatgtaatttagagcaaccatagtatatgtgttcacttcagcgctcactaaataaaatcaccataagaattgatgcatgacaatggcttgacaatttcttattcttttgtatcacaccaattcttgaaatgatagctgttgcacagacatgtgtgagtattgctattgtatatgtggtagccatgcatgaccctacttttctcctcttggaagctggaacctgaattcttagactaatcaatgagtaaatatttcagagatgtgttatctaatttacttctgaaaaacagatctactacttgtctctagacatttagaaagagattgacagagtcatttgcaaattcaaagatataaaaacagtaggtagattgacttccataatcaaatcaatatttggttagaacatttcacaatattctaaccgaaattacatgaactacattatatactttcagaaatgcagtgtaccactccatctgaacaaaaacataatgttaaggtgtccttgaagctttaagtcatcttttggcaatgcagtagtttcaacataatcacaagacaaaaccagttccacataaaattcttcagaaatgaacatgaatataaataaaaacttgagagatgctactgaaatagattttacatttcagagttacaaaggaacacattagtagctattaaagcttacagataacattaccatctagcttactaataaatctcattgttagtattttctctagtctttactgaacctttaagattattaatttttttcatattttattgatatggctaggatagagttattaaataacttcttcaagttacaaatatgctaaaaataagcattgaatccttatctatctaatttactcccagccatgatgattctaacaaggactggcctaatttcctgccacaaaaggctataaaactgagccaagtatggaaaaaccttttcagacattagtcaattggtagaaatggactttgatacctaaaaggttggaaacaactaaatgatcccaacaattatcccagctttcttgctgctggcagtttccatactggagacatgaaagtatggatccaaaacagaacttgtcagcctcactgagtttacgaagtagagatcagagggtgagaaagctgatgtggttggcgcatattatctcatttttgagatatgttgtaaattagagggagctgagcaggaaaatatttacagaaatgtgaatcttgcctgagtactagaccatcaatgctagagagaaattctacaagtgtgggcaaagaatgacaggaatcagaacaatcgccagagctcacacatgatttttgagaaaggtttcatttggggagatcgtattgtatcaagaattcaaaagaaaatgtagaaagtatgtatttatctttgagttgtgtagtgatcgatagaaatttaggtgaatatctaaatatctatatagatataaagtaggatactcccacacaccttgctatttctgtgttttacatatttccctgacctcccaaaatgtccagttttttgttaggaagctgcacgctcatcttccccttctgagctccaagagcatgttgatgttcttgctgtttcatagctgatataaattagcattgggtaaacgacgaaaaaacgtcacagaaagtttttcttgttcacattttggaaatcttccttctcagtagagaaaagcaaccttaaagttgcaacatcatgattggatttcagttcacaaaagaaaataaattttgacaaatcacatatgcttttcctgtccctcccaaaatgctgcagtcttccatggcagccttaccaaagaaaaaactaagtccctaactggaacttggattctttcaaaggcacagtaagaggttttgaccaatagagaagcattgatcaaatcactatccactgcattacatggtactctaggagagtctgaaatgagaatagatatcttcaaaaagcatccaaatctggggctggtttactcatctgtcagcttctggaatagtgaacatgctattaaaattcagctccttctgggaggtgggaagataatcaaggggagacccaccatactgcatggaagtcccagaaatggaaaagctgatcaaaggaaggaaggtaatatacttttttataatatgttccttgggatttttaatgatcggtcgaaatacagaggttttggttttaaggtgttattttcacagcatctccaggtaaacttccaagtattatgttagcctggatagaaacaaaaaagtccataatgcttgaaactgaatatgtgatccttgcatcatgtttaaaattgttcagcaaggaatttcagtttctctaggtgatggaagttagcacgagcaaaggaactttacaatttttcagaattttttttttttcatgtttggaaggtctcctcctcctcctcctccttctcctcctcctcctcctcctcctcctcctcctcgtcctcctcctcctcctcctcatcctcctcgtcctcctcctcgtcctcctcctcttcctcctcctccttctcctcctcctcctcctcctccacctcctgcttctccttctcctccttcttcttcatttttatttttaaccattgctagtggtatgatttttgaattgggaaaacaaaatattcagactaaatattttcccaatgattcttatgtagagtaatgtactttgcaattcaattaaaaataacaagctaggatggtgttctgagccaaatgtaatctccaagaccatggtcagtaaagtactcaagaaaaaagtattgaggccgagtagtctgaagtctactggggaataaagaagcagctgattagcatttgaaagcaaggtctttcactgttttaaaagtgaaggagaattttttaacagaacactcatcaaaaacaaagcgtttgaaaattacccctcctttgttttatcagtctcagggaagatgcacttcgatacacgtctcaggaattaagatgcatttcgatacatgtaatattacatttggtgacactgctggaacatatgctgagaaatgcaagaataaataggactaatgctcattttctttttttttttaatcacttgcaagtgacatttgtttcatctaggcaggaaagcaggatcttataggcagggtaggtgtaagggctgattttaggtcaagcttttcaatttattatgcaataaaatatagcaataaaaatatgcatctttatattttccagtaaattataggaatctccgtttaattttttatatatgtgctaataattaattcagtactacagtctggatccacagtccttttgataagagctggcacagaggtcatttttatgtgccttattattaatcttaataatatgtagtaatattcctttatatgcttattgtgacacacagaaacttaaagcctttgtagctttaagttcagatgtctccacattcttttgtaaatccctgcagatttgtttcttgcttttaaatatcagcacctttctgctgtctactcttaggtctctgccctctatgcaggagatcttttcttttaagtttcccaccgtgcttcataataaaatcaaaagaaaaaggtacatccctcagaaagcattcatctcactagaaatagaaaacctgtcaccttattcttaaaaccttagatcagccaggccagtggctgaaatagtgagggtagtgtctacaaagggtatagagtaggggtagcaaaataattatgtaccttgttctctccacatcttttagggaagagactctttgctctggaaaatgacttaataccattgggaggaaaacatttcctctacccacttaggttcctatgtttaggggcctgtgaattaactgataatagacagattaacaggagaaaagaaaaggttaatctacacatgcatgtgaagtcactcaataatgagtcgtttcctgaatacccagaggtaaagattggtatagcaacttaaaaaagggaagggaagtgtggctagggcatcaatgtgtagttgatctccttcctgggattagcagaaagctcttggaggagagttaatagcagctgtattgggggtagtgtcagctttagttaggtaagggaaagtcagatcagatttcaaatattttcactttaatctttatgctaaaactgtgattccttcaatatgctgatgaaagttgaagtgtggcttggaaaaaaagagaaagtataagtagatttattctagatataaagcattttttaggtatagtagaaagagagaaagagaaagcaacaggcacacacacactgagagagagattttgacacgaccatgtcaaagactaagagtaccccaagttctttatcaaccatgtagtttctgcaacctgcagtatacacacatgcatacccatatactgatggaggcagtctaaattaatggttaagaatatgaacttcagcaccagagggcattggattcaaatttcaatctttcttactagctttgtaacttcaaacttttttcctcttggaagctggaaactgcatttttagattaaacaatgagtaaatatttcagagatgtgttatacagtttacttctgaaaacagatttattacttgtctctagaagtttagagagagatcgacagagtcatttgcaaattcaaagatataaaaaacaggtagactgactaccataatcaaatcaatattggtttagaaaatttcacaatattctaactcaagttatgtgaactatattatatacttttacattatttatctaccctcaagtttcagttctctcctttgcaaatgacaataacaataccaaaaaataaaaaaactaaatgaggtaatgaacgtaaagtgataaggatgatgacaggcataaagtaagctttttattgtttttatttgctttttcctgtagcctgaaaatatgttcaaggtaaaaaaaagcattcttttgctctgaatctcctttattctaccaattcttttctcgtgtaagtgtctcagactcttcagttgtcttcactttgtcatttatttttatcctcaaatcattgatatttggcttctattttcacttctccaaacaaattgcttttttgtcttcatgatcttctacgtgacaaattaaatgcatgctttcagaccttaccttcctggacctctcacctccattggaatccactggcaatttactcccagaagccctgtcctctcttgcatcttcaacatcttctgattctgacctctctattcctttgtttatttgtttgtttgtttgagacagagtttcactcttgttgccccaactggagagcaatggcatgatctaggctcactgcaacctccatctcctgggttcaagtgattctcctgcctcagtctcccaagtagctgggattacaggcatgcgccaacatgcctggctaattttgtatttttagtagagacagggttttgccatgttggtcaggctgatctcgaactcctgacctcaggtgatcctcccgccttggcctcccaaagtgctgggataacaggcgtgagccacagtgcccggcctctctattccttttacctccttcattggattctcttcttccagagtttcatccctggccttcactatactttattgaatgacttcatttactttctagaaagttataaacaaatttttatttccaaccctagcctctctctcctgcttcagactcattatccacgagtactattgaaaaaagtattctatatttaatgacaaaaaaacagaaaatatggaaaacaaaaattaacagcaaaatcataaataattcttccatcaaaagttacttgctaatattttagtgtctaccactagctaaacttaactacatttccttatctataaaatttgaggtaattgaggtcccaaactcataaaactattgagcatgaatacacaaaaagtttttaaagtacccagcacatactaagttccatatgaatatttgctgctattatttttttcaatttcaaacatgtacacacatgtttcaaattcaaaaatgtagctttgtacattttcttcccatttagcaatatgcaaatgagtatttttaattgaatagatttttttttttttgagacggagtcttactctatcactctgtcacataggctggagtgcaatgccgtggtcctagctcactgcaacctccgcctcccgggttcaagcgattctcccgcctcagcctccagagtagctgggactacaggtgcatgccactacacctggctaatttttgtagttttagtagagacgagtttcactatgttgtccaggctggtcttgaactcctgacctcgtgatctgcctgcctcggcctcccaaagtgctgggattacaggcatgagccaccgtgaccagctgtgaatagatatttttaacagatgtgatcagtagattttttcagccacttagtgaataatttctacagctgcctcaaatgtctattaatttatctagggttgtatgtaattcccagccttctaactgttgacagttttatttctcattccctgaactatgttgaaatgcaaattaatgtctttacagagatatttttgaatctctctattaaaaaaaaaaaaagaaaaaagaaaaaaacaaaccaatcccgaacttcaaaatgctattcttggttttttaaaaaatgacctatagtccaactctgtgtagataattatgtgacagggcattgagacactgaagttgacagcccaatgtgctgtgctgtgtcatacagatagacttaaaaaaaaaaagccccaggctgggttctgtggctcatgcctataactccagcatttggggatcacttgaggtcaagactttgagacaagcctgggcagcatagtaagacccatcccccccccccaaaaaaaaataccaggcataacagtgtgtgcctgtattcccagctactcaagagtttgaagcaggattgcttgagcccaggaggttgaggatgtaatgagccgtgattgtgccattgcacttcaacctgggcaagataacaagaccccatatcttaaagcaaaacaaaacccatctctgattgtagcgtatttaggttgttttcaacttcttcctagataacttgcaatgaacgttttaaaaatatatacttgtgcacatttatgctcatttatgattatttagatgtacaattattagatgagataatataaaaaatttacagcctttcacttttatttttctttttcttttattttactttaagttccaggatacatgtgtagaatgcgcaggtttgttacataggtatacatgtgccatgttagtttgctgcacctaccaacccgtcatctagggtttaagcaccacatgcattaggtatttgtcttaatgctctccctccccttgcctaccccactaacaggccccagtgtgtgatgttcccctccctgtgtccatgtgttcccattgttcaactcccacttatgagtgagaacatgaagtgtttggttgtctgttcatttgttagtttgctgagaatgatggcttccagcttcatccatgtccctgcaaaggacatgatctcattctttgctatggctgcacagtattccacgatgtgtaagtgccacattttctttattcagtatatcattgatgggcatttgggttggttccaagtctttgctattgtaaatagtgctgcagtaaacatctgtgtgtatgtgtctttatagtagaatgatttataatcctatgggtaaatacccagtaatgagattgctgggtcaaatggtatttctggttctagatccttgaggaatcgccacactgccttccacaatggttgaactaatttacactcccaccaacagtgtaaaagcgttcctatttcttcacagccttgccagcatctgctgtttcccagctttttagtaatcaccattctgactggtgtgagataatatctcattgtggttttgattcgcattgctctaatgatcagtgaatgttgagcttcttttcatatgtttattggtcacatatatgttttctttatagaagtgtctgttcatatcctttgcccacttttttatggggttgaggctttcacttttttattgtgaatttgttttctggaaaacttttaccaattttaattcacataagtagtgcatgagaaagtctactttctcacatgcttgctgataaatgttaacattcatttttatccttgccagtcagataagcaataaattaaatagttcttgttattttaatttgtattccccaaaggtatgttaagagagcaaaacaataaataattcaccctcaatggttgctgttaaactttgtctttttaaaatttaagctttaaagattatgactttaattattttttcttctcataaataatatttctcttctaaataattctaagtcacaattatgtagggataaaaaagaaagtatacattttaatgctttcctccattaaatttgaatgtgtgttaattttgtattcagtgctgcaggtttttacagaatactgtctttggttccatattgaacattcaccttgaggactttagtctattgattgaaagctttagttcatctaatagaattattatgacacatactccaactaaaaatcagtcaaggacagtcccagaagttaatactcttccaaagactgatgcctccactgagcacctctaggaagtatgagatggtgttgcatcacttctcactaagttcttataaccccacatccaatatatcaacaaatttcatcagctctaccttcaaaaattacctagaatccaattatgtcttattaaatccattttactgccaagtcacttctgatttattgcaaaaggctcctaattgatctcccagcttcttcacttgcctcttccagtctattgtcaatagtaactgtcaactgtctagtaaactgtgaaaatatatctgatcatgtctctcctctgctcagagcccatctggcttcctatcttagtcaaagtaacagctgacatcatcatagtggcctaaagactctagtgaagctctgccccatccaaatacattgcctctcagatatttcctaatatgtggctctagcttccttggtcctagccacgctagtgtctcttctgtctcttaaacaagtcagagactcttaactgctgtatttatacttactctttcttctgtctgaatgctgtttctacagaggtgctttctaattgaaggtacaatcatttctcacatatgccttcttctcattatttgtttaatttctcttcacagcacctatcatcaccatctgacattttatatatatatatatatatatttccttttttgtttgttgtctgtcactcccactaaaatgtaggtctagaagaatagaaatgttcgtttgttgtttgttttgttcactgctgtattcttagtgtgtgcctggcattaacactcttttgaatgactgaataaatatctgaatttctgctatttccctataagtaatattattttggatagaaatgccactaatcctgaaacattttcaagttttatatggtttttatctttaatatttgtgtggctttctgctacattccaatatttaattagctttagtttacatttattaaatgcttctatatccagataatgtcatatcataagtttcagttgacatttattaacattactacttcttataatattttaacagaaatatgattcatcaactccagtgtttgtaaatatcatcaccattctgaagtcaaatgttgccaaagtcttccattaaatacttgcagacttctctcatttggtacagccagtcactccttacagctgcaatatgttatatctcgaatgtatttcttgatagctttctttaagataactgcacttgcaaagttctttgtacctagaaaactttcaacaaatatttagagaatataatttactcatgcatgtggatagacacatgtaagattcacttaagtgtcaaatttactaatataatgaaaacttggaccaaacaagcaacaaaaaatattatccagcactcatactcaaaacgcagtctgagagtttggtatttttcagttcctaaaggttgatcatgtggttcataaaatcttagtctccaaaatgtattttcaaatgaatgtcaggcagaaccaacaaatgagaactagggtacttaggattattgtaattgcctaatgtgtttggtgaccttgtattcccacttacagcaacttatgcttctttcaaattcttttgtacaaaaaaaattgtcttgtccactctccacttagcctttaagtcactaagatgtggctatttcattagttgaaagcaatgtctaaaataaaatattttattttaaaaatcaatcatcttgcataataatagctttaactttatgctcaatttaaaatatttgtatttaaataattgcttacagaatagaaatagaaatgatatataagataatatagaagatgtaaggatttaagaagttaggatgacagtatttttatttacttttatcatttgtaattgtatcttattgtctggtaaaaacatttaaggaaagattaaaatctaagtttaatgtattatttataaacatttgctccttcataaaatcttcctgcaatccctctttttaaaaatgttttcattgcatatcccgatgatctgcttttcttctctccatgaaactcagatactagttttctttacaacacctggattgtttcttcctctactgctgttccttattttgtttttctattctggtgtcttgatatctccttttaacaaattccataccattggccttcctaacttgtgaacatttctaatactcacatatgctctataaaaaaaagtgaggtttttccaagaagaacagtggccattaattctgcatatatcaaaatggaatgtgtcatctttgagcaaaatataagctcacaccatgcataaagacaactattgtttgcttcagccaggagtatgttttagggaaaaaatattttaaacaagccattaagaaatagtctcttttttctttaatgtctttgagctacatatgtgagcagaattataaagaatttccagtgactcattcttagttttggccttcctggcattctgtagtcgtgcatattaaaacctctaaacagctctcagtaaagccttggcagtagagcttgtagcttgtacctatcaaaaatgtcagatgcttttttccaacgccatcactagcaaacaatattacttagttattaacatataggaattaacggcaaaatctgcaagttgcaaacagtgttgtaaatcaactaagcatttatcatgagattttttaagtgactgaatacagattcagaatcatgaagttattatctaataacccaacaagtgatgtgaataaatccttgctaatatgaaaattatcagccactgaaacacccttttctacaagcaggtctgtggatcctcatgctaatgtacttagattgataaaccacagacattctctgaaagcttcgtttgttccagttgctgaggcttgtgcttagagcatctgtcatgcaaatgatcagcaaatcataacctgtaatttgttttcatttaataggcagacaggttttcaccaatttagactcaagtcctattaatactctttgaaactaattgctggaaaatgaattttaatgacaggattttatcatttattattttcccttctgtccctataaaggaagactcaaagccatctactcacactttgaaaatatatgttaaataggcacaagccataatctcctgtcatctgggctgttgcaaaggacccctaatcccctctcttgtaataatccattctacactctactcttaaaattactttcttactatcccatttcccttccacaaaatcttcaattccctgtcaagtaaatagcagacactttaatatggcttcgttgccctccattatctgtttgcagtttacatatttttatccttatttgatatcgcaatataacatgtatacagaaaaaagcatgaaacattaattaataagtagtaaagtaacatccagaaaacactactcagagcaaaaagcagacgattgtcattaccacagaaaccacctccccagtgcatctttctgatcagacccttcccagcatcccagagtctaaccacccagagataatcacttcctctattttctttagattgtctccagctacgtgtgaattcttaaataatatggtcaatttacccatttttgaatgttatgtaaatggaatcaaaatctgctttctttggctattgcttttttcactcaaattattctcttaaacattcattcattttagggtacagcttcagttaacttcaattttaagctgtttagtattccactgcatcaatgtaccacaatatatttatcttttccatgttgatgggcacttggatttttagattgtttccacatttgagctattacagacaagggtgctatgagcattcttggatgtatagtttggtgcccagtattcttttgtattcatacctaaggagtggaatttctaggacttagccatgcatattcatactagataaatattgatgtaatacgtaaaaccaagtaatattaacttgtatataagtagctctgtatgctactagacaagtcaaaatatttttcaaaatggttgtaaatttatatatcgagcaggagtgaatgctattcactcctacttctatttcgacttctagaaataggagcacttctatttctttatatgcttgacagtacttgggattatcagactacctcactttctgttcctcctctatttattcttgctttaggattttctatcctcttgtttattcttccttcaccctggatattaattctgacctattgcaattcatgaattctttcttcatctgtttctaatctattaatgactcagtcatatgttaactttggtaattgtcttttctaattctcaaatttgtttagttctttttcaactgcgtaacaacactcctttgtagtttccagtttcctgccaattaaaaaagcattgcccttcatttcttcaaacacaataaacataatatttccaatatgcatctgaaaattctagtatctaaattcttgaggatcaatttctgttccttgtttcttctgcaggttctattattgaagaattattatgttggtgcaaaagtaacttaggtttctaccattacttttaatggcaaacaccacaattacttttacactaatctaatatttcttttcaccacatttctttgatttttgtttggacatcatattcaaaaattatttgaaggaatcatgttacacctaaagtaatattacctttttctagagaggattgtgtttttctctgtcaggaatctggagcctccatcagggtaccaccataaattgtgttaaaatttgagattaaactatgcagtcctggattttaatccataggtggaaaaaaatagagtttcaaagaggtaagcttcaattaagacagattatgatgcctccttcttctgtaacatattgtgtgactttgagttgagattcttcctaagttttctgatctattaaaaaagatatagctggtaatccccaaaatcatgattttccttttttttttttttttttttttacagtttctactgtatttctttgttgtcctgtcagtaccagttatggtgtgtgttgctttttctttctttatatttttgttgagcacagtgattgagtacatgccccactaatagggtataattattttgagagtaatatctatgacttaacaccatatctctcactatattgagtgtagtaccttgatgcagtagctagctgctcagtgaatgttaaatggataaatcaatgactgaataaattttagagataggtacatagataaaagtgatcaaaacaagctaagtattactgcagagaaggaacaagtatcttttctattatagttcccaaagcttcaaccaaatttcttttgctatgtttacctgtccaatatattggctggttgtactcatagagtactagtcttagttagaatttatgagtaatggtccaaatccgtaatagagcttaaaactaaagctttaaaaacattgatccagatgaagaatgataggatgcaatgaaagtttatttagggcataaaatttaaaaggtatgttatcaataattcattttgaaagtccccttaatatagccatttctattctgtatctttaaccagttataggtgacattgctaggaacagattttgacagcagacttgtgcaagggatctgtttgcctagagatttacttaaaaggtagaattaaagtcatttcaagaaagaaatttaacataagaaaatataaccatttagtacactaaataattggtctagctagttatgagttaaaaatgaaaaagaattaatagtttttagcaacatatacattgggacagtatttttgccacatctatcatttacctatgcaataattaaattcataattttttaagtgtcatatcgaagagtgttattcaacttcctggtgattaaattactgataaacatagccgattttttttggttttgcaggtcctgaaaaatagagaatgcatatgacttccaaatattggtagaagagccagtcaaataatatcttccatgaatcctcttacaattaatttgctgattgatagatgttcaaaatctagaaatgaatgagttgcatgtaaggaaatcagtacatgcttctgctgccatcatatatcacaatacaagcattaaaagctatattaattatagaactttatgatcttatttacatggtctgtgaatttgatctttattttggaattcctttaatccattctgattctaatcacctcaggaccaactttagtgtatttgtacaaggcgtaatcattggctagctctataagttgtccaaacaaccaaatgagatgtcgcaaattctgccaattgtgtaaagttttattatgtactttaaatatatgaatatttggaatatcaagatgtgttgtattttaccaataatattaaaggtttgcttgttcacttttcacttgtattatgatgtcatttaaacaagtcagtattattagaaatctgattcattctgaaaacctctcatctactgatctaatgatcttcaatattcattaacatgaaatattactataataggaaaaaaatcggtaccttaacaaaaaatatggaaatttatttgtttatttattatttttacttatttatttatttatttatttatttatttatttatgtttttgagacagtctcactctgttgcccaggctggagtgcaatggtgtgatcttggctcactgcaagctctgcctcccaggttcacgccattctccggctgcagcctcccaagtagctgggactacaggcgcctgccaccacacccagctacttttttgtatttttagtagagacggggtttcaccatgttagccaggatggtctcaatctcctgacctcgtgatccgcccacttcggtctcccaaagtgctgggatatttctttctttctttcttacattctagagccttggcgagttggcccaagtgttgtacagcattttcagtgtcagggacatagacttctctcctttctctgctgtgtgtagtctcagatagttaccagagcaccagccattgtatgttctttctagttttcaggtagcagaaagaataagaaatgttgcacaaaccaccctgtttacatcacgttggccagaattagtcacatggccatgaagcaagccactttgcctgaagtaggactacagattgtctttattctccatagtggtaaaatataaaaaaatataattagagaagaagagaactcctctggaggacaactagcagtaacctactctactaactgtccatttactagttcattttgctctaagataacatataaacagtgaaactaaaatatgttttcaaaattagaaaatgtaagtaccttagataaccaagattaaagaaatgttacaaataccacaatatcaacatagttatagatgaacatcaaacttagtactgattttctgaatatccaaaatgaaaagaaatacctcaataattggttacattgttttttatcattttgaaaaaggcactactgaggcaaatgaagctctttgaccctgaacaattacaaaatttatctcatagcaatttttagggagaaaattgtatattatagttgacaatattcctataacaggtgcagtgattttataagctacttacagtgtctttgaataaaagccaaaatgaaagcattatgaaggctattttgtgaatctctgaggaaaaatcattcaaaaaaaaaaaaaaacctttggctattctggcttatatacaaggagaaattttagcctgcccagagggctggatggactacatacaccatgaatggttatctgtaaatattactgttgctgaaagatttctgaacaaatgtagaaaattaaggaatagattatctagttttctgtagtctgccagcatgtttcaaatcaatcgagctttcttaacaccaggtgttctcagaagtgaaaggggcctatttgttagctttaaaaagacaaaaatgggaaaagataaaagaggtggaagcagaaaccaatttgctaaatttactaaattagacagtttattgaaaaggtaagtgaatttctcatatcagtcataaagaagctatttttccaatgaaatgtgtgtttatatcaaagtcacaaaattacttagtgaataactcccagtaaatgcgatattattaatttcagctaaattatatgttcttagaatttttttatcttttcagattgttttatgtagattatagctgttaaaattttattggatgtaatttacatggtttacaaacaataaattcctgagaatagatacgataaatttatagtttgttgaatgatttattattaaggagtctcagattggtcctccgaggacaggaaaaataaattcatggaccctaagttttttagttacttttatctaatttttgatatggtaataattaaaagggagatgataagaaattgaatgattaagcattgttaaataatatgatgcgttaataatgcataagttatattcctgagttgattctttcaaagtataaaacaatttttagatttaatcaaaactctttaaagaattaatctttgcttttagggagcactatagattgacatcagaaatttctcttatttccatgtaggaagaaccttttgtgatggtctctgaaaatgtcttgggtaagccgaagaaataccagggcttctccattgatgttttggatgccttatctaactacctgggttttaactacgaaatttacgtagcaccggatcacaaatacggaagcccacaagaagatgggacatggaatggcttggtaggagaacttgtctttaaggtaagaattactttatttatttgtctcatacttaaaggttcaattatttgtctcatacctaaaggttcaacagtaacaccttgaagctgatttcatataaaataagtgtgatgtatttaggttggttaagcattaggtggtggaattgagtacaaaagtctcactcaatactattttatgaactttgtggaaagaaaagtagttgacaaaataaacctaaatgttaaaatatatcctgtaatagaaaagggtttagaagaagaccttttctttgctcaacttataccccaaaaacagaaagtgtatatgatacgtgatgaaatcacaatgtaagttacacatgcaatttgtactattttttttctttctttttttttttttttttttttttttttttgagacagagtctcactctgtcctccaggctggagtgcagtggctggatctcggctcactgcaagctccgcctcctaggttcgcgccattctcctgcctcagcctcccgagtagctggactacaggcgcccgcccccacgcccagctaatttttttgtatttttagtagagacggggtttcaccatgttagccaggatggactattgttttctttttaaaaatgtgatgttattggaaaaaattaaaacattcactgcttagaaactaatcatttcattctgtaatctaatcaagataggtatgtacatatgtatatatttttctttgttctttcaattctcagaaaggtgtttaaaacctctatgtccttctttagtcctgtcagaatctgcttcagttttttgaggctctgttattaggcacatagacatttataattattacattttcctgataaattattgaatagttgggtttaggtttataacttactgtttggtttatatgtataccatttttttctctgttgcttcttttcctgtttttcttggggttaattaaatatatttcagtatttgattttattgctcttactgcctttttagttgtctccctttgtatttttgttcgtggttagtctaaaggtcataatatgccttcttaacttactacattctatcttaagttaatattgtactacttcacataaaaagtaataaattttcagcaatataattttatttgtactcactcctttttgatattgtgttcacatatttatattttattaacctcataccaaatatcatagttttttatttaaatatttattgtcttttaaaggtacagaaagaaaaaaaaaaagacagttgctgggatataatcacttatctaccgtgtctggggctctttattccttacatatatttgagctcccatttggtataatttaccttcaacctgaagaactttctttagagtgtcttgaagtgcagggctacgtaggtagcatatactctcaacttttgtttaccttgaaatgtcttttttaaccctcatttcaaaatgatattcttactggatatcaaactctgaatttacagggttttttaatgttcatcattttaaagttgtgattctatcagttttgccatatattatttctgatgagaaattagccatcatctgtatcctgattctttatatgtagtatatttttgtatgtgttagtggccattctacaagtttctcttcattttttggtgtttagaaatttaattatgatgttctagatatgattttctttgcatttattgtgctgagagttcactaaacttctgggataggttacatttagtaaatatagagaattatttcttcaattttttttaccttctttcctttctcttcttgatttgaggctcagagaatattcaagttagatcacttaatgttgtctcctaagtcactgaggccttgcttgttttattaagatatttttactccctgaccttcagatttgacaatttgtcttgatctgccttcaagtttactgatattctgccaccttcaaatttttgttaagtcctttcagtagctttttcattctagattgcttattttttctttccagaatttcaattttttgaaataatttttacttttctgctgagatttcctatctttttatcagttatgactttcttttcttaaaagttcatgatcacatttataatggcttctttaaagtccttgtttgctaaaatttcaacatcttatcatctcagaatacattgcattttcctggttcctcacatttctggttacatttgattatatattggacttcgtggttgatacattgttaagacttgggattatgtctctgaaattgtatattctgaaaaggattgatttttgcttcagtggatagttaaatcactatctgttctcttgaatttgtggagatttagctttaaacattgttaaggcaggtctatttgatgtaatcttggtccctagggcaaatcccttggttttcgtagtccacatatttctaagatataaccttctggagtttctggggaaagcctgtggttctcctcaagcccttctgacttaaaggaactcaaaattcaatctgtatcttccctgtcataggcaacagttgtaatcccctctttagcacgtttagccttctagccattactctttgctaattttcctaggatctctcccatatatgtgcagtttaggggtcagctaaggattttagaaagtttatacacagattttggggctcactcctctgtggcatcctccttcttgtgtttcccttttcaatttctggcaaccctagctgattcaaactccatcctctgacaagttagttaataagactgactttctacttgagctctgtcgaccccatccccgctgaactgaagtgggtcctcaatgactaagcctaataaaggagggctctaccccgtgcagttattattttcaagggtaccctgcagtttctgcctgctttgggttgctctccagtcttttctatatatttttttcaatttgatcctgaatttttaatttttattctgatagggctagtccaataaaagctagtacatcattgctagaattggaataatttctcaaatgctttaaagtactcagaaggctagaggatctaacctaaattgtttgtaaggaatggagaagagtagaaataaaaggtttcttaaggcagtggtagggaaaataataaagctatttctatattctataaaatcctaatgaatttggtctatttaatacataagttacatatagaattgtattggaaagcattaatatcgttatttttaatacaaaatgggcaatcgtcagtcctcttccttcttattaaaaccgtgccccttcatcttctattcttttaaaagtcacaaattcagtgttccacctttatctttctaagggctgtttcctgatctgaacccagattagcaattacgttaaaattagtgtaaagaaaaggcattatacaaatttattctatatagatagtggttaaaatccttaatgagttattatgctaataaactacacttgctagatgcaaattaaacataaaaagcattcaaattagtatgttgatgttgtttttaatttgttttatgtgcttacactagttagtttaattttggagacttactttttcacctataaaaatgaggagtccaagtatgttaatggtaagatcacttccaaatactatgttttgaaaatataagtttatcgtatagcaatcatacacaagaaatagaatgttcttcataaacaatcaatttcaatgtactatttgcatgtaagagcatgtcattattgtatgataatttatagtttagagggagtccttttgcaaataaaaaattgaggcttaaagaagcagacatatgatttttagacagaaaaaatataaaattattcattggaactaggtttttattttgttcaaccggatatttagtcactctgactaggcttcaggaaaactattaagcaggtggaggagaagaaacctacaaaaaagacttagttggagtagatagagagattaaaagaaaattgagaaaatgggttgtcatgaatgccaacagaaaataacatttcaagaaggaaagagcagtcaacattagaaaatgactatcaagttaagggtacacaacattcccttaactgtattctgactgttatcagtagagatgtaagttataatttttaacaattacaaatgttaattcaattacataatgatactttaataaaataccataaaataatttagctttccaagaaaattcatcatattcaaactttatgaggtgtatttacccctataaaccaaaattacaccgttgaaatggcataaaaatgttatgatggagctccagaaaagcaagcttattattgttattatatcttctgataatatacatacttttgtgaatctaagtatattttaaataaatgttgccactaaatatctctgtacaagacagtaagaattttaaaattaacaggattaactcgtgtgcctttctaaggggctaccaaacttaaaagaatgtttcacatagtgcaattatatatatcataatgattatgcacgtaccatcacattaaagaagagtcaaagaagaaatgttggaaagtgagctctgaattcatatgattattccacagtgattagatctcatgttagagagctttctcattaaaaccagaagtcagtggtccagtacatacatacttttaagagaggaaaatgcagtcagagagagagagaaaatgattgatatgatgtacatatggagtctatttaaaaactaataatatagtaaagtctcctcaagtccttctctgcctcactactcttataattttctgcaattaatgtgttcttaaaatttatgaaaacacaaatctggccaaaagatatgaaacagataaatgagagatatcttctgcctagtacaggagaaatatttaagggtgagttaatgtaactgagaaattattttctcctagtttagaagggaagagaggcccacagagaactttcaataagaaataaaaagtatatcaagtttaggatagaagtaccaaaaaaattaaaaacaaagataactctgaattagatacagttggatgtttgatgatatagtttcttctttggctggctttcaagtcagaagcttttaaagtggagtatttaggggtattagaagactttccaagggcaagccagtatattcagcacagaaaaatttcaaggtgttgagtgacattttgaaatagaaactaaaaacttcctttttcatatattaatttgtttggaaaagatttctataaagtaaaaaaatacagaaattaaatcttaatgctaaactctacctcatttaaaccataattagtactgacccatggatatctaaattatttttttaaaaggctctatccataacattgtaagctgcatttgtagtaaaacttcatttttatagacactgaatccatagatcgtatactaattgaatcatgactcaattcagaaaaaaagattttatacctaaaactttatagtcactggttatttaaaaaggattgtaattttaatttgtatgcatatttttgatgcaaaaatactttggtgatcaagaaaagactttcaaacacacatttctattgtacttgaattacaattgtgtgagggtggggcggaatataaatatagttcaagcataaaataaaatgatataaatattctacctattaaagcatgaggtcaaatcactatgatatttagattctaacagatatatttttaaaagtgacttgacaatattattttaagttatcaatatttacaacacaatatacatatgtcagtgccgacgcccactcaggaaaatgaaaaccattcctaaaattttgaaaagaggagaatttaatattgtgggttgatcacaaaggcgctagaaggaatcaaagagcaaaggatgaacagagtaggacattggaaaagcaaaaagaaaaagtaaaacacagatatcaagtgttactgatgtgtcagttgattgtatctgccagacgtatgccccttgatcagacctggaattgccaaaaagttgctgcccgtgccctagctgctgggatcaagaatcgcctactgccactgctgctgcagccactgaaataaccatttaaagcagacggctcttctctttctttttctgtctgatatcttcagtggtttccctcaggtggaaattatggagaagccagatggcaaaggagcctgggaaatctggtttgcagattcccatccctataaggctcacagtatatagcagagtagaaaatggtatgtataggtttaagagaaaacaggtaatgatcagtactgtctgcaaattgcgccctttacaattttctaaatgattgcaaaattaatatgtcaattataaatgtagaaagatacatacttaaaaaattcctttggggtttatatgaagaaaaaagcttgatggttattacaatggaagatttattttatataaagaacatgactggtcgttttggatttaaaaataatctgttccttcagcctaattttacctgagcgtttccaccacctggaaattaaatctcttcatgctaactgattatcaaatgctaaattatatgacaagaattttactccccaaggaaaatagatccaacaatggaagaaagccagaacccaggaaaatggaaaaaaaggaggaataagtggactaaattataaatctgtaaaattaggataaagtactatacttagcatgtaagtattaatagtgatgtttccatgttaaaatatagcaccattgagagtcctatctctcaatttctaaacttctagtataacactaggcttttcttgtcactgtgcccacccacgtggtttcatgagagtaaagaatgtttttgaaagtagacatataatattggagtataataagatactatttagtaattataatgccaataatgtcattttctgagaaagaaaatgctcccaagactaaacagagtaaatcagctgcttgggactacacagctttcctaatttttatggttgacacaaagtttggcaattctttagttttactaggtaaatgaattcctatgatgggtattttagttcatcaatgcattaacaatagaaagcatatatttaccgggaggctttataaatattttattttattattttatttatttatttagagatggagtcccactctgttgcccaggctggagttcagtggcgcaatctcggcttgctgcaacctccgcctcctgggttcaagcgactctcctgcctcagcctcccaagtagctgtgattacacgcacccaccaccatacccggctaatttttgtatttttagtagagacagagtttcgccatgttggccaggatggtcctgaactcctgacctcaggtgatctgcccgcctcagcatcctaaactgctagaattactggcatgagccactgcgccctgcctataaatatttcaaaacatatgccacttaacatgtgttaatcacatgccatggtcaaagtgctatggagggatgcaagtgtgaataagacatagacattgatcatgaaaacattttgttgatggtctctatgtgctatgcactgtgctaggcactggagatacaaagataaataaaacatggttcttgcccttgaagagatcttgtcttaatgagaaacacagaggttaaactagacacttataatacaatgcactaggtgcaatgatagagaagcactaagaaagcaacaaggaaggtagagtaaaggtaaatttcctgaaggaggagaaatatagcctgatgacaaaataacaggtagtaattatctaggtaaagagggattggcagaaagtgaaggacgtctactgacagacacaagagtagaagtaaaggtagaaaggttagaaacagcatggaaagcaggccaaaatttatgagaattttgcagctctccaagcaaaaagtgatgagaatctatcctaccatactaatgttgtgaagagaatgaaagacaggaaatcagagataaaaaggaggtaggataaacagaatttattggctaaagtgaggagaagggagaagtctggaataattcatcagttcatagtacaaatacataaaagggtggttgtgtaactaattgggacagagattgctgaaaaagatttagaggaggaggacagtttagaatagggtgagttggatatgtagcattctgaagctcactgtgaaagtgccataggaggtatacatttgggagtcagcaacctgtgggtggtagttgaaatcatgaaagtacatcagattgccaaaaagaacacatggagtaagaggatcactgggctaatcttaggatgaaacccagagaaagctgtcacttaagaattgacaaaataagaagaatttatgaaaaaaaataagaaagtttcaaaaaataagctatgactagcaatgtcagaactatttgagatgttgatgataagaactgccaaatgttcactagattggccatttgggagttgttggttacccaagccagaactcttttggtagcatagtgggagaaaaagccagactgcaaaagatgatggaaaaacttggatgtgaaaaggtgaaaatgacatgcatatgtattattttttcagaaattttagatggagaggggaagaaagagataataattggaagggtcattggttttggtagagtttttgtttgtttttaagttaaaacagagacttgagtaaaattataagctaaggaagaaaaagaaagaaggaaaatgtaatataagaaagtcagttaatatgtgaaggataaatatcctggaacagattcaactccatcaaaaatgattaaactgaaaattgattttaatgaggtaaagatgttactttgatactgaatataatataatgagaatgtgtatgttaataatagataggcaagagaatggaaaattgacaaagatactttcttattccttcaaatttattgataaaaattggagattacgtatgttgacagtgatggggacatgtattatgtaacagtctacaggagagtggtgaagattgaaatagacattgaggaaagggaaagtgactgctaaatcagaacagataaaagaatagatcagtggcactaaagactgagtggaggtttatatgaaactgacacttttttattgctgctagtttacacaacagtgtgactttcttcagctgagattgagtgcccaagtctaggagcagagatgaaaatgttcatatcaaggttgagacatggtggataaacttggtaagggaattaaatgagatgaaagaagagctaaaatgattaaggaagcatagccatgatcagagacataaacttggataaaattttggaaatgttaattagaagatcaaatgaagttgaaaaacaggtgaagtatgagtgaagaaatgaaagagtaggttagaaagacataaccagagactgaaatacgaaagttctagaatttgaccttgaggttcatggcagagtgttagagaaaacaaaagaaatgagtttaaaatagctcaaaatggagtgagggagggagggatgaatagatgaagcataggggattttcagggcaataaaactattttggatgatactctaatgatggatacactgctgacattatacacttgtcaaaacccatagaaagaatgaactctaatgtaaactgtacaccctagttaataatcatgtattgatattggttcattggccaggcaaggtggctcatgcctgtaatcccaacactttgggaggccaagatgggaggatcccttgaggccaggagtttgacaccaatctgagcaacatagagagacctccacctctaaaaaaataaacattaaaaaaaattagctagacatggtggtgcatggctctagtccgagctgttgaggaggctgaggtgggaggatccctttagctcaagagtttgaggctgcagtgagctgtgatagcaccaccgcactctagcctggatgacagagtgagatccgtctccaataatgattgtaaggttcattaactgtaacaaatgtacctcaccaatgcaacatagtaataatagggtaaattattcacactttctgctcaatttttctgaaaacctaaaactgctttagaaaataatatctatctgaatcatgacccaaaatgattgttgtaaggaatatctacattgattctgaaatatattaggaggttggtcagtttttgtgtgaagagaaacatttagccaggtctcaaagttttcagagaaggagaagaagatgctattgtgaggtttgtctggtggaggtgatgagacctcagaaagcacatgtaattgacaacataaaacaaaacaaaacaagaatggagatagcatgaatagagtctcattaataaataacaaaaaacaggttccttgagtatctaagaaaggcaaaattccatggcccctaataaatagtgaaaatgatggaagagaattcccacgccatgtcagctcaaaacaagtatattttttgcccaagccatgctcaagctcttgctctttttctatgcctcctgtgctcatccccactcctattgtctaggatcccgcacactgggttattgatgtagctagtcatgacacttggctgatggagttcatttcaataccctagtagctaatgtcaatagaactttcattgattttccagtgtcctttaattcgttaggtattgaccttttatttaaatcccacatgaccattccaaacattttccacacttttcaagcctcaatttctagtcccttcattttttacaccctcgtcatgttcagttgttaaactctatggtttactgcaaaagctgtgagaatctagcgtaagtcccttgtgttcttgatattcaacctcaaaatccttccatgattctctcatctttagtgacatcaaaggcattagttatggatactgttgacacatttaatacccatgtgagcctaaaagagttttgaatcctctctgagtcacaatgtccacatcagtggaatgaagctattgtgaagatgaaccaagaaaatgaattcaagaatgtgttgcaggaaaaacaaatagatcttgttgtatttgttgactcggatagattggtaaaacttcctcaggttctgtgttttaaaaatgtaacagatccaacacatatttggaaggtagtctgataggatttgctgtggggaagtgagagaaagaccaaagccgagaataatggtttccagcttcatccatgtccctaaggagatatacctaatgtaaatgtcgagttaatggttgcagcacaccaacatggcacatgtatacatatgtaacaaacctgcacattgtgcacatgtaccctagaacttaaagtataataaaaatatataaaaaaaatttaaaaaagaccaaagccaacaatctcttctaaactcatccctttttaattttgtcttttcagccacagcagcagaaaacaaaaacaaaaacaaaaaaaaacagcctttatttccattttccccagctccactcactatcttgttcctagccacaattatctcttctctggattgtagccgtagaggtccaattactctccctttccactcttgactgccttcaatatattttaacacagcagccagagtgatccagtcattttcctgctagaagacttttgatgggtttccatcccactcagagtaaaaactgtccttaaaattgtctacataatctgcccaatcaattccctttgtgatctctttatctctccctctgtcaccatgctccaagcttatggtaccccttgtacttccttatactcattgaacttggccttttcaatttctgtctctcctatctgcctaaaatgatatttctctgtccacctcatttttttttcagcatttgcttaaagcttattagagaggactgccattgccaccctcttcaaaagaacaacttccatcctttgtactacctatctctcttattctgttttattgttttttataacacttacaattattttattatgtactgacttgttcatttgtcttcctctggtaaaatgtaagctgaagttggtctgagatttcatatatttggtttactactgaagcctcaatatctagaaaatatttgtacataaaagaatgaatggtggccacatggcatacattaggtaataacactcccctaattaataaccattcaatgggatctcattgctctttaataaaatcaattaacctactatagcctactaaatttggactttatataaaatgtttttatctttgttgaaagactacactttgagcttttgttcctattattttaaatattttgtccattaattaaacagcttgttatattcagctactctcactttacttcaagttaattgagaatggtaccatttattggcacagaagaaatgaatgaaggaaatatttggccaggagttgcagaatgcggaatcaaaactactattttagaaatcagtaataatacccagatgctattctaaagctttacaggtattgactccttacatgctcttactaatttgatgaaatagatagttaatatgcccattatgtagatttaagacatcaaggcttagagaatttaaataccttgctcaaggtcacatagccaataactggaagaaccaggatattagcttaaattgtttgattccattctcttaacaactatggatatacctctttggagctatccaaatggaaaatgaaataagtaatctgatatatgagtctggagttcgggtaaggatatggaatggacacatgcatttgaggccagtctgcatatagatgaagtttaaattgcccctctacctttctttatccctacttctcttttattttcagtctctttcaaattctttgctccttccccatttcttaaaaaaggtattctctatcttgaaaataacctgctcatgtattctaagctaaattaattaggtgtctttggttgcaaatgacaatccaattgaagtgaaaagataatttaattctcacaaaactggcctattcagggatgagatccaggctcctttcatcaggctttggtatcgcttgctccatctctcagctgtgatttttttgtgtgtgtgttgccccagttctcaggcaggctctcctctcttggcagtaaagtgacttttagtagctcttaggcttagatttcatcctcttatctatcccaacataaacatagattctcttttacctgcagttccaatacagagcctcagctttaacattcactggctctgactatgaagtattgtgttcaagaggaggcagtgttctcaatgccaggcctacaccacttgcccaggtggagcactgagagtaggggtagctacacgcaaaacacctagagcaagcctcggggagtagtgaatcccaaggaaaagtaggatgctgttatcagaggaaggggaagtagataccaaacaggaaaaacaaaagatatccttcaggggcttaaaaacaatagaataagttacaggaaactatcaatagttacatgtacacaaaaatttaaatcgacagtaatacaaaatcataatgaactaaattaaactacaaacaaaatgctagaaaatatttgtaaaagtgtaatggtgacttgtttgtgtcaccgcttcactgctacatgaagtaaaaatcaacaagaaaatactaagaccccactggatagatataaaagatatgaacttagagtttcaaaaggagaaactagtaggcagtataaatccgaaagcaaatatattgcaatggagaagggcagttaatcattttttagaaagttaagtttatgaaatatgattgatatatattttattttacaaaataatgtaaatgtgttatatatgcttggaattattttatatgttgtatttcataataaagtagaacatcaccagaatttgatgacatacttgtcatcaataatagatttgacaacactgcaattaacacaaaacccacaaggaatttaaaagcatagcttgaaactgaccaaataacaactatactagcactgatatagagcttacttattcctgacacagtctcacatactatgtatttattacctctcagtactcacaatgataagtactactattatctcaatgttgtagatgatgaaacagagagaggtgaagtaacttgcccatagtcacatagccaagttgtagagaattaattattcaaattcaggaagtttggctccagcatccaagtgcttaactcctttaccagtttccagagaaaaacagttttgtctgcaaagcatttaaataaacccagttacatgtcagtgagaaaaacaatactcaaacagttcagagctgtttttttttaaacctgcatatttgaagaaggttcagataggagttcagacagagtatgagtagaagacaaaacataagattacatagagaaagatttggggtgagatgtaaaagatttgcatttctaaacttctcgaaattcacacttctttctcaaacacctgtgtcttctttccataaaaaattaaaacttttagaaaggactgcaatatactgtacagtctatatctcacttccctcttgcatttaatcacactccatttagatgacattcagctttaatctgcctagactgcctgtactcacttcatttctcaaccctagctaaacttgcactttgtcccataaggctttcaaactactcccatctcttagtaatctcgtcctctgagaacacctattccacttcttttcaaattacctttgtgtaatgttacacatctatctatatatatctacatctatatctataaatgggcatatatacaatctcaggaagagagaacgagagagatggagggagagagagaccttctttttgcatagtccctgttttggaaatcagaagactaaggttatgtttactttgtatgccaagcacacagcagaatgccctaaattcatccatttatctgcacatgtttttgaatgcatgttgtattctgggcactgtgcctggcatcatagatacaaaggagtggaagatacttttcctcggccttcaaagatctctaagtgcacacgaaaaacaaatgtgtagataaataattaaaacacagtgtgaaaaatgccatagggtaatacatacagggtgccatggcaacccaggggccgaatggcagcttctgcctggggagttgaaaagatttcacagaagaggagaaatttaagctaggtcttcagatgagtaggagtataagaggcaacaatagggataattataaaagcatgtttgccttgataaatagtttgcactttatcatttagccagtacaaattataaaagagttttacaaaagagaaaaatgtgatttaacttacgtttaagaaagatagctgaggtaggcctgagaatgcattggagtgaggaagagaaaaaaacaaatggctttttcaacaatctagggaggaataatggaatgtctacattaaaacaacagtaacaggagactaacaaaaagaatgagtctgaggaaagttaatattctttattttattttattattattatactttaagttttagggtacatgtgcacaatgtgcaagtttgttacatatgtatacatgtgccatgttggtgtgctgcacccattaacttgtcatttagcattaggtatatctcctaatgctatccctccccccatcccccaccccacaatagtccccggagtgtgatgttccccttcccgtgtccatgtgttctcattgttcaattcccacctatgagtgagaatatgcggtgtttggttttttgtccttgtgatagtttgctgagaatgatggtttccactttcattcatgtccctacaaaggacatgaattcatcattttttatggctgcatagtattccatggtgtatatgtgccacattttcttaatccagtctatcgttgttggacatttgggttggttccaagtctttgctattgtgaagagtgcagctataaacatatgtgtgcatgtgtctttatagcagcatgatttacaatcctttgggtatatacccagtaatgtgatggctgggtcaaatggtatttctagttctagatccctgaggaatcgccacactgacttccacattctatggcataataatagaaattgataacttggaggagaaaagaaggaagggttgagacttggtgagaaatttagcagaggaaaatgagcagatggacactccacaacaaaaataggggatgcagaaggaaaagcagattggaaaagggcaacagggacacagaatttggctataggcattttgattttgtggtacctgaggaacattctcatggaattgtctaggaacaattagtcagtgagcatctggaacccaagtgaataatgttgagaatttctaaaagtttaggaaacataggtatttccatcacttccattataaaaacttcattgggaatgttggattaataggaagatcatgcacagaatgattatttaaggtcctaaattgttccacctgagcatgggtaaggagaacaggtgttaattatttttgctgcgaggggaaataatttaaaaactagagggaggagagggttaactttgggaagagagttcagagaacctgagaatgtgatgagttgtccccttttccacccacactggagaggggcatgccaggggcagttgggaaggatcaggcattcttcccataaagtcgagcctatctctctatgccagcagaacatgctgcagggaggcacaattcccaccattctgacccaccatttcctaggtagtcaaacttagggtggcaagaacacctaagattcccacagtctagagaaggaggaagagctggcaaggacaaagaccagaggaaatggcctccttgtgcagggagagcccaccacccactgggatcaggagaaggtcctgttatgaggagcaacgcttgtgaatgaagaagggttctcagctgggtgcctgaaagccatcaaaaatgttccatgatcacacaaaagagtcttacatattttcattactgcaaaccagccttgaaaatatatgtatgggccaagaaaactttgcccaccgaagaagaacctccctgctacaacacacctgccagtgactgcccagtgataaatgcttgcaggccttgtgaaatgaggagatagctttgcaaaggggaccagagtaaaatacgtaaaaagaagggaagcccttatagagactttaaattggacagtggctaagactttcattcttacatgagattaaacaagtaataatagacagattgagtttcccagagtatgtcagctgtacacaggcaggaagttaaaaaaaatacatgtggtcataagaatacatgtttgcacgtctgaatggtaagtgttcaaaatccactggatatgcatataggatgaaactaaaatatagatatgggagatcatacaacctgtttgtatataagtacaagaggaaaacatggccaaaaatatttgttgttgataaggaaggattttaacactaatgaaggaaaaggataacgagagatctgtgaaaggaaataaattatgtagatgcaaatgacttagtgaatggctgtaggagcaattttctaaatttgcaggtgatatttaattggcagacattgcaaacagcaaggagcaattcaatcagataaagaacttgaatcattaagtacttggcctaatagatggcaagcgcagataagtggtgaataataagtcttgaatcaaaactaaagaacagagagtgaacatttgccaaagggaatgataccatccaggaatggctcttagatttaaggagaacttatagacaaggacaaacaaaacttcagtaaaatattacaaataaaaagatttggtgggttacagcttatccagctgaagctgtgatgagaaaatctgacaacttaaggatagataaatcctgaaatccacggttggctattgaaattccatttgttacctagaatttcatctatccctgatcatggtttggagataaaattaatgagtaagataacatccaagcatataagaggttacagatttgggtgaggatactataaataacttttaaagacatttcggatatgaaattctctatgttctatgggcataattgtgaggtattgtgtttagattgcttggtcatttttatttaacatgccagttctagtctacgttagtctggaaattataaacatagagaaatatgctacaagtaaaagagaataataaaaatttattatagcctagaaaggtagttgatgcaatatataatatatttcctctttctctttttttgcaatggtgaatactttactaaatgaaaaggttaattttaatattaaagagaaatggaaacatcctttagtacaacattaaaaccacaaatggaacctttaaatattcactcactctagcaatcaatgttccaacctcatttaaaggattttttttaacttgacatacaaatattcagaatgaatatttggaagcagagccacgagccataccttgaaagataactgcggacttactcttgcctgccatttgggtacttcagatttcagttgttctaagtctcaatgatcctgagttttctttttgtaatttggtaattttgtaatggcaggctttaaaataagtaaaggttttcttaactaagaacaaaaaaaaatccggagacctaacaaggctcagctgtgtccaggtaggagatgactgcagtttggcttcagaggctccctctagcagtgtgaggacatctgagtgtctctcctactcattttatatttcatttgatactgcacagaatcactaggagaacagccagaattgatttacttctcatagagacaaactgtttctgggagctagttatcttcttattaacaaagagcttacattcccctcccctccagagctcctaaaacatctatataatagctacattaagtgaattctacaatgattgaaaattttactataatgaagataaaaattcactcaattctagttcttttatccttgatttgcatttgactgaaatgtgtatttgcagtttgggcatttcagtcagcgattgctcctgtattctttgcccataagcagccttcagatggcctcttagaaaattgaagaagtctctacatgactggaaaactctttctgatggtctgtttcttcaaagatatagcattacctcttgggaattatagaaacaatatatattgttaagcctcttctaatgctactgtaatttataactggtaactttttcccccacttagcattcaataagcatttattggggcctaatgtgtaggtggaattttggagaatacataaagtatagaacacagagttcttgttcttcaagagctaagcagctctatagagaagagagagacagaacgacagagacagagacagagagagagagagaagagatcaacacatatccaccacttgctttactatctatacttcaacttttggtggactcatcccatcttatggattcaattatcatctataagtagaccacttccccaattgtttctttaacccagacctctcacctgaactacaggcttttattcctcacaatgccttcagcattttccatttctaatgggtacctcaaacattaagtgttcaaaactgaatttctgatttcacccctttcccccatccttgtctgttgtagtgtatggcaactccaattttcaagttactcagtgcaaaacctttgagttgtccttgaattctcttctctctgtcacgccttatatacaatgcatcagcaaatttgtctggctgtaaatctgaaatataccataaatataaatacgatcacttctcaccactcgaaagccactatttttctctctttaggactatttcaatggccctttaactgctcaccaagctactgctctttttcctatttctgttaaaaaatctatttttaacagagcagccaaagtgattgttttaaaatgtcagatcgtattacactctccctataaccctccaatagttttccttcaactctaatttacataattccctataatgccttatatgttcaattatatacatatacacttaccaccatctctgtgaaatctctttctcctacttccctagtatgagtattgcttaggtataaatcagaactcagaaaaataagagtaagaattaaaaaggacatatgtgctgaaaaaaatagagcaatgaataaatactggggaagtaattagaaggaagagattatacagaaaccataaggcaaaaagttaatcaaatttatcaagcatattataggggacatggccaactccacaatttgttcacctataatctcaggcaagctatttaccttgtctgagtcttagatttggcctcagcgaaaggaaagtggtgatacatcatgagcagggttgcagcacagctggcataaatggaggtttatcccacacatgtgggctgaaaatattagaatccaagctaccaaggtcagagtgcctggctaagagcttcatatggaaaaaaaacctttaagtcaatgacaaaatgggagagacttttttttttcaggcagtatatagccaagaatctattccttgaatgctggaattgaaggttatataaaagcacttattactaccaaattgcaaagaacaagcagagcaagtaagttgagagagagagagagacatctttcttggagaacatttttggaaaatgactgtgggcaaagcaatgtgaaaatatttagggagacagaagactacgaagataaaatacctatatcaagaagtttatattgaaattgagaatataaaacagatattatgggataagtcccataggagagatacagaaaaacagagaaatgaaggataactgtaaactctagggaggcaatgtcacaaactcaggtgaaaatacattagaaaaggaaaactaggtatttttcagtatatataatcaggctggaagataaaagctggttcagagactagtgaaaacaaatcaggctggaagataaaagctggttcagagactagtgaaaactaaattgttcctataaggactttaaaaggagatcagcatgtgagtagacttggaggcctgctaaagagggagctaggagaaggaatagcacgtggtttctgagaaacagtgtagcaataaggcttatcacacataaactaaactaatcatgatgtttttgtcactattgtgctgtcagagaaaaaaatctattgaaataatgaaacatactaattttgagaaacatcagtgtggcaaaacccaagaaacacttttcaaatgaatatactcaaattgcaagatcaaacatctattaattataataggtaagaaaaaggaaacattcaaaaaagtccttcaaagcgaaaatatgtaaattagagtaccttcataatcaataaacacttattgagcatctattcatgtgctatcaatgtgttaaaaatacaaaagtgacaaaaataattattgctcaaaattctgtgcagtatttagaaagattgggtagggataaacatgtatttctctaagattacattacattatgataaggtttatggaaaaaatgtacatacctatgtatatgtaaaaatagaaaagagtctaaaagaactttttcaatctcaaaacagtgtttacatatgaggaaatgtagcgatgactgttcattgtttataaatatctgttctctcctttcttagtaatacagctcctgaatcataatagccagatacagacttcccacaatatgaatttcccagtttctctccttagctagtgtggtcatgtgactaaattgtagccaatgatatttaagcagaaatatcatgtgatgcctctgagaaatgttcttaaaggaaggatttttattcttattcttatcttcctcctttcttctggctggaatgttaataggatgacttgtgttcaagcagccctctaaagacatgagttggaagctatgtactgaggagcacagagcaacaagagaaaataagtaaaataagtttggttcttagctctggaagcgtgataaacctgggatagtcagccagggaacttctttcatgttgatttttaagccagtgatattttgggcatttcttttacctgcaggaagaaaataggctgattttatgtaatttgaccctttaaaaactagaatatattcatacatagtttttacagttcagtgtttaaacttatttatttttcatcttagttttgcttccctatgttttgtaaatggtaaacttattagccattctgtggtatataaaagtttcacttttatgttttgtttttatattggcccaacttccatgttcagctaaatacactaacataatttaaattactgcatttcattgggaatccaagttagaaaattccttttcccacatttttaatacctaaaacttgggaaatgaataacattataagtacttgaaaataatattcactgatttatcatgtgtaagccctgtcgaaatatttattttctactgagcttggaagatattttaaaatgattccattaaagaaatttttaaaatttttgaaatatctatttacttaagatgttgaagaaaacataagcatctacctttaccttccattttttagatctcatatgatatgacaaataaatagaaaattagaggaaattttacaacagtactctaaattaagtaagggtaccctccatgaaccaggaattggcagatttcaaaaaagcacactcctaagaaatttctgtttttcacgtgaccctgacaaaatccattaattgtcctaatttggaagggtacaaactgcagaaaagagcagggtattagctcagcaggaagcataatatttcattgccaagttgctgttgtgactcagtagcagcacttctgttatcttctgcatggctcctcactcttcagcgagcaaattaggactcattcacatggtgatccagggttcctggcacagcaagatagatggcaagccattgtgccagccctccaatgctctgtttgtatcacattgcttttctcccattgatcaaagcaagttcctggctaatcccaaagttaaaggatagggaaatagactgcaccaattgttggaagagctgaacagtacattgcaaaggggcaggaataccagaataggaagaactttgtggctatcttatgtaatctgccgtgctgatcagttagactaataaaccaagagaagaaatgaaggataataaattcaaatacctaatagagatcaggctgttaaggtataaaagtaaagttgggtatagtacctatgcacacaatgtgcttgaattgtgagagctaaagtgaattgaagatctcatgaactttccaagggggcactgtctctcaaattcaacaagttgcttgaaacagactccagcaattttcacatgaaattgtaagtttgaatttctatgtagactctactaattttgaattctggctgaagtattttaaaactgtggttgaacataaccacatctgtaagttacttatgaatcatggaccatcaacatgtgagttttgatagagaagactgaaaggataacattttacaactctattaaatataatataaatagtacaattaatatatattttatataaatttgtgtcctatagacactgaagacccataggttaattacaaaaattgataatacatcatgtgcctccaactccaaaatttatatacaacataagtaatacctaacaaattaccagattaaaacacaataaaattaagatgaataacattttaaacaaagacaaaatctcaaaccacttggaagtaaaaatagcaaatgagcaaaaactctcatacactgttcctagagcaaagaggaaataaaaactaaaagtatagactatttagaaaataatgataacaaaagcactacatgtaaattgtttttaaaactttgcttacagaaacgtgttcatctttaaactctacttaattactaaattaaaataatgaatcaagccttcaactcaataaacaaaatatgaagccattaaagcttgagttaaaatgcattaaaatctgtattttagaattcataaatcaatagggttaattgaagggaaaaaacagttctttgaaaagatataaaacaaaaacaagccttgggcatgtctggttttggaaaatgaaatgcataaataaaagtatcaaaaacatgtgtacaccacaattaagaaaaattttcacaagcatgatggaacagtaagtacaactttatcgtaattatttgaaagaaacgtatggcatgaattattatcaaggaaaacatcccatcattaaaattgacccaagaagaaatagaagacaattaaatatatgtccaatatgacaaaaaatgttatttgtttacaaacaaattaataatgttatctcctgcctgttttcttaatttcaggaaagagtaggccaaatgattaagacatttcataaaagttacccaattaattctgaagagctagagtaattcccaaaagaatggctgaaaatgaaatcacatacaaaaaaagaaaaaacattcaatatcactttagtagtggtaataaaaatacttattaagtgataattgaattcttttacaaaattcttttggatatgaatatccaaaaatcttaaatgtcctttcatatttaatccgtcagcatattagaacatagtaaagtattaccaaacagggtttattacagaatgagcttcattcaaccaaaagataacaggagaatctttggcaaaatatctaatagtaagcaaagttggagacatggattagataataatatgaaatcatcatgtgttctaaaaatgaaagaatggtattaaaaaatcaaaggaaaaggggaaagtaggggaaaataggatatcgtaatgcactttagggaataagtggaagtaacagattttatttaaaattttcaaaacgttaactggaaaaaaaggagtaaaagcataataaaatttttaaatattgaggttaaaaactataataaaagtgcaaatctttctagatagtaaaagaaaaacctaccaaagaaaacatgctacatagaaaaacacagtaaatataacaaaatctacacaataataaataacataaagaatagattaaataagatacatttttgggatatggatcaaacactacaccctcataatatgccattttctcaagcatacatggaacattgacaaaagtcaatcatatattgattggcctcaaagaaaacactattaagttccatttaagtactttattacaaatagtgttccctcatcaaaatacaataaaactagaaatttagaagaacagtaagagaaggcttttcacctgaaattaagaaatcatcatgttaaacaactgtagaaaagagaaaaagaaacaaaaattatctttaaaattagtggtaataaaaatactatatatcagaatctgtaaaggatacttaaaggcgtaattagtagtcttggccctccccttcccttcccttcccttcccttcccttcccttcccttcccttcccttcccttcccttcccttcccttccccttcccttccccttcccttccccttcccttcccttccccttcccttcccttcccttccccttcccttccccttccccttccctttcccttccttcttttcttctttccttccttcttctccatctccctcctatttttcctccttcccttttttttccaccctttcttccttcctttagcatttcttcaatccttactttctcccaagcaaacctggaatctttacattgtaatattatttaaaagccaaataaaatcaaataatatttaagaaaactatcaagaaatttcaaatatttacaaaaatttattctcttgaacagcaagagaaggaaacagtttagtaagttagataggcagaagtagacctagtacttgtgaaatgtgtgccaaaactcttcagtaactattttccttctgctttctgtagaaaatatttaaagttgaaatgaaagcatttcctgaagtgatacgtgaattactacaagcaatatgtacaaaacatgaaaaacagaggtgatatttagtttggaattgtcatattcaaaatcagaaataaaattttcattctgatagagcagtgagtttgattttattctcagattaaattacagaatggattattaatcagatgtgttttagatgattaaaatagcagttcatgtttttgatagcattagctattcaggatcaaatgaatatctgattaaatatgtattttgagttcaataatgccttttacaaagcactttaaaccctatagacaaacgtggcttgatggcagtgtagtaaggaatatttataggtgattgaaaagctatatctaaagttttaactagtgagctatcatcaaagtgcatagaactttagaggcatattgccatactttgaacttgccaatgtatgtttcatcaatactttactagtaatgtgaatgaagaattaaaggcttgctcctcaacttctgaatggctcaaacatggtaaaataaagttgacataatgaatgagaagtatagattacagtagatgtgaaaaatacaaaagaaccaaagaatgaaattaaagagacaaatataaaatctaacatttgcttcaattgcataagactttgtgggctactagtttgatagtgtttattttaaaaatatttttaaaattttatttgaccttaaatttagcataaggcagtattaaaaatcacctaataaaaatgatacagcctccaattttatttaaaaagtgtataatttatatcaattgaggaaactgattatttagactgtgttcacaggagaatgacaagtattttgagggacagaaaatcatatctttggaaaaagtttgaaagcttgtcatagggcagatctatttagattgataacataatgtatggatgacaaaactaaaacatctaataaagagtacagggaagcaggtattgattcattataaaatcaaagttttataataattagaatatttcaaatgcaaaattttcatcttagaaaaagcaactggacttggtgtaatgttaaaataatgcatgtaaaacacatgatacttggtatatagtaagcactaactaaatgcatactattaatcttaccaatataatgttcttagcattatattcaagaataaattagatctttagttgttacatataatcatttattttagattaaatttagagtaaatgtatttcaatttgtctaagcttctaagattcagtgattatattgcttattagtcatgctccattgtatcatccatccatatccttttcatgacttgagagaatgcaaatcttgtatcttctctcaaggaaaatattatgactatataattaaaataattttaaaaatgtatttatattccagttttagtgctagtcctaatcaaaatttaaataatcattttacaataaatatttgacatataatattttgtaatatattgaattttctatagtagatgcctaattatcttagctatttgcaaataatgtaagtgtaaatatactgataaatcaagaaccttactttaattattgacataattattcaggatattaatcttttatcattgctataaaacagtcaattttcatattgccattttctttttattatttaaatacctctctctgttgggaatgcagacaaaaagatggaagagatttataataattaggtaatataagtttagtaggggctccatctttatttattcatatattcatagcaagtatttattgaccatgaattctatgccagaaaatgtgatatgtaatttttttaaaagtcacaatccttgctttcatggagcttatggcctagtggaggagtcaaacattattgaaaagatcatataaacatatgtaagattgcagctgtcatagtggctaggaaagtgaggaatgtaaacttctgatagtgtaaacaaattattgttccaatcaaagagatagtggatagcttccctgtgaaaatgaaaatcaagctgacatatagatataaatgagtgtttacttgaagtttcaggagggtcaatccagactgtgggaacagcatgtacaaagaccatgcatcaggaagaactgctggaagggaaaatggtacagtatgaatatgttgaagcaggttggggatagcctacgtaaaggtgtgtagaccatgtttttaatctttctcctaagagccatgcaaattcattgaaaatttttaaagtgtggcaggagacaggatcagatttgctctatagaaagactactttggctacaatagggagactgaagaggaagaaaggtagatttcaggtagtcttacaaggagctggagcctaggaaaacaatgaaagctggaaatagtaaagaaatgaatggatattaggatgctcaggaggtaaaatcaataatgatagatttgatagggggcataggctggagaagataatgaagctaacaagttttatgacttatataaaaagacaccattaaagcaagagatgttggaagaggactggttgaatatcataagtatgatgttggccatgttaaatgttaaatttgaggtatttttaagtcatttagtagaaatgtcaattatgtagttgaataaatcagtctagatcccagagctcagatacacatctagaaataatacatttgtaaattgtgtgtagatggggacaatagcagtaatgaacacagatggaattgcctaggcagaagagctcaaatgagaaaaggatgtaggcccaagtccagagaactgctaacatgagcttgaaaaaggaactgagaaagaggtgtatgttatgtcatgaaattcaagggaaagttgtgtttgtgatggagggagaaatcatcaatgctaaatgtcaagagacctgattagatgagctttgaagtatatccactacgttcaacaatacaataattaagaagtactttttccatgaggaatagggtatccaacaatatggggaaaaagagttttctcagagtgactgggatatataaaaatggagagaaaatgtggtaatgtggagtaaccagagagtagagggaagggctcaatctctttgatttcattttaacaagaaacaaagaatcttttaatgggaaatctagttaataggatgatgttgaatgcatgagacaggaacttaagtatctgaaatagagagagattgatacatttaatgatggaaggttagccttaggaaaggggacagctcctgtattgtggaagcagataaatagagtagactgggtatgggctataggttggaacacagaaataagtatgatttttaatctcccatcttctatgttctctatataataacagtaggattaaagatgtgacaagtcgttgtaaaaagtggacaagtgagttgaccaaataaataaaaacctaagaagggtaagaataaataattgtctttgattatttctggttatgttgtttattgatatttaggaagttttagaactgtctttctgaattagtggtccttggcctttttttttttattatactttaagttttagggtacatgtgcacaatgtgcaggttagttacatatgtatacatgtgccatgttggtgtgctgcacccagtaactcgtcatttaacattagatatatctccaaatgctatccctccccctccccccaccccacaacaggccccggtgtgtgatgttcgccttcctgtgtccatgtgttctcattgttcaattcccacctatgagtgagaacatgcggtgtttggttttctgtccttgcttggcctttttttaaattttgcttcagtgcagcacctctaatataagtaaggactaccacatactcattatccattacagtgttctgctgtatcattgattctgaaggatggagtgaagcacctctttaggaagactatacaaaactcagagatgggaaagagagagagagagagagagagagagagagagagagagagagagtgtgtgtatttgttagaaaaagttcattatatgattctgatatgcctcccacagggaggctagaaatttctccttgaaaatagaatagccaaatgttgaaaatagaccagaatttaggaatttgtttatagatatatgacaagtaattgttaaatttaataaatagtgtagcacatacaaataatcagctcccttttcctaaataaaaaactttagctatttttattctattttaaaaattcacttcgtgatatttaaaggtatccattattaaaatcagtaaccattccaatttataatcatttaaaagtaaaacatataattatttattagaaaaatatttgtgaacattttataaatattatcaacatgttgtcagtaaattcctcctcaggtggaattttctgactttggttgagtcattaaatgttttgggtcactagtgatcaattagtaaattactgatccatagtactttaatggcctgaaaaagtaaatgcatcttctgagcacctaattgaatcttagttatttattcatcattaaaatcaagataaatgagtcagctcacaataatgaaactgaacagttacattcatttcacaaatagattaaactaaagctcagaaaagacgggacaagggagttaaacatccaggttagattttccatctgaaaagacccaattcccaatatcttgctataaaaattaaatacatatatgagtttgaaagcaatatttttctgcaagttcattttcatatagcgttattaagtttaataccattcagttaataattgtagatccatggtacgtatactaatatggtcttgttataatgtaaatagtacagtttaaacagcaaaatttcacactgttttaatataaaaaatttcctagaaccaattaccctgagtgcctactatatggttcatttggaaaatgaatgatagctgcaatatggtaaaatgattatgagcacagccttcggaataagtaaaacatagctttaatatctaacttctgtacttactaactgagatctgaacaagttacttaaacttctaaggtttagtttctccacttacgaaatggagaggaaaacacataattcatagttcattgtaaggactaagtaaaaaaaaatacttaaatacttagcacagggcctagcaacaaagatatatgaactcggtacacacagacatacaaacacgtacccacactgcttaactttagctagaatatttttaaaagcattattagtttgagactagattcatccaagttggtttagcattctactagggatgttacttttcatatctttctttgtttttgttcccaaaagctataaacacaagttttatcttctttcctgaaacaattaaaaagaaaatacaagaaaatgttcaaaaaataatttactagtgtttttgtttgtctggaagggtcatcctgcagctttaatcacagctgaagatcattatttcaaaaaagacacatcttttagatatttaaatatgtattatcatattatgcagtttaaatgtgaagtcatctaccctctggtttactgagattctgttacattttaaataaatagtaaatgctgtagttaagagtgctatcactgagaatctaagaagacacattagaaagggattattactccaagaagaattctctttccttaatcattactttttcattaaaatatttctgaagtttatacaatacaatcatagtagtgaccttaggcatatgacaccttagtgctataaaaactctaacaaatctgtttagagcccaataatataaatttctgtgaagagaaatataaaccaatggtaaaatgccatgttgaagtttctaaatagcccacctagtaatttacatgttaagaacatattgaatatcttgggaacatgttcctagaaaagattctccattataagcttttcctttactgttaatgattgctttgataaaatgacccacgaaaaaagacaattttctccctgtgttatctgtgtctgaaatattcttcactgattttacatatgctgataatatgaacaaggtaatttgtctgactctggtggggcaagattttcagtaagaaatgcaaaattcacacatagctcttctgtaagaagtctatgcagtgtttcagtttatataaaaagatttatattgcctgaggcatctatttttttttcctcgaggcaagctgaagtggcacaaatgaaattgtttttcacactgttaatgtattcctttctctttcaatttctcagagagccgacatagggatttctgctttaaccatcactccagatcgtgaaaatgtggtggactttacgacacgttacatggactactcagtgggggtactacttcgaagggctgaaaagacagtggatatgtttgcctgtcttgcaccatttgatctctctctatgggcttgcattgctggcacagtccttctggtgggtctactggtctacctcttgaactggcttaatcccccacgattacaaatgggatcaatgacgtctactactctctacaactccatgtggtttgtgtatggatcttttgtacaacaaggtaaggagcaaaagtacattctagtatttaaaaaaaatagaatgtgatgtttccaaagccatgtattcagttaataaggttctgtatctgacatcaataagtgttctaaagggtactcacagaaatgctcagaaaagaacatttgctacttcctcctagtggatctcagacacaccaagtttccagcaataatggttcattgtcttttgatgtaagtttaatttcatcaacaaaggcaaatgtgaatgtcaaaggtaaagctcacagaaaacatcaagatcagattttcctctccaaactctgactttctgagaaatagccttataaggatgaaattacttattaccagagaaggtactatttaattatttacatatgtaagaaatgttaggacttgttctttgttcagagacattatttcatgcattaaaaatattgtcattgaaaagactttggttaatttgagactgatgagaaattttgtgttttatcttttactttgatatgtaatctttactggtgatttaacttacaatttcactattttctaaagaatgtcattgctctgttatttaatatccaatctgcccaactctttaaacttgtccaattaattatttggctctcactgtttcaaaatagaataatatttattgcattccttacttgagactattgcctcatagagaatgaaatagtaagaaaattgatagtctcttgcaagctctacacatatattgaagaggaggatgtttgctacaatggagacattatacttttgtgctaatatttacaactctcaataacatctttctttttattcctattttctcttggaccttccatttaacttcatttttctattctaatttaatcaaagattagtctagaaccttcatctgacttgctaacttctaatctagcccttaaaccttttgtaagcatgcttttccctccacccttccatatccagggctctaagcttacctgttactgtatatttttcacagacacttttagttctttcattaataattaattcagtaaatatttaatccacactatctaagtagaactttcctaagcaattagtgtatgatggtgagcaagaaggtctttgccatcattgcgccacaacagaagtctaatgagacacaaacatgtaaacacaggattacaattgtgggtagaaagttctgtggtaggataagcatagactgttaggagatcataggtgtagaagcacttaatatatgttaatgtcgcagagaaggctttttaaagtaacactttatacagagagacagagttaactatggaaagtgcttcttgaggaagatgaatggagaaaaggagacataaacggttaggatggaatttcagaccaagaagtgagagagaaattaagatagtccaagcagagaggatctagtaaagatgaggctgaagctacatttgttattataaggagtttgaactgatccttgaaatgatcagatatttaaagataataaatgggaaaatacagattcaaattttactctagaaatattctggttataatgtggagaatagattgaaaaaaggcaatgtgaaaagtcagacaaattagaagactattacaataactgagcaaagagttgatgtggcttgctcaaaggtaaggtagctttgggagtcaagaggagagtattgatgaaatggaatcaacaggctttgattacctatagcgtggtgtgggggtcagtactgaagaaaaaaggagataaagttttatcctaggtttttgaatagaaaattatgtatattggatgtggatctcatttactgaaaaaataaaacagaaaaaacagatatgacaggagagatgatacattcattctgctgcacattgagtttgagctatccgtgaaacatccaaaagagtattactaatgtgtgcttagtggtttgatatatttgtcagatgcacagaagagacatctggacttaatatatatttaggagatattggaatgtaggaaattttgaagacatgggagttaatgagatcacacagagtagttgctcttaattgcaaactcctgattgaggaccactggcccatacaaagcctaggacagagctctaaggaaaggaatggatagaggagcactcagtggtgcctgataaggagtgactataaatgcacaagtgaaaatcagagcagctagtagtatacgtttggttgactgtgttaaacctttcaaagaatcaaatgaaattaaggcttgaaaggtttttgttggatttaacaataaatttattattgaagcaaaaaaggcttgtctttgccctatgatgtctgaggtttcagctagacaattcagaggccagaggctaaaatcatccaaaggcttgttcatttcactcacatgtctggtggttgatgcggtctgtgggctagtggcctcagctttttctccatttgggcctctccatgaggtcactttgcatgggatagtttgactttctcacagcatggtagttgctttctccacagagaacatcccaattaaagaattttatgttccaggttgggagtcataaacttgtgtgatggtgtgaattcctcttgcagagaacatcctggatgtacccacctcatgggtttttatgagaatttattaatgaatggttaaaattgtgaagttcttagatataacttatataagtgtcacataagtgtttactaaataaataaaacaatgaattagactcagcggcagataattgacatatgtaaaaaaagggataacaagacaaatgattgtagatcattttgatgtagatattgattgaaatagtagatcatggggtatatggagaactagaaagagaaggaccaagaatgcgaatgtaaagaagagtaagggtagaaattgatagagtaggcctggcatggtggcacatgccagcactttgggaggccgaggcaggcggatcacctgaggtcaggagttcgagaccagcccggccaacatggtgaaacaccatctctgctaaaaatacaaaaaaatgccaggcatggtggtgggcgcctgtaatcccagctactcaggaggctgaggctggagaattgcttgaacccaggagcgggaggttgcagtgagccgagattgtgccattgcactccagccgggatgacaagagtgaaactccatctcaaaaaaaaaaaaaaaaaaaaaaaaaaagatagagtagttaggagagagtagtagaggtctcaataagattacagaaaaagagtgaaaacataattataaatgagtttggagtctgtatttataaaataggacatctaagcctaattttttttgaaatgtaatagaggagaacatgttgtaggtatgtggatacaaattccagatgttaagatttggtgaaggacttcaaagctgatcaaggaactgagagataaagggttaggtgagccagctgtaatgatggcttggattagactggagaaaaagaaattgagccatgtgtcaaagttgtgaataaataaggaaggatgacaaggatgttgatagatatgagcattgaccagaaataggaggtgacatacctagatataattaacctctgttttcatcttacttcttccaatttattcagtttttcagtgtatgatttcaacaactgccaatatgctgatgactcccagatctacatcatctattcttgaacttcagatttgtatattcaactgttacctaggcaactctctgactataccagaggcaccataaatttgaacatgccaaaaatgtaattcattttagaatttgaaccttcttagcctctcacattctctattccagctgatccaccaccaaccattcagactcatgttagaaactctgaaaatagttttcatttcttcctctttctcatcttgtatatccaaccataatcaagtcctgtcaattttacctactaaatatttctagaagtggaaatctcttcttatctagaaagattagcctagattgtcacctagattgaggctacctcatttttcacctgaactataggagtctcataagtctttcttcttccagtgttgtctcctgcaaatatacgattcacatacttgcatatatacccaagttatccatgccatggaaagataaacacataattcccattcttcagttattttcttggcttcccaatgcccacagtttagaagtctgagttcttcagagcataaacaatattccatcacctggctcctgtccaacactcagttctcatctcttaccattcgtgcctcacatttaattgcccagttactccaaacttacggtttgaccataagacaagactctttcctaactcttcacctttgtatctgctctttccaattccttgagtgcctttgttaccaacctgattagactctactcccactctctgtctttatacagcaagttcctattcatcctctaattttttgcttttatttctctactttcaagaagtctttcctgggattgagaaccatcttctatactcctcaacatgtatttgtcatagtacttaccaaccatagtgtaattcctttttttaaacatgtctccacctgagtcctttgaatataagatagtgtactatttaatctgtgtagtctctttgcttatagttaagtgccttgtacatgttaggcatttaataaattcatattgataaatttaatgaatggatgctaaatacttaactaaataaagcatggaggttagctgcaatattttgtttattagattatagtctcaaataaaacactaaaattatccacaaatgacttaaaactcactaaaccaaaaagaaatttatctgtaatgtccccactgagttgttgtaagaaactaagaggagtttataagtaaggcatcctcttggttgaagcctcatttgtgaagacgttgacatacttatgaattggctttctgaattcttcctccaagtgaccaaatttcaataagttttggagcacacccaggaaaaaagataaatagaattacccatatggttagcatgcttttctagttctataaacatgcaacagataacaaaagttataaatatgttaaatacctttctatcccactgctcccttaaatgagttgcacagcctgcaggttgattgtacatttatacaaatttataatgacagataatgctgaatcgcatatgattagctacttcatctttgaaaagctgctattcttccacttgctaacaatgaaaaggtgaattcattaaaagacactgagagcatctttatgctctgattaaaaataaatgaagaaaaggcttataaaccctatgaaaaagagaataaatcaatgacagtgtccatgtataggcaattgacttggaactggtgatatttccaataaaaatacagtcttttaagaggaagtacagctgttatttcagaattgcagtcttcattgagccactataccagattgaatagggataaagaggcatttcatgtgttatcagacagatttctaaaaaaagagttcacggacagccaaaagcagaaaaatgttaaatatatgtgagttgtttactaatcctgacattttaaaaaatctgtaacttcaaagcattctggaaaaatagctcagggaatccaactgtgcaaaagcagtatggtccattatagagataaactcagtacatctgtttggctggaacattaagagcttgtgaattaggttgtaaaatgcacgaatgagagaccaattttatacaacttttgttgtcattttatgtcctccgttatctccatgtctacatacatctcctttcaattaatattcttaagtgaaactggatttgatttttagaagtctcttatgtttagtttattggcagtgactctatcatctggtctccagaggacttcaatgactttgcaaatgtagttgtatgtaatttgctttctgtttacatgcaaagggaaatttcagaattatcttcagatgtttgtgtctgattatgggaaatagaaatatttatagtcatgtaaaatatttgaagcaaccacatatatgtttatttagcagcaagcatttattaagcaccaacaatgtgccaggaacatgagtagcaaaaggaaaataaggaataactcttaactagggtttaataaatatttcacgagtatactatgtgccatgcctggcctatgtgctttgagtatgatgctaaataagaaaaacagttcttgcaggagtgttcaacatcacgccgatggatcttaaccaaattgagatcaaaataaaccatttctgatgagaggagcagccagaattattgaaaagaataaagaaggaaaattcctttggtagttttcttaaagatcaaatagctccacagatgctaatgatgaatagaaagtgtgcctttaggagtgttagaaatactgaaaataatttgatgctgttgcacaagagttaacataagagacaacccactgattttgaaatcccaagacaatttttggaagaaaataaagagttcttcctactgtcagatggatcacactattatacagaatccaactttctcatatccacaaaaagaagagtcagacattcttttctattgaattaggcaacagaagagattgttgatgggagaccatctctttaaaactttgcacagaaggataactcaaaaagacatcaattttaatagtgtagatatcaaatatatgaaacttaccaatgtcctatttacaaactctcaaaggattcaagccttggaatgcagtagctaaagccatttctttatattgttacctaatatttcacattcaatttgaatataataaaaatgacattgactagctctgttgtttactgaccctagtgaacagaggaaaaatgagagtaattccccatgacaggttaactcgactacaaagacaggtttttttctacattgtgttcttacaggtattaaattaaaacagctctccataatttttatttaggctcaaacaacatctctgttgttgttaattatgattggcagtccttaacaaagggaccaaaatgcattctgagtgctgtcacatccacttgagaattgccccatgctgatttaaaacatgacgaggtgcccattttctttctttttatcgcacaattcttcacaactaataaaaaaaaagttgaactttcatgctgaaagtgaatgttcaaattctaccaatagtgaggagtaatttgtgtactagaaaacagtgccatgattttaagctgtgaatgcattggtttacattcctaatgaactgtgatgaactcctaagcaattatgctatgaactatatgcatactatatggccctgaaaattatttagcttgataccgactcctcatgacgtgagtcagaaaattctttctcatgctcaactgggcttttgaagagttaaaagaaatcaaagaacatgaggcagaaatcatatttctacttataaaacaagaactagtacaatcaacatcttctttgactcctttgaactacctgtgaatatgttccataattaaaattactattttagtatttaacaaaagaaagaagctgtttcctaagagacactaaaaaattgaagggtgattttgagaaaatatttttaaatctaaatttaaatgatagaacaagcaggtgctggctgggcgcggtggctcacgcctgtaatcccagcattttgggaggccaaggtgggtggatcaggaggtcaggagatcgagaccatcctggctaacatggtgaaaccctgtctctactaaaaatacaaaaaattagccaggcgtggtggcgggcacctgtagtcccagctactcgggaggctgaggcaggagaatggcgtgaacctgggaggtggagcttgcagtgagccgagattgtgccactgcactccagcctgggcgacacagcaagactccatctcaaaaacaaaaacaaaaacaagcaggtgctatagattctttaaaatagtattgtctgaaatctgagtagaactcagtgtttttacagtaccatattacaattttttcagcttaagtagtaaaaatgggaacaaacatcctcaacataaacttatcctaaagctgatttaggattggtctaagttaaagtattgggctcaagggaaagcaggtggtggtagagaacatcatttaaattatttagaatataaatttgaaaattcaatttctgtttgacatgcccaaacctgaatccatttccccctttgtctatgaatatgtaattagaggtttaataatgatggctatattttttaaagcatgggaaactgaccagagccttcaaaaacaaagtcaacatgttttgaaaattaagactgttagcatttagcctagctctagaatgcatccttaaaacccaattatcatggacataatactgtatttaaaatccccatcttcaactttaaaaaaattgttggtcataaagtccttgtgacattttgttaaatacccttgaaagtggtacaagctttacttgattgtttttcacatttataaggcagaaaaattcaatgtttaatagagaagtataaatacacattatgtatctcattatatatatcaatgtcactagtgaactacatttttatggcaatttttttcttttttgtgtcaaaatttaacaaaagataaatgcatgacccaccaatgcactgtagacacataaaattgttctttgattttgactgtgcccaaaatttatagagtctctttatatttacagctctttatcttagactccaaattaacaatccatttgggattgctgcacagtgtattctatctgcttcagttgttttctagcagttagtgtttatatccgttgtttaagctctactttagcatgtcctaaaagtatatcttctgcctttactattttaaattcttcattctctagtaaacaccaacttggatattaaacaagaattatttaactagtcacagaggtgaataagacagcatgatggctgttttcatggagcttagaatacacaagtgacacaaactaggaagcatgcagctccatcatagaatcacaattgtcatgctgaggaaacacaagacaccacgaacatggaattcacagatatcctgctatttagcgtactgcaactgggtcaaatacatactaagttgtgatactgaaagagaggaacacagaccatgagccaattttttacctagtcacaaaggaagaaagaaattgttcaaataactcacttgatctttgcttcaatagagtgtcagattatttaaaattttcttttatctataaaaatgtaagattcagtaacataaatatctaactaaactactcttttcatgtctttgtgtttccttaagagacagctcagtttacaatcctgttttttaccacttactagctatgtgacatttgacaagttttttaacctctaggtgactcagttcaccagataataattactgacttcatcaggtgtttgagaaaattaaaagaactcatggatataaaactattagaactgtattcatgacacaaagtcggcacagaacattatagttattttttcctcactgtttccaaaggccacggcaagagatagaatcagccatattgtttaatccttcaatattcatcattaacttccagaaaataagcattagtttaaaaaagcatagtgtaatcaagcataaggaaatatattaggaaaacttgtttagctaatgaaaatgtttatagtaaaagccatatgctaataaactcacaataactttatgtcattcaagtaaatatgaaaaactacaaaaacatttttccctatttaagcatgtcattactacatgtttttataatagactatagccaggaatacaacaaattaatgaacccaaattgagtggaattataagttgtgattcaagatgtttgcaatttatatagtaaattctttggggctcataaagacttaggttttggggggattaatgtcctataaaaacagtacacttagggttttgttttgggaattatatctcgagatctgcaactaaaatagcacaatattaagtataaacattacaggaaggctagtttctaaactaagcaatgttcacaaactgccactgatggcagtctgaaaccatatgggctttttccagctaaaatgatgatgatgatgctgaaatttcattttttattttgatattctcatagtattgatgcagggcaggcaagccccgaagtggagcttagcctgctgggttcttggctttgctcagggaagaattcaagggcaagacagaggtagaagaaaacagctttattgaagaggcagtgttgttacagctccatgactgcccctgtagagcagggctaccctatgggcaaagagtagcagctcagggcagttttgcagtcatatttataacccacttttaactgcatgcagattagggggcagtttatgcagaaatttctagggaaggggtagtaacttttggatcattgggtcattaccatggaaaggggcagtaactcccgagtgttgccatggcagtggtaaattgacttgacaggctggtgggcatgtctgatgacaagctgcttctgccccggccctgttttagccagtgcctaatctggttcactgtctgagccctgcctctggaattgaatcccacctcctacctcagtatcaatactaaaaactaaaatgttttataattttaaaacatgttaataactatttgatagtttaatatgttaatgaaactgaaagcagtcttgtcaattatatagaaacataacctatgttaaatatagattgaaagaaagcctttaagcttaacagaattactgaactctggtttcattgtaaacttaaatgtaatacatattgtaaatacctatgaaatacaatttaacatgtaagaaagatataaagaatcttgctaagtatctattcccactattttatgttattgcaacactaaaatataccatgccggatctgaaaacaaattctcagtaaccagtgaaatttgtttctttgatctgagaaaatcaaagttcatgatagtattctgagttcagtttgaagtgaagaacatgccatgccagattgcaaaagttggttctggatttaaaccatctttgacattatttaatataaacaatctgaaaataatttatactattaaaattattgaaaaggaaaattatctttagatgttttttccaaatactgttttaataccgattttgctgagaacaatgaccaagttcctaaatcagcaaccaatttttgcctaaagtaatttttaagaagtctgtattttatataaaggtgattcaaactttgttggcttttaaattttgaaatagtatgacttcttcacataattatctacaaagctataaggaattgttgatggcattctcttctaacttagatcctctttgatatcattatagtctcttctaaatataaaagtcattttgctatatcagcagggactgtctacaagtaccacgcttctgtgctattgttgtactgattaaagggttaaggccacttagcctttagtcctctgccttacatcaccacccaaggagtgctataatcctctagaaatgcattgcctgcagtgtggcactgcttaataaatcactccatcttatttatctttctcttgacatatagctagcagcaggaaccattatcctatgacaatgttaagttctattgacattttctcttaattaactacactaatttttacattggaaacaaacttcctttatttaatgctatcttaaacaaaggaagtgttaaacttgtcatacctgcatcatcataacatgttttgaaataagtgaaatgtctttgttacctttccagaagaccagtttattctgctgagaaaacaagtttgtacttatagaatcatattgcatcatttcttctaaactcattagacatcttaataatatataagagccccaaaatatatgtctgaattcctctgtgatacatatcccttcagtcatttgaacaaattttatgtacagtttcataaattgagaaaagcatttttttcagattaagcatgtcttacctatcttagaaccaagcattttgggtctaaattaaagatcattcaacagttagtgtatgtaatgtgccaggcactattcaagctgttggggctgtattcatgagaaaaacacacatatattcatgccttcatggagctcatcttctagtagagggagactggcaacaaataacagccataataaataaataaataaataaactacatatatcagaactcaaatgctatagaaggagtagttcagagtaaggagaattggaagtatgtatggaactgttacaattttcaatttgttgcagtaagcctctttgagaatttgatgttgaacaaaatcctgaaggataggaaggaatatactttatagatagatatctggaggaaagatgatcaggtatagggaagttcaaaatgcaaaggttctgcttgaagaggccggaagcatagtttagtaggaggtgaggacagagaggtccatgagttcagatgagattgacctttgtagactttcacatttactctgagaggaatggagaattatggagtactttaagcagagaagtgacaggacaaacattaagacaaatatatgtaattgtaatgggaggcattgacaaacttttctagagctattctattttccacatctggcatatttgaggatttaatatttgtttcaaaaaatgtagatttgtatctaaaggagtcatgattatattttataggtatacaaatgtatacatgtttaggtagatacatgctggttgcaaaatatacccagccatcgtacattttaaaaaactttaactccaagatctagccataatgttttctactctgcagatcagacacatatggttatccattttggaacacatgttaacaagtaaatcaagagatacgtctcattcccagctgtatttgtggtgatgactcctgaagaaggccattcttttctgataaatcttccctggtgcttttggtagagaaggtacagagagaaagcaaaagtacaggcattcttagtttatttttttcttctcaatcaacctagtttctttctgggaagaataaatgctatttcacaaaatcagtttaccagtttacttgaaatgtatttggaaagaaatatacatatatatggtaaaaaattctttgctacatcaaatcaatctactaataatgcctttcagagtagaattaaataaggctttctttttagaaaattcttcctgaaaagaaattaaattgaatatttttattatttttatttatttaaaatgtatatataccttctatttatccataaagatcttaaaatctgctaacattcataatagcagtgcattcttttgcttcactcacagaaaaaaaaatgaataaccttctatctccaatcttccttaccaaggccaactctttccatttaaacatttcttgatttttaaatttgcagtcatttggccacaaaaggccatctggagtataagattaaatagacactaggttcaaccacagtaggaatctgtaaactcagcattatcctccagaaaaccttcctttgaaaatgatgtacagttcttctattagggctgcacttaatctctaagctatcggaaaacaaggtcagatcttctgttgacacaggaaatagtgcaaccggtcccctgtagttattgcaaatagttgtatagattagtgacgtttctgaaaaactaaatatttttaaatgggtctttaatattcagtcctccaaatacagaaaaaggattaggttaaaaagtgaaaattaaaatgttcactatgatgttcattgatttttaatttttccttctgagcttgtattgacccaagtgacattctacaaatgctgacttaaattaggttaagcaagttgaaaattacatttgatgacctgaataattcattaaaaaggataagcatataaaagcctactttagtaacacaaacacattttttataataatgtaagatattgaatctggccacaaacaatgtccaggatggacacttttaagtcggaatgagtaactttcttgctactaaattatatacagtacatatttaactgatgaaccaaaagagagtaatttggctaagtaaaagtcattcccagcactaaaaggcaatttaacatgcatttacccccaggaaacttagaaaatgaacagtaattgcagaggtcaaacttgtaagctggctatacttacttgtttcactccaagacttgacagcgatgcaatttaatcctcaaatctgtgactacctgagactatcattgaattgagggagcttatcaactaagaaaattaaaaataattgtactagtttatagctcaggtgtagataattccatataccaaataaatattatcgtgatgtgttgtgagtttataagttaacatattacatacgtgtgtgtatacgcacacatatatcttatttctcctttaggggacgatctctccctgatttttcaatgtagtttcataaactttctaacactaattgacaaaattaaaaacaaatattgtgtaatgcacagatggcagaaagtaagcaaaagtgtatgatttcaaaaacaaaaatctacagatatattcttatcaatttatttttaaattttaagtattagctaaacagtcttattaagagccattttcatataaaatagtacattgttatattttcttttctgttatgatattgtaaaatgtggctcattcttagtgatattaaaacaaacaagtaacacaatgtttgttagacgtgcatttttgtctaatctattttacaaatcttttagcaatataattaaaaatatttgaaatcagggaattcaaaggaagtaaaggaatgagaaaagcctagtggaataaagatattataaataagatattaaaatatagatttaatttttaaatgggagcatctggcatgagtgaaataaaatgaaacaaacctcacggataaaactttgttattaaaactcttttccttccttcttttgcttctgtgcagatgatattttgataatttcctctgaaagtaactgaggctgtgctgcttcttatagataggctgcaaggaggggaaacccattatctttcaactcttaaactgtctcttcataagataagcatttcaaaaattgtattccgtaactccccttctagtttttatccctcagtttttagttgactaaattaccaaaaacaaaagtgatggggcaaattctataataggtctgaggggtctgaagactcaaatgaagcttacagagatcctaaccggatgatctagtacttttgatctttgatttggtgtgtaattggttatcaggatttgtttgctagaaaatttacccttaacacagagaaatgtggaaattttagcttgaaacaattctcaagattatacatacttttcaagtttaagacatattccttattcattacttaattcattgttatttcttctcctgaattcaatttttttttttttttttggagacggagtttttgctcttgttgcccaggctggagtgcaatggcgtgatctcggctcactgcaacctccgcctcctgggttcaagtgattctccttccttagcctccaaagtagctgggattacaggcacacaccaccacgccagctaatttttgtatttttaggagagacggggtttccccatgttggtcaggctggtctcgaactcccgacctcaggtggtccgcctgccttggcctcccaaagtgctggaattataggcttgagccaccttgcctagccttgaatttaatattttatttatgctgattgaagttagaattttggccaggcgcggtggctcacacctgtaatcccagcactttgggagactgaggcgggcggatcacctgaggttgggagttcaagaccagcctgaccaacatgaagaaaccccatctctactataaatacaaaattagccaagcatggtggcgcatgcctgtaatcccagctacaagggaggctgaggcaggagaatcattgaacccagaaggcggaggttgcagtgaaccaagatcacgccattgcactctaacctgggcaacaagagcaaaactccatctcaaaaaaaaagttataattttatcagcagatgatctctcagggtataacttttaaccataattaaagaaatgttagattagactttatccatatacattaaaaatatgaaatactactgaatatatagttcctttatttaaagccacaacaagagcatttcattcacatagctaaatgatcaatgtggtggatattctccgtatttatcaggagtttaaaaagtaaacttatcagataaaaataaggaaaaagaatattccagacatttcaaagtttaagctggtaaacagtgtgaggatcccatttttgcatatgaatggaacaaaggttggagataagactagagaaaatgttaggggccagattgcagacatgctcaggtagaacacaaagaaaatcgactttatgttacagaagatagatattcattaaagatgtttcatcatcaaactggcccaataaaatttatgttttaaaactgggctctttgcagacagtatgaagcatgatttgaaggttatgagacttgaaatagaatagctgaagtaatgcaaagctgaagaaaatcagccaccaccactaccacaacaaaaacagaagaaggaatagaaaagagagaataaaccagaaacccacacgacagggcttagtgcctgatggagtgtcaaaaaacagtaaatatattaatatgtatgcaacagtagtttcatactgcatgtaatgctattaaaattaaattactagtacatccttgacatctattttttcctttaactattttttcctgtaacattatttactgtctatataagactatattatttgtatgtgtgtacataaatataacttctttgccaacttcccttttattatatgtttatacaattttaaaaaatcattctagtggttcaatctttgtgcacatccatggtcattttctgaagaaattatcctagatatgcagcttctgagttaaatgatatgtatgcatctaagacttgatactttcagcttaacattgtaccatacttcatatttgaacatttcaacaattaaaatcacataagttttaatagactttaaaaatatttatttagaaaagtaatagtcaattaaaataatgtaaaattcagctttacattactgtgtcccactagatattgagaagaagcttaagtacattcaaacagttgaaactacttggacataaaacatgacaactctgcacaccttaaaaattacctaaatcatttggacaaaagtgtttgaaatttgttgctgataatgtaaatgttaaaaacgtaggcaaaaggcaaactgaaatttagctcaaacctttatatgtgtattgttggtgtttataaaggtataaaataataccatgtaatgcaagaaggctataactaattcatattgcttcctcagttaatgtcttcacataaaaactacccgagatgtctattttttgaatagcagcttgaattttcaaatattgtaagagtctcttgtgtattgccatatgtgcataaaaaatttctaagtctgtgaaacttggaaaaagcagcaaatacatatttttttctattttcaataaatttatgcagagaagtagggtgaatgaatgccttttgggaaaaggaaagcaaaaatataactcaccattttgtttgcatgtacaatttatacattgaaagtgctattcactagcatataatctattatatctaagattacataaaaagttatttgcctaagtaattaaaaaagaaaatataaaaacaatttataattccaatactgggtgcttagaattttcttatgattcaattaaaagtttatatactactactaaaatagagaaacgacaaatgcatttgttgagttatcactagaacatgaagttaagatatgtagaatcacagcctgcctcctagaacaactctgaggacagaattattcacctattacttctcttacttgtcattagaatctcttgtcattgcaatatcaccttccatctattttctttacatcttccaggatcatcaattcattatattggttatgttttaagttgactgctttttagaatcatctaaataacttggtctaagtaaattatttccaactcaaaataatggggagtttttctgagtcttatagacaaactcttattctgtttgttttaaatttatttgcttgaacctgccctaaatttttagtgtaggaagcccatgatctaaacctatttattctagtcattgaggagaatagagggagaaaacgaaatggaaataataaatcagaacccttggtggaagaaatggcgcatgtacttggaggcggagacaccaggaggcttcctaaattctctgacatatgtcactccctgcctggttttctcccttccctatgatagcctgtgatcatatattgtattatttccccactcctctatgatattcaccttgggttaggaagcccaatattgcttttctagtcataccataagcctgttgtgaagattaaataagaatacagttctaaaacacttaaaacaatgcataatgccttagtaaatacttaacaaatagaggctttcatattttgtttcctgacctttgctttgtaacctcctactctctgatcttgacctgagtttaataagttttttgttttgttttgcaacttcaccctgatccccttcctccctgagcctacttcctctttgttacatccatggttttgatttactgcttcagcccagtacaataaccttgtttcctgattttcctactgctcatcaattcaagtccctaactcagtgactccagaggctgtaagttgaaagtgtaagaacttcctggaaaaattattttaaccatttttaaatctcttattcaaaagaatatgtggaaaagaaatcagaatagaatcaatttttctcttcaactctttaaaatactctcctaagaacttaagcataagagctctgtaaaactgaaaattacggaagaaaattcaaaattaggaaagctgatattgttttgtaagactagattcataatgttaaatgattccctttttctctatcaaattataaatctaatgtatgctcaataaagtcattttaatttaaaactaatctccagtggtggttaacaggttgctggttttaaatgacattttggaggcttaaaaatgtattttagacttacttttggctcttttatcattaaaactgattgaaaatgtattggcattctctgaccttttagaactaatgacatacttatgcataaggcctagtttagtaaccaacctcagaaattccaaattaaaaacttcactttgagatccatttcactttgattcctgttgacaactgctgcttaccctttgaactttcatgcttctgggactggcaaaatgggtgcaattttcctcagaactactgattgattgaatctctgaaaaatggggttgctaatggcactagaatttatatagtggttttatatagtggcttaggcctcactataattattttaaaacattaaaagctaatggatcactacagagtggcaggttctgactcaactgcagtcttgcttcatgctgtttgacaaacgactagtcatctagacaatatttactgtttcggtgcctttcccagccctcatttcattgccaggtctgtggtaaaatcagtaggttaaaaaaaagtataaaaagaaaagagaataatttttgagaccttctggaaagtagcatttgtatatatgtaaagaatcatactatattccttattcaaaccatgcattgtgttcttcttttggttggttgtttactttattggtgagcaaataggcaattggtatacaatgatgtgttaaaagtagaaaacaaaacacctacagtgtaaatcaagtaatttaatacacagaaaataaataaaaaatacatgaaatgttaaatatggtggaagtgagaaaaacacagggatgatatataaattgtcttttaaaattgcagtgtatccctcaatcatactatctgaaagctttctgaagatattaagggatttgtttgaatatctttccctcttttcaattgaatttctaaactttcaaatgttttaattttgtagtattagataggaaaatgctttttacgatacatttaagcctttttccagaatcttagccttacacccttataaaatatctagcatatctaaagccaaaccaggaaagaaagaatgaggctacttggtttctcctttttattttttaacaaaacttctaaaatatcaaaatggaacagatataagagcgtgaatacaaaagctgaagatatttctaaatatatgtgtgtggttttgacaaaatgctacgtagtagaaacaatacatgtgatgggaagtattctgggagtcaataagtgtttgggacatattcctccattgtttttgaaacttatatcaatgttctgaagatatagtcttatttttatcattaacatttacaaaggtagttttgacagatactggaaatgagaacagaaaaagaaataaacaaatacatttttgttgcatataaaaataatgggaaatttaaggaagacatgtggcagactggctgtcttaatccattttgtttcactataagaaaatatcacagagtgggcatgatataataaatgaaatttattttatagttctggaggctgggaagtccaatatcaaggtgctgatatcttgtgagggccttcatgctgcatcatcccatggtggagggcagaggggcaagagaatgtgagagagccagagaactttccagaagtagccagagaacaatagaaagctgaactcacttttgtaaaaacctgcacttgtgacaatgagcctgctcctaaaataatgatattaatctattcatgagtgttctgcctgtatagcctaatcgccccttaaagattacatctgttaagactatcacaatgacagttaaatttcagtatgaatgttcggaaggtcattcagccatagcactgacccgttctgctttgtgctaaacctgctttgattatccattaatattgtgagatgcaaacctatgaattagtggaaatttcaatgaacagccacaaatactaccaagcctttcgaccaaaacattcaatttcagatatttagaagcttgtttagaaacactctcttaaaacagataaaagaacttctaatttcaatgtcatttcagaatctataaaaaagtaaacttaccaattcaaaatggatttagcagtcccataaaaaagaactttgctaattaatgttctggaaaatttatttgcctgacccaataaagttcttgtataacaagctactttcagtggatattagtgcatttcattcatactatgatcagactgtccagtagaactgaatgcaaagcaattagtgcaatggaggaataaaaggctttattaaatgagacctagagatagaatttacagaaagggtttctaaatgctatcactgccactatgcttggagacaggaaagttaatcaatttgcggtggggaattaatgataaacattatgtgtattactcacccatatgttcttaacattgcacttaagagagtttatatttcaatgcagcacttacctcagtattttttactgttacttaacatacaactgtgtcaaattgtaatgtagcccaccttacaaactggaaacctgaaatctgtgattgatgttcaatgggctctttttttccctagctctttagaaacagtgggaattttatacaggctagagtaacaaaaacattgtgaaagtaagaaactgccaagtaatatgtttttgtgtaataaaattcaatttagttctaatatgagttatagcaattggcacttaaaagttaagttaaaatcagcatgtaaggtttatgtgtggtaaccagcacccgtttaatttgattttaatttttaatttagcatttttcatatctgctcatcagaaatattttatggtattgggtctggtaaaataaacttaactgctggtattaagtctgaagtttcaaaaattataaagatcgtctccttctgtaggaagttctaatttgaaataacatatttttatttgctcagaacattcttattttaagtaaatatgtatagatggcatttgtatgtataaaagaattctattaattttaatagattaaatatgataaaatattaaattatataattaactacataacataaaattaactaactacatattaaattaacattatgttaatgttaagtataaacattttatattttaactgttaacattaaaatatattaaaaactgaaacgcattattcaaccaacatggaactcttcaaactagaaaagcacaaataatataaaagtggtggaaagaaggaactgctatttataagctttacaagtatcataatgcctatgacatgtaaatattaagtcagagaagtctacaggaaattttcatttcaattacatgatctaatgtcttgtagccttcttttgcttatttgcaaatagacctatagccagtccataacaatatttagtcatttaaaaccaactgaaataacaattatattagtcagattatcaagagagacagacccaataggatacatagaggcgtgcattgaggatattgcaggttcagtttttgccaccacagtaaagcaaatatcccaagaaagtgagtcacacaattttttttaattttccagtgcatataaaagttaggtttacactatactgtattcttttaagtgtccaatagcattatacctaaaaagcaatatacataccttcattttaaaaatactttattgctaaaaaatgctgatggagagacatgaagtaagcatgtactgctggaaaaatggtgctttgcaacacggggttaccacaaagcctcaatttgtaaaaataagtttgtaaaaaaatgtgtgaagtgcaataaagtgaaattcaataaaatgaggtatgcctatatatagatagatagagatgtagatatagatatttgagtggggatttattagagaaattggctcacatgattatggaggctgagaattctcatgacaggctgtctgcaacctagagattctgaaacactaagaaaagcctcaaaaccagggaagctgatgatgtaattctcagtcccaggccaaaggcctgagaacctgggagtggggatggggcggggaactagcataagtcctggagtccctaggccagaaaaccagggatcctgatgtccaggggcaggggaaaaactgtgttttagctccaggagacatagagagaagaaatccttttctctccttttttgttctatctgggccgccagctaactggatggtacccacctacattgaaggtgaatcttcctcactcagtccactgagtcacacaccagtcttctctggaagcccccactgatacagccagaagtaacgttttaccagttgtctgttcctgaatccagttgacacctaaaatgagccatagcaaaaatagagaaatgacattacctatcactattttttcaataaatcatgttataaaatgtgcttgaaaattctctttacttgtataagatataaaaaactaacttcattcacaaaatagcttttcttcatggattctgtcaaaagaaaataagtcaaaatatttaaaacattacatgtttgaagatgtttatagcaatgtaatatgtgatagaataaaaatctccaacttttctaaactaggagaatacttaaataagctatagtagaactgactgagcaatatcattcagccattgaagatgtagtaaataggatacaaaattgtatgtttgacctgaccattactactgaaaaatcacattaaaaatgccaaaaaaggacatatcaaaaaatgctaccttgaccccttcttcagtattgggcttctgaatatatacactgggttagttctgggaactagataagaggttccaaattcccactcagcaattgaggctagatttctgccttcagatgtggaatttttctatccatacatatcaagaagcaccttaatggtttataaagtataacctgtaattaatagattgtatattatgtaaattatgtaaatagaggcacctattttatttttagggtcactgtgatcaataagctattactatagttctctgaagataatacacttcaattatcactgagaaacagccatgactcactgtggtaattttacctcatctcttatagttagtcatccacaccacgcctttacctgggatactgctttcattttggatcaagaaatgcaatttattgcaggattccccagtgttatctgagacttcagaggagaagcacacagaactcttcagagatacttgtgttctgcccccttccatgcattttttaatgtctttgtgtagggattggccttctcatgtaagagaggtgaccaagtttcttggaacagattcattccaacattcccacctccctgaatctctacagtaggccagggaggttgtatataggttattttcaaatttcatgcatttttggttcattctttaattagccaatctaatgaattactaccaccccctgcccaagtatcaagtcagcacattaaatcccaaatctgaaatcttaccacccatgacaatatatttgccctaatagatacttaatgtcatactatttggtgtaaacttttataagtgggctttatacttctttgactcaattattttgggacctaatttgtagcatggagtcaataaggagtaacgtggtgagtccagaagagatccgtgaaatttcctatgtcaagttattgaaaagcatttgtgcagaagaaggctgattccctcagaagtggtgagaggttgcttccaataacaagaaggttcagaagaatttgaaagttcaaatttcttatcaatgcatgagatatcttatatggcagaagatttaatcagcaattaagctgtgctacagtcaagccttaatcttgtcctcagcagtatctaccctaaaactacaggataaagagagttcttcaaaactgccatcaagatattaaaattttaccttatttctgagctaggcattcatggccttaagtttctcatttgcactctgtattcattcggagacttcagagcagttagctggaaccataatcttcaaaatcactattattgccatggccttgcattccacctgcacttcattccatgccaactctggtggttatttaaacaattgtaatgtaaccacaggctgtaaattgtcacagttccatttcccatcaatatgtgctacagagatatgggagcaatccaatctcagaatctcatttttatggttctgtttcaattactaaatttaagaaggaagtgtttctaggagggtggagagggacagcaaaaatgagcagggtcagtgcatcttagatcccagagggattgcaggcttgatggagggaggaaggtcaaaagattgaagatggcataggagattggaatgcttgaaattcagattacagaagggtttatattattcttaataatggtaatattcactaatgcaacttaaaaggaatgtcattgcattcaatagaaaataactataaaatacatttaatgtaaatgaaacattgaatacaaattagttccattgaatgccaaaaggagtttgagatttgaattttctttgtaaaagtaaaatcaaaatttcagaaccttattatctgaggctttgttcttaccatgatattactgggtatatacccaaaggattataaatcattttactataaagacacatacacatatggttatcgcagcactattcacaatagcaaagacttgaaaccaacccaaatgcccatcaatgatagactggataaagaaaatgtggcacatttataccatgaaatactatgcagccttagaaaagaatgagttcatgtcctttgcaaggacatggatgaaactggaaaacatcattctcagaaaactaacacaggaacagaaaaccaaacaccacatgttctcactcataagtgggagttgaagaatgagaacacatggacacggagggaaacatcacacagcggggcgtgtcgagggttgtggggcaagggaagggagagcattaggacatatacctaatggatgaggggcttaaaacctaaatgacgggttgatgtttacagcaaaccaccatagcacatgtatacctatgtaacaaacctgcacattctgcacgtgtatcccagaacttaaagtataataaataaataaataaataaattctaaaaggtaattgtaaatggaacaacttactcactgtaacatgatgtgatttttgtgctctctctccctaccacaaaaagccatctcttatacccatgatagacatgtcatgttgtagaaaatctaccctagcttgcaaatgggttcaatatagtgaacccattatcctgtggacaacaggaaaccgcacttgtatctcttgttcacttccttattacccccacatcttctgtcaaaaaaataaaacacttacagatctggtcacagtatctctcaatttgactatcaataaactttaagcaatacttatataaaggtgactggcataaatgaagcatttcagagatgatatatacattatctcctcctatctttaaatgtagaatatgcttatgctggcaatgacttccacacaaattccaacaatatcatctttctttgtttttctacattgtgattctgtaagtgtaaaacacgctaatatttatttacattttaattgatcagcttacatgaactattcagtcagcttgaataatgaaaattttctatttactatgagtttttagccattttgttagtaacctgtttccaataaagatccaactcttgaaaaaggaatgtttatttttttaaaaaaggtattagttttctcccatttttttctaattataatttataaaataatcccaccattccagattacaaattaaaaatgttgtgagtgtttaaacctataagaagtggatttaccaaacaaccaaattggagactcttcaacaattaattgctttttcatatttcatggaaacacaaagatgcatatatactcacacagaataagacttagaataacaaatttttgcctgactcagatggatttatcaaatttcccaaacttgcctgaagaaattgcttatttttaacaacttttttaagtaagctaatgtatacagtagcaaggttaatgtagtttttcatgtggtaaaacaatcacatcaaaatgaaaatctggtcaagaggattttccttaaaacagaggggtcctttggaaaataaaaatttttcatgctttagcagagcactttaaacttatcaagggctataggaatccaaatacccaacttcagagtcagacctttgcacactctgaagtgtcatgaagtatcagcctaatttttgcaatacttttttagcaaggtgagattatgttttttttttaatttggcacataattattttgtcctttacctaattctctcttctggcatcctgactctatgaaaatgcatattttttttctaattgtggataaaaaaaggagaaagaaaacaaatatcattattaaattcactattctctctccttattttcttcttttatttagtttttaattgtgaagtattatttgcctacagaaaagtacgtaacatattgtgcagctcaatgaattaccagcaatggtccacctgtataattgccacctaggaaaagatagaacattaccagtgacccagcccccatttccttttcctcaatcatttttcactcttcccaaaggtaaccatccatgggatcatcaacactgccattcatgttgcttgcttgtgaacaattattatacagtgtgaattattttacccaacattaggttcataaaacccattaatggtgttgtttataagtgagatttgcttgttttcattgttgtgcaatattttattgtttgtgttcaaaaaaaaactttagatgaatgaaatttaacagagttgaattgagcaaagagccattcaggaattgaggagcccctcaaaccagataggttcagagcaactggggggctgccacaagattagataatatttatggacagaaagaagaaagtgacatacagaaaatggaagtgaagtacagaaacagctggattgattacagctccacatttgccttatttgaacacagtttgaacagttggtcacctatagttggctgaaactctgtgattggtacaagagtaggttacagtctgtttgtacatccagttaggtcacagttcactacgcatgaagaaaccttgaggccaaacttaaaatatgtaaggaggtatccagtctactctcaaagtatgtttgggctgtttccagtttagactattatgacaatgcttctacaaacatttctgtctcttggtatgtacattcatctagtgggtatgtacctaatgggggaaatttctgtattctaagatatgcatacgttagttttcagagatcatttatcagaatgattgactgaaccaatttgcaatcccaacaacagggtacaagcattctgatagtcccatgtccttgccaacacttgctattgtaaatctttttattttaatcattctggtggctgtggagtggtatttttttattttgtatttccccagtagttaataagattgctaccttttcatatatttattggccattggttatcttcttttatgaaaccacctatccatttttctgattgttgtctcatttattcttatagatttataggagttaatatttattgatgattttttgttaggtatatgtattataaatatcttctactgtggcttgtcttttcactctctttatggtatctttttaactatgaagtattattgcagtcaaattatcaatcttttcttttgtgttaatgcattttatgctgtgtttaataaatccttttctacccaaacttgtggatatattctcctatatagttttctagaagctttattgtttaccttttatatttatatctataggctgcatggtattaatttctgtgtatagtatgagttaagagacaagtttcattatttttcatacatatatctaattaacctagaactacttaatgaaaagacctccctttctctatagtacatactttagtgccagctgggtataaatcaagtgcctatgtatgcatggacaactttcatttatttatttggtttatccttgtacaactaaccaactgtcttaattactatattaatctatagtcatcaagagccagtttttttcttcttcctgaagagtatcttggcaatttttgtacttttgcaacttcatataaactttacattcagcttcaagcacatttacttgtgcacacacacatacacacaacctgggatttttaattgggaattcactgactgaatctatagatcaatttgaggagaacttatatctttacagtattaagtctctcaatcaatgaacatgctatatcttcatttattgaatcttcctttattttactcaaaaatagttttatagtttttcatgtagaggtctctcatatctttaaatgagtttgttcctagttatttgatcatttaatgctattgcaaatgatatgttttttaattctatgttgtcagtgttgctgttatatataaataaaatctttttttgaacactgattctgtaacatagcaagctgataactaatttattaattttagtaatttatcctttgttctcttagattttctacatacatattcatatcatcactaatccgtaacttttgtttcattctttccaattcctaaatacttttttctgattttttttcttggactacagagtctagcacaactccaattcaatgctgaatagaaatgttagcaatttgtgtcctttaagacagtcaaaaatttttattttattagtatgtatgatacttgatatagattttcttaaagtactctttataaaaataatgaacactttttaaagtttccaatttgctggttatttctaggtttgttttggttttgtttttctaagactggatgttgaactttatctgtaccttttcttcatctgccaagatcatataatttttctcttttggtcctaaagtagcgaattacaatgattgatttttgaatgccaaaccaatcttgctgtcctataataaaccctatctgtttatttatgcagttctccgtttgctaatttatttaccttttgaatctacaatcatgtgaaagattggcctataattgccttttattggaataactttgtcaggttttgttatcaaagttgtgctttctttataaaatggattgaatagtgtcttgcttttttctaacttcatgaagaatttgtgtacaattaaaattaattactccctcatatatttggtagattttgttagtaagaccactggccttacattttgtggtgcgtaggttttaattccggatttgaaatctttgatagttacaaaaccattcaaattttctatttctttggggaggaacttttttaggaacttgtccatatcatcttaattttcaaatttattggcataaatttgtacataagttatccttctattatctgtaacatctgtaacaatgtacttttaaaattcctgttacatttttgtgtcttcacttattttccttgtaagtttcaacagcttattttggtctttttaaagaaccaaacttctgtcagatcaaccttttaattgcatttcttatctattttgttaatttttgctcttaattattttcttccttgtacttgttcacatttaacttgctgatttttttcaacttctttaaattgatgagtaactcagaatacttttcttatacattgcaggctatcagtttccttcaatacaatttagctgcatcccatctactttcaaaacttgtgaaattttgatatggagtatttttattatcatcctattcaaagtacttttcatttctctggtgattttctttgacccatgacttcatttatgctcatttggggattttcttgttgtctcagtcccaccctcatttggcaagccctggaccccagttttattaccacctaaccattgaatacttttaaagtgttcctcagtttgttagtttcttagctttctttttttaaattggtatatgcccctcagggaaaaccatttccaaatatgaagctatctttctgggttattttcttctccaggactctgggcctataaatttttactgcctctttagctctgaaaacacattatgtattcaatttttctagttgttgtcagtgggaggattgttctgaatggcttcatccaccaaccattaccaaccattaccaaaattggaagtcaagattcccattacttttaatatttgattcctaaatgtaattatcaaataacattttatttgcattctacaagaatatttgagttccttgagttgcaatttttataacaaagattaaaaaactcaagtatgcttttatgtgggtgataacaactctaatcaaggctaaaactttaatagaaatgaatgcccaattagcattttcattcataaatttattgttctaattttgttatacatattaacatcttttagtctttggctatcatcttgttcacattttattattattttttcaattagctattttgaccagaaaatcctcatatggatgtaaaaataaatattttattttgcttttacctttcaaaagctgggcaaataattattttgcttttaagaagaaggtatctaaaatgcattgtaacttattttgaaaaatgggttccagatatcagaggttagcctgttctgaatataatacatcaggggaatagcttagaatataaccaaagggtgtacttaccccacgtataaaatttagacatattacgtagtgggaactcgtggttgtaattaaaatatgcctgatattatagtaaatcgaatcctgttaagtcattcacgtattgatagaactacatgaaagtagtattgtatctctttatttccaccgtgagtataaaactaacttcttttagaaggcctattaatagttcacatatagcatgtattagtctaataatattgccataaaaaataacacagactcggtggcttaacaatggaaatttatttcctcaaaggtctagaggctggaagtccaagatcaaggtgtcagccagtttggtgcctcctgaggcctctccccttggcttgcagatggtcaccttcttgctgtgtcctcacatggcctttcttccatgcatgtgcatccctggtgtctcttccttttctgataaggacaccagtcatatcggattagaatccatgcttacaatctcactataccttgattacttagttaaaggtcctatctccaaataacaatcacattgtgggttagaatttcaggacatgaatttgagagagaaataatttagtccataacacagcacatattcattcaaaaaaacattacccacttaatatgggacaaggactgttcctatatcaaaaattataaaggacggaaataaacaaaaatgtttaaagcctaatacattgttatttttaaaaagataaaggaattggcagtatagggttgtggggagttattttagatagagtggtgataaaagattgttataaaaagatatcctctgagcagaaacctgaaaaaattgaaggaagacggaatttatgaattatagaggagaaaattttaggcataaccatttgcaaatgcaagggccctgggacatatatcggcatggctctatagaggaaatttcaagaaagccattgagagaatggtaagaaataaagtcagacaattgacctaagatcagtatacatagagtcttgtaaaccttggtagagatttttattttattttttaaagagtcctgggaagccactggaagctttgataggggaatcccattgatctgattttcgtttataaaggcaccatggtaatagacttaggagaggtactctctagaatgtaagtaaatggggaaaccacataagtagttcagtagtagagtcaaagatgtcatctttgaattgggtgtcagcagtagacaggatgagatgaggtaggatttgggatgtaatttgaatgtaatggtgacaggacttgctattgaagaagatgtttgaaaattcctatttttggtctaagaaataaagtaaatagtggtgctattccctgacatggtgtggactggcttgaaggagagttaatttgggagtaaaataaaatgagttctgttttagatgtcataagttagagatgcatattgaattgcaagtgagaatcatgtaggcttttatctatagctctctagaaagagtcaaggtagggggctagaaatgtaaattctagtgttatcaaagtatactgtagatcatagtcaaagtcaggggactcgttgatattgtccatggtgagactatggacagagaagagaagcagtctaaggactgagcccaagaacactccaacatttaaaagatggagaagaggattctgcaacaagattgtaagagtaggaagtcaattaaaagtagaacaaagcaagtatgtgatgctgaagccaacactaatatgtgtgatcccatgatcattaacaagctatgtttctagagaatataacaaaaaataatcctttcaatattatttatttaactggaaatctgaaaatttgtattaaatataggcatagcaatattaatgtcacctaactaatgaataatcaagcccttggaaagaaagcatatacctgtgattataataaaaggtaattaattatagggttgaacaggaagggggaagaactatcatttaaacatgttatactaaatatttatcatgcttcttttggctgggtctttcataatctcataaaagagaattaaatatggagtgatgaaaatatagagatctatgttgatgttaagcagaaaaaattctcactacttgcaagttaatttggtgttgaatatagatgacttcagatcctcaataaatactagttgatgttctttttatctctttgcttctttctacaggcggggaagtcccgtacacgactctggctacccgaatgatgatgggggcttggtggctatttgctttgattgttatctcatcttacacggcaaacctcgctgctttcctcactattacacgcattgaaagttccatccagtaagtaaacaatgtttccattagccacaaaatatgagaaatgataagagtggccaaagctatctgagaataagtatgtggtgtctcataataaatgtacaacttctctttgagtaaaggatcaattttgtgttactgcaaagtatcactgattagtccaagtcctggaaatgcagtattggtagagcattttttataaagtaaaaatttggctatgatttcaatgttgcttcccacattttcctggaaggataacacatcttcagaattttagtgtccacaaagaatgactatatctgactaacactgtgaaaaggaagaaaaaaaagagtcatacttaaaaggaaatctttgccttgagtctgtcccattatgtactgtcagaataaatagttgaatagatacagatgtttgagagatagacggatgattggggattggggagaaaagaaaagggaggggaatagcaatcaacagaaaattatagtatttcagtaaccacattctgtttttctcttcattaccttatacttcatgtggtccttattgctgctatttactggttgcagttggaatgctgggaaatagtgattaactatggtgcacttatttaatcctaaaagttacctaagccagtgtctcaattcacaaatgccatttccgtaagcccgtggagcccaagggccttttatccaccacagccagttttgcttttgtggtttcatgctataagatcaacaccacagtataatttctgccttattagaacataatgttctatatattgttttaagaaaaattttcctgaaaatgttttattcatccccaaacaaggtaagtttgaattttcctaaagttggacattcatttcccaaaaagctgacaattcaaattcagaataattagatatgtcagggaattccttaggaatgtaacttgtttggaaaagaaaatctgggtagttattttcttttaaaaagaatgtaaattaaattcattagtagccacaaaactattatagcataataccaaaaaagttaagaattaattatctataaataaatagggtattattttctatttgctcattatacaaattgaaactcccatattcaactagtaatgctaataagtagtcaattattttatccattcataaaattgatgtttctagtttctctcatgaaatcatgctgctcaagttgttttccaattattcctttgatacagaaccttcatattcccccaatttattgtccatgtaaatagatctatgtgtgacataaattacaaatcatacagagtgaaacttataccattgatggaaagcttatactggtgaccccataagcatcatactttaagcaatatgaaaatgattacaacagcccagccaaaagatcaatgaaatgagtaaaattatgaaaataataataaacatttattgatcacttacaaaaagccagattttgtgatgcattagcttatttaaaacttactatcatcttcaaaaatacatactatgaataactcattttataaatgacaaaactaaagttgagaggataagtaactcacccaaagcctgcagctagtaagtgactgagtaaagaccaaatcttaaatctggttcctgagcctacattctaactgcatcatgttagttcccacaccacacttgaacttgaatttctgtatgaatcttaggttttagagaacacaagaagaaactcgtcatagcattttccattgctaagggatgtaaaggatgaaattctccaaatcctcaactggtctgaggaaatagagtatcaaaagttaggtgacttttgtgttataggcatgtaggcatatatcccaacatgagttaattatgtctataattggtatctaccattcagggtaagactttggcaaatccaatcaatagaagtcattttaagaaaaatagcttaattgtcaaataaaaattgtacatatttaagttatacaatgtgatgattcaatatacatatacattgtgaaataattgacacaatcaaatgcaccacccatgctgtgcattagattcccacaactggttcatcttctgaaagttcgtaccctttgaccgacatctccacattttccctatactctagcccctggcaaccaccattctactcctgcttctacgagtttgacttttctagattctacatataagtgatatcatataatatttgtctttctgtgtttggcttatttcacctagtgtaatatcctccaagttcatccatgttgttgcaaatggcaaatagcaaaacagtttttaatcaataaaattgagtattttatttcattaacatatttcttatcaattatgttgaatgtgtcacattttgggtatccttaaagctcaaaatttatgtagttcacatctgactttgaagtgtttttaaataaataaatcgtaaaaagtttaaataaaataactgatcctatgcagtaaacaacaactgtcattatagtaaacaaaaaatcatggttaacattgactgagaatttataatgaaccagaagttaagcatattacaaatatcatctcatttattccacaaaataaccttaataatacaagtactcttcttattgccattttatggatgaagaaacagagtttggaagataatgcttaagattacacactcaataagtgtcagagttgagagtccaatccatgtcaatcagacaccaatccgtggccttacctgtcaaattcttttttttttcttttttttaatctagtggtgggtcctagaatttgtttgcttgatatggtatttctctgaggttgcagactttgtggtgtctgtaaatctgagttatttagttattactaactttgccagcaccagtttttatctagactttcatgcaatagcagtgggaggagaagcctgtctcaaatttttcatccataggtttatctaaaagtaaaacctgatggaaaaagattgtaatttcacatcatgtttccctcaagtgtagttctactgcccaaagtaactttgcattcatttttttaaaaaatcattcctttccaatgccaactggcattattaaaagtcatcagtgggtataataaatctctacttccttgtaatattatcactggactaattttggaatgagagaatcagagccaaataagttaaaagaagccagattccctcccgaaatttaaagatatcttctaatttcatgcctcaacagtgttggtaaacataattgcctgcagtgtttcttagaaacattcaaaatctcatttgtaactaatgccaaagtttcttgggaaaattctaatttttcttagaaaagacaaactttttttcaaagtagcattcaatgtcatgcttcttaatcatttatattaataagatttgctcatcaccaaatgaagctgcagtgcatgtcaatgtactatttccagcccaattttgctgtgccattggcaaacacatgccaaccatagcttcatttccaaaattcagcgttgcttctgcagactacaatgggcagaggtggttagaggaatgtcagtgaaggggagagagagagagagggagagaaatcagcttctttgaattgatggttgacagaaactcttccactttgctgggagcaatctaatagatttattttggggaagctgaataatttcataaaattttaccttgtttttaaaattagatatctatgggcatctaatctaactggcacttgttattaataaaagttttgaaagggaattttccctggaaaagataacccataaatttaatttcatatcccttcagtgatatgggcagcacatcataactatgtcctatgtttaatataatataatgagacagagtatgacacagttcagttcttaaagggaaaaaaaatgccatttccacaagactctaatgacaatttgggctttttcattcccattgagaggtaacaacatatagttaattgttttcaaacacctagaaattggaatgattttttttctcttgataactagactaatagtggcaatggtgaaatggagcatgtgaagctttgaaggtacttcagagtaagcactggataatagcatcatcaacattagttctgtttgcctttattgtgatattacttccaaaagctacctagttcacataaaagtgaaaatagctatgggaaaatcagggttacacagttatagttattaataactttagaatcaaactggtctttggtgatgaaacttgagttttttcattcccaggagctgcaagtaaacttggacctactcaaagggatcccaacatcccaccatatttttgtgttcagtgctttcattctccataatgcttaaggttggactaaacaaaatattgagttaattctgccactgaatctaactaatatgggatagcattgctttccaaactgatacagaaagagatccataaatattctattactaaagaagaaccccttttccctagcatatcaataacaggatttttgccatcaccttggtctacattttgaaaagaaaataattattgagcaatttttttctaagtgttcacaggtgagtatgatctaattatgcttagaaattcaagcatcaccaaatctggtactaaagcctggagacagagggaaggatagcaagtgacagatgctctgtaaagaaaaggaaagtgggactaaatcatcgagggcatggtaagacttgttaaggaatttggaatttttcctggaggtaatggagagtgacgttgtagaaagacaactttatctctggagaggaggacatgtgggagagagaaaatgtaggcatgcatgggaggccgttaaaggtgtctaatgcatgtatatttacagcaattaactagtatgtctctacttgatacgaatatgtctctacttttttcaagggctacttaatttgataatactagaggattaagggtaacttagaaatttggcttcagaaacttcatatttctaggctaatatttacttatgtagtggatgtaagaatattgcctcagttaattttgtttaagatatttaaagagaggatgtggcttactatgttttagctaactaagtaaaaaggaagacagtgattaatgaggaaattctggaaatgactctgtttaggctgcgtttcacatgcaattttgcagaaaagttgcatctcaaggtctactattcgtgggccccatctgcctctcacttttagctttgagccatcaacaaagaagttagacttatttttattccatttgaatgcatttttttcctgattgtaaaaaaaaaaaaaaacaggctgttttgagaaaataggaaagtacaaaaagatgtcgaaggacaaagcattaataatccataaactgtcatggggcagtaagttctgttaatatttggacaaactttcttataacttttaattttgcaattattatatatacacaggaagtttcaaagatatagtacagagcagtgtcatgtattcttctctcagttccctgaatttttgcatattaagtgattatactacaaaattaaaaccaggaaattgacattggtacaatgtgtgcaaattgctctatgacatattattacatatgtagactcctataatcaccactgcaatcaagatacagaactattccatcacggcaaagatctctctcattctacccctttatagtcacattcacccttccttaccaaccccaacctctggtaacttactgtgttccccatttctgtaagttttgcgtttcaagagtgtaatataggattgaatcagagtatgtggcctttcgaaaatggctttcttattgattcagcataatatccttgagatctatccaagttgttgtatgtaatagttcattgctttttattgctaagtaataatccatggtatggatgtaccacagttggtttagcaatttacttactgaatgacatttttattgtttcaagttttgggctattacatataaagcttctaagaacacttacatggcagttttctgtggattttttgtttgtttgtttctctggcataaatgcccaggaatacaattgctcggtcatgtgttaagtatatatttgttttttaagaaactgccctactaatttccagagtggctgtaccattttgtgtttccacctgcattgtatgagagatcaagggtgtctgcatctgtgtcagcatttggtggtatcatttttttttttttagccttgctgataggtatgtggtgatgtctcattgtggttttaatttctattttattattgtgtagtggtattgaacatctgttcatgggctcatttgtaatccttatcctcttccatgaaaggtgttttcatgctttttgcctattttctaattgggttgtttactattaagagttcttcacatagtccagacacaaaggctttgtcatataggtggtttgcaaatattttctcctagtctgtagcttgtattttcatcctctttatagggttcatcatagaacaaaagttttagaagttgatgaagtgcaatgtatcaattttttcattttatggattgtgcttttggtttcatgtctagcactcttcaataagtccaaggtcatgaagattttctcctatttcttctaaaagttttatagttttacattacacatttacatatttgatgcattttgagttaattttgtataaagtgcaacgtttaggttcaatttttcactatggatattcaaatgctcaagcagcattgctgaaaagactatcctttcttcattgaattgttttgcacctttgtacaaaaaaaaaaatctgttggccatactatgtgagtctgtttctgtgttcctaccctgtttcattaatctgtgttgtctatccctctgccggtaacacagttttgattactgtagtttgagtagagtgattcttcccacctattttttcagaatcattttagctattttagttcctttgtctttttattataaattatagaataatcttgtctatatctacaaaaatattgctgaaatattgacagtaattgcattaaataaattggagtgagaattcacatttttaatatgatgagtcttctgatctgtaaacatatgtctccccacttatttagatctttgatttattttatcagcactttataattttcattatacaagtcctgtacatgttttgttagatttgtgcctaagtatttctttttctcagtgattacaaacgttcttggtatctcgatccatttgtgctgctataacaaaatacctaggtctgagtaatttataaagaatagaaatttatttcctcacagttctggatgctgggaagtccaatatcaaggtgccagcaggttgagagtctggtgagggccaggtttctgcttccaagatggtactttgactgctgttctatgtcctcacatgacagaaaagatggaaggtcaaaaggggccaaactcattccatcaagcttttttataaggaactaatcccagccatgagagcagagcctttatggcctgattgtctcctaaaggtccccctcttaatattgttgaactagggattaaatttcaatatgaactctggaaggaacccaagtattaaaatcatagtaattgaatttttaattttaattttcacatattcattactaggatatagaaatacaattgttttttgtctgctgattttatcttgtaatcttgctaagctcatatcttacttctaggggtttttggtagatcctttcggatttcctaggtataatttgtaaacttactaagctcctttattagttttaggagtttttggtagattctttggatttttctaggtatagcttatgccatttacaaagtcaggtggttgtatcatttttctttctcatccagataccttttattttctattttgccttttctttgctggatagaatttacaatactatgtcaaattaagagtagtgagagtgaatatctctgctttgttcctgatcttgctggaaaagcagtctttgaccgttaggtatgacattatctgtaaagttttttattgtagatattatttctcaaattgaggaagttatcttctattcctagttttccatgtgtttttcgtcatgaataggtgttggattttgacaaatgatttcattttttattgattggtatgctcgggtaatttttctttattagcctgtttagtggattacatcattcatttcaacaactatttttaaaacaaggtagaggctaactatattccccgcttctatttcttctccatctttttctccaagtcttgattttctacttgattttcttcccattattgattcgagtcaataaaatatcatgactgtccctgcctgctgcttcacatcttagtttcttttcccttaccttaactattgttcctctttctccattctcttcccaatagagtttatccactggagtgtggagtccagactgttaccttctcccatcctcaaaattggcttgaaaaactttattattacttcatccaataaagatgaatacaactccattagcaaagcatattgagcccttctttcccacccacatttctgtccaggggcaccaacaaattccttctcactttttcatgctacagtcaagctagactcttatgggaccttgcatgcctctctggagctttacatgctcttctctctccctgaaatcactcaaaacccccttctcttccggtatcttccattttcccaggcagaattagccattactacacatgtgccttctctttgcgattttaagttcttcaaaagcaaagactatgttatatccatcttgagaggcactgctagagtgcctctcagagtacctaacaatagtatgaataagagcagctaatatttcttgagtgcttgctatgtgacagctagttttctaaatactttgcatgggttttctcatttagtcttcgtaatagccccatgagagatatgttattatcatctctattttatagatgatgaaactgaagctagggtagtaaacccaggcaatctagcactataactttttaccaggggaacatattgtatgctaattacaaatacgctaaacctttattgtatgaaataaataaatgaataaatggcatccataagggttactataaatttcttaggaaataaagagagctttgcagaaaagaataaatggcagcagtatgtttagctaagttacttccaggtatttctaagttatgtggtatgcaagtcagtaacgggagactggattcaaacaaatctgcattcgaattctttgccacttaatagctcaatgaccttgtcaggattccataattattataaaccatattttcctaagagtaaaaaagggatagattcaacttcataggtttagtgtagtgtttagtgtaaagattaagtgaaaaagagcatgaataatataacacagtccatggacagcacctacctaacatttgcttccattcttctacattttctctaggcactcatatagattccttggcctgtctttctctctgcccccattttgatggtatttttgtcattttgtccacaattctatatattaattgttcctttgagctgattcacctaaatctcaatgtttcttgcttatggagctactgtttctgacacagatgtcaccatcctaccttacagtctatcttgctgagggttgtctttttgccctgctgcttaatcctctcattttccccaaagataaaagcaaaataaacaaacaaaaatctgatgcatctgcaagccttatctgaatttaggcataaataaggtcttggaagaatgattcactctgttatctcaccttagctagtgactaactagcactgagatcaggttgctactaatagagactggcaagacccctgggtcaggatatatatttgccaggtaagttttctctcctaactcacctttatttagccctctcataatacacagctcaaatactcaaatatgtccttgccacatattcataactatatttagtgtctcccttttttgaaccacttcacatctacctcacttacaccctgtattggaatactattctacttgttttacttccctattaaaatgcatattcttgagggttgttttatcatctttgtaccagttcagtgccttatgtagtgtattgtgtgagtacttagtgggttacaagtaaatattcactcactgagtgaactagaaagacattttttagaatctgacctgagagtgtgaaactccatgacttgtatgtgtaccccatttaaaaaattagatagaaatatgaaagccatttctttgtcctattattccaggataagagaggaaacccaaaatggtatgctctctaagtatcctttgtgtcacccactcactcttcagtcttccagtaggagtcttttttatagctctcagtagggaattgcacactttattaggaggagccaaaatgaaggtggatgaagtgagcgagggctggctcatactgcctttctgtttcattttagtacagaattgtataggcttaactccagaacacacaagcactgcagcagaggaagacattcatctccttactctctattgttagtgttgaaatggcttacttgtcctagcacttaagtactacagtgatggatgtttcccaaacgtacagctatctcgatgtcatagacagaattttgtctctgttttggaaaaaaattaaaacttcctagaagtatattggtctttcaaagccacctttcagtgagcatttaattaaaagttgtctcacagtttgtggctcccaggaacagggctatgttagcatttccatagactctgtttacactgagctcaccaggacaaaaactttaccaattttataatcttccacagcttctaaaataatcttcttctgaacaagatgaatcattctagacaaatcaaatccttctctttttctctttcttcccaatcttgctcctttaagcctagaaacctattaagtgctgtgctcaagaatataaattcctgtctcttctccattttctgttacttcctccccttactgaagtctgctggataaataaattctatccaccacaaacttatagatatggttaaaaaaagaacctatgcttggagtatactgcttagtcattgtggaggacatagtttgagtacagagcatccttttgtgaaattaatgtgggaagagtagtgatgaaaatcagcaagactggagttggcagccggggctgtttggcagaagaatactattaaaggagactgaagacttaggttcaagtctcttttctcctactaaagaataaggcaaattctaaaactactttgcacttcagtttttcgtcttttaaaaaagtgatccaattcttcgctcactgcacaaatatttgctccacagtttgaatgatgttattttccatgtcccttcaggcataaacttttatatcaactataccaatgagatatcttaataaacaaggtgtgagataaaactgatactcaactgaaaacctgaataacagatatcttaagttgaaaggcaaatctgaaaaaaaaaatccttttttgtcatatcttcttattttctttttctagttctctatttccagtcctatttttctttccctagcctctccatcatgccagtgatgttggtatgctgccctccacactctactgctaagtatctgtttgaccccatcaattctctgatgctcttagttcctccatagttcctgtcacctaaagatatttaatttattttaatggctctctcctccactccccccccccacacacacacgcacaccacacacacacacacacacacacgtactacagcctccatttctcaagcccagatgctaaagagggatgatgctaaataagagccagataccccagctaatagcaagtggtgaggaaggcgaggaataaggtctaaagctggctggtgggctgcttttattcagaggacgattgtcattttctgagagggatgctacagagttctcaagatttgctgttgtcttgggagtgtggagcacatttgcaaaacagttcgggcatttataatctcaaaatagcagttaataagacctggctctcaggcatcaagatatgcatttaatatcaacttctgctgaaatttctcaaaaaggaaataccacctacttgagaatagaggataatttctctgaatcattctgaatcagtcattgtggaggacgtagtttgagtatggagcatccttctgtgaaattaatgtgggaagagtagtgatgaaaatcagcaagactggagttggcaggcagagctgtttggcagaagaatattattaaaggagactgaagacttaggttcaagtctcttttctcctactaaaaaataaggcaaattctttttattttattattatactttaagttttagggtacatgtgcacaacgtgcaggtttgttacatatgtatacatgtgccatgttggtgtgctgcacccattaactcatcatttagcattaggtatgtcacctaatgctatccctctcccctccccccaccccacaacagtcctcggtgtgtgatgttccccttcctgtgtccatgtgttctcattgttcaattcccacctatgagtgagaacatgcggtgttcggttttttgtccttgcaatagtttgctgagaaggatggtttccagcttcacccatgtccctacaaaggacatgaactcaaaccactttgcacttcagtttttcgtcttttaaaaaagtgatccaattcttcgctcactgcacaaatatttgttccacagtttgaatgatgttattttccatgtcccttcaggcataaacttttatatcaactataccaatgagatatcttaataaacaaggtgtgagataaatttaaaaaaaatatttattttgagaaattcacagacctactggactgagaagaggaatgtatcttttgcatttggaaaatgttgagttatcagtagaaacttggccccctgttcctgtgttataaagagccaggatttttggtttttgtcatattcattagatacttcactgaaactgtgaccttctaccttactttgacagtaatgtttcactgggtctttaaataggctactaaattagcctacacttattcatggtaacttatttctcctagtcttttatttcccactatgaaatttttgatagtatgattaatgtttttgagctcctcaaaagatcttatagaggaaaaaaatcacaaattattatggattcctcatttgaattcacactgtatttcatttgggtcattgtttcatgtagtattattatgtattattgtttcagagcttgttagtaggccatatgcaaggtagtgatcaataatatttcaatgtcagccttggagggtatattgaataatttttttccataagtcagcattggtcttgattctaattaacattttcaatgttaatttgaagtatggaatagggagtaagcttattaaatatgcagattactctatattgagtaggggtgattattgactagaactccactgtaagaatgtataaggacctttacaaataaaacaaggtgattagaagtacgatgaagtttaatagggacgaatatgtgataatcactcagagatggaaaaaacaaactgtatgcgtatatttgtgtatacctatgataatttcagtataaaccatctgtcaattataaatctgaaatgtggcattagtgtttatttttaaaatgaccagagtaacctagcagcatgtaagttgttcaagccttgtaaagactaccatgacctacttagaaggttcacaaattatgcaaaaactaaaatacaagagaaaaaaaaatggtttagttaataacagtctaaaaatggaagtaatatatcttatagataacaactaaaataatttagtatttaatttgacaaagagaaggctaaaggaggaaaatgaaaaagaagtgttttattacatagagaaatattgtaccagaggtggtatgcaggtattgtccattttcattgagaacaaaatagtgttttctgtgaaacaggagattttggggctatgtacaagtaaggactcccttgtgttaagttttccaagtcactgaagtatcttattaaaaaaaacatgaagtcagttttagggactggtttatgtgccttaaggtacctaatcatattatgtaatgcctctggtaactctttcaactctctggtattatgattattttagtatgtttttgttaacaccatttaaaaatgtgatccttccagggaaattaacgggaattagtgaagtccttcctgaattttcaagaatataggaatatgaaaatcccctatttcactactgaaatctattgcattatttgaagatatcatcttaacataaattttacaatcatcctataatcagcagtaacattgtaaaatgctgaccataaaatttaggataattttgtatttcttcctagtgtcttgagataaataagtattgcagcttttttatgatatataaaaaagaaactgcacatgctttttaccatgcacaggaaaactgcaggataattgaatgtacagaatactaggaccttttatagtgaagatttgcttaataatttatatattataatatatattttattagatatcatacacatatattaaatataatatatctaaaatggcctttcatggtatatacatgtatatttattttataatgtatttattattaaatattaatatataccaaatatttgtttatttaactaatagccatttaaaatagagaaaaggatcataaatgatatttctgtcaacactgtcagagttttgaggtttgtggtagaaaaatacagtgtctgccacatttcagggttcatgatgtgacacaattagtttctagcttgtaatgtgggtcaataagtcagacaagccagtcagattttcagatgactgttctcttgcatctgtataacaccatcatttcacagagagtttaacaatcatttttattggttatagccaacagcagtaagacgtgcagcatttccatcttcccttagattctctaaaatggcctgccgtgtccacatatctgaactaactcctaagtttgtaaggaaagtgcagatctttttaatgcaaggggatgttcccctaagtagtccatgacatctacccttcccaagggcatctactttacataaacttacaattttacctgtgaccatctgactgtaccacatggtgggtagggctgacccagaatactttcgtcgggacagagtgcagaaaatattcccaagtctgtcagggtagacttcagggtcatctgctggtctgtaatccccacactttgtaatctaatctaccacaggaggaccgtgttctgccaggtagatgtgcccttctcatgaatcttgctgcgcactttttctagaccaaacgcatcttatattctggtggctatttaaacagttctaaaaaaattaaaatgaaatagacactctaaaggagttcaaaccagaaggacctgaggctgtcttttatctaatgtattctgttgtgccacatgaggagagttagggggaagatgaaagactcaggacaggagtggggaaagggacagaatggagcgactagaaaaggctgcatcatttagaccttattcaagcattccacatggaggtgcccatcttctgaccctccgtaaatctctaaccctctttgttcctcctatggcaccctctccatccagaaggcttcatttgaaaagttctctccatttcccaaaatggagtcctaaccctctgccttgcctggtatcattctaccgtgctggcctcagacctcagcttgctcttccaaaggcttctgctgtgttgaggaggaagagactctggcaccataacaggaaggaagacacagcactttggtgctggtacattccttcattagagattgctgtctctgggttcctcctgaattaccccacaccgtgaggaatacttttaggctatacaatctaatcttctctgagagaaccctatgtcttccattaacatgactttgacattaatcttttttaaaataggaaacttagtgctattaagctaaaaactctttcctgagcctactttcattaaataaggacaccccttcaggcactaaaaatatcttttacagagctcttaattatggaccaagccaccttgaaaacatcaggagtcctttttatcccaccgtatactcttgatacctttacatttcaccagactttacaagcttgagtctgaggtagttaagaaaacttcactaaggaaaaggagctactaagtaagataggaatgtgacttctcaaagaacaagtggccattggctacgccgtaaataggaaggtggaaggcttattccatttgtccatacatagagcgtacatactctccttcctcctcattatctaaatattcaaccaagaaaaacaatcctgaaatataattttctgtagtaatcctcaacattgccaaaggtgactgtcctcgacttgttctgctgcttatctcaagattctttagctactaaaatcatgaattcttttacatatttataagcatttcaattaagcaattttcttcaccatttcagtttgcttccaatatttcagtgaaaaaatcactcagttcatgtaccccttatcttctctgtctgcactgctcagataagtaactttttcaagagcaaatattctactttgtaccaggtcctatgtctaccagaatcacagactataccctcagctttttgaaatacgttttttggtcctaattgtttgtgttttctttttatttgccttgcctctgaatttatttattttacatatgtggcaaaatattatgacaggcaattcactggaggttcaatgaagcttgcccagctgattgtgttacagaggaaattgccaaatatttctttaaaaatgaacaatgagaacacatggacacaggaaggggaacatcacacaccggagactgctgtggggtgggggaattgggagggatagcattaggagatatacctaatgctaaatgacgagttaatgagtgcagcacaccagcatggcacatgtatacatatgtaacaaacctgcacgttgtgcacatgtaccctaaaacttaaagtataatataataaaataaaaaagttttagattttttattttgtttttgatttttttttttttttttgacggagtcttggtctgtagcccaggctggggtgcagtggtgtgatatcggctcactgcaacctctgcctccgggttcaagcgattctcctgcctcagcctcccgagtagttgggactgcaggcacccaccaccatgctcagctaagtttttgtattttagtagagacagggtttcaccatgttggccaggatactctccatctccttacctcatgatctgcccgccttggcctcccaaagggctgggattacaggcatgagccaccatgcctggccttgtttttgattttttaactacaaatacttctggtcatgattagtcagctgtagaatggctaataatatatagttaaaatgctattattatgccatgctagtttcaggggaatgcttacttcccaaaatgaaatatccttctagtgaagaagaccaccataaaacaagtaagcctcattgattgctgactgttttccagaccctgggctagatctggatttcaaagatgaagttttttaaaaatcatgggaaccagcaatctatattctagtgaggtaaataaacaaatacaattcctaaacacaatgctgaaatgtgaacatattccaagtgttagaagagcactgaagagacagtgaagtttcatgttgaaaggaaggaattctccaggtagacagagaagcatcttatgccaagaagacatctaccaagacatgcacctgtgatacagccaggaatgaagaaacagtgtttggcttatactgtgaatatgagtaaggcaaaaggttgtttctgagaatggaaatagaaaaggcttaagccaaatttttgaaggaacttgaaggctaaggagtttaaactgttttctaagggcagtgaagtacataggcagtacttaaacaaggcagcagtatgatcagattgcatatcagaaagaacagtttagctgtgctaaagaatggattagtggtgagtgagaacagagatagggaaaggcttaaaaataatagtccaggtagaaataacaaggctattagacgtggaaaggcaaagatggtgacagatttacaaaatttaggaggtaaaatatacagaacttgatgagagtagatgaggtggggaagttaaagatccacaggtaaggaaggggattagctgagaatgaatctaattgataggaaacaaggatacggcaattccagaaatcataatagagaacaaagtaatagtaatcatcataataacatcaataattttaactactggtaattgagtgctcatagctaattactaagaaaagtgtcttataaacaatatctaattcaaacctctagataccttaatataaaagtattagttcctctgctcaatagagaaagaaattgcattttggagaagtttaaataattttcccaaagattgaaacacaaatatttatgttttcacaattcatgcttttagaaactaagtgtttgctcagtgctggtcagttggcagtacctcttggggatggcctgccttacccaagcaccccagtccattttgtaacactttgacttgcttcttgggtctaaacaacattaattctcaccctcacggcatattagttgttcctttaaatgctacattttggatcactttttatgctggaaaacttgtcaccgcacttcataggacagctctcagctgctacaaccaatggacaggcaggctgtttacatggttgctaatgagctctcagggctgtaacaatatctgtcctttgacagttgctgaaatcagcatccaaaggagaaaactgagaagagaataggggggaacctaaactgagttggaggatgcttgtcatatacccctatttgtctcttttccactgttagcccttttgcctgaagcatctggtgcctatcctatcagccacgttccatttttctccccctgaagaaaaatctcctctgatgtgataacttaagttgacttgttccaccccatagaaaatgggattagacttaaaattccccaaagccagctgtcaggccactcttgtcagttattgatgagcgttctacacaaccaggctaaatgtagtttttaatcttagaagacaaagaagatggagatgggacagagaggtttatgagagttatttaagttttatgtggatagtgacatctactgtcttgttaaaggaagataggaaaaaaatataagtgaaagtttaccacagaggggttacgcattagattttttaaaaaaatagttgacagttttagagatgtgtttttaacaacgtatttaatataacattatttcattaatataaaattgtataaatgtcccagagagtttgctatgaagaaatttatgaccatttagtatcatagagtcacacaatctcatacttggaagggaaatcatgcattatttattctatttcagtgcatgaattcttcttcaacaatatttataaagaatcacctgactctgccaggggggaaaaattccacaaaaaaataccaatagaaattattaaataaggcattgtggaaggaggaatcatcaacatcataatctttatataaaaacagtagaaacctgatcaaatactgatttgacagatatgcttgactttaaaatctaacctactcaatgttaaagctattgctgtcagatatatctaatagactatcaaatatttaaaaaatttaattgtattatttttattttttattttcctttgagagggagtctcgctctgttgccaaaactggagtgcggtggcacagtctcagctcactgcaacctccgccttctgggttcaagtgattcccctgcctcagccttgtgagtagctgggattacaggtgtgtaccagcacgcccagctaagttttgtatttttagtagagacagggtttcaccatgttggccaggctggtctcaatatcctgacctcaagtgatctgcccacctcagcctcccaaagtgctgggattacagacatgagccactgcgcctggccccaaattaattttaaatgcttgaaaagagtttcagtgtttattgaaagaattttacagaaacctaaagccactcaaattttaaaaatttattttcacagaattgccttaaatcacacagtacctcagtgtatgtactgttcatacaaataactaaatataacttactcgtaagctctcagtattgttcagtacccacaggttgatgctagtctgatcagagaacagtagcaggaataaaaaaataatctcagtcaggtgtcaagaagataaggctgattagagcagcaaagcattttctttcttttatcatccaccacttagagctatagacactcatttttttactgtgtgcatgagtaagactgtgggtttgagagaagagacctcaggtctaatgggttctcagagtgagcattcactgagttttatgtgagatatgtggttaggtagagaaacagagtatactatgagttatacatactaatactatgttcacagataacacttctctggagtactctagatttttccattccttcttctttttttttttttttcttttctgagaatgagttttgctcttgtcgcccaggctagagtgcaatggtgcaatctcagctcactgcaacctccatctctcgggttcaagcaattctacctcagcctcctgagtatctgggattacaggtgcatgccaccacatccagctaattttttttttgtctttttaatagagacagggttttgccatgttggccaggctggtctcgaactcctgacctcaagtgatccacccaccttggcctcccaaagtgctgggattacaggcatgagccaccatgcctggctgattttcccattcctcctatcatctgagaaaatgtctattgttaaaaaagaaatgtctgtatttgacatggtatattaatgtatatattagatgcctattaatgattctatgattgttttacattttaaaacaatgattaggcatgtctaaatattatacactcagattttgaccttcagatacaagtttttgaagattaccatttgttgaatgacctactatatttcctttaaaggctcataatataggctacagcatttctgctaatcttgttctaaactcttcttagtatgaaaaatacaaagtgaccgcttgtaatagttactccctttctattttgggctcctgaaatggccttttcatttggtaataagctatttgtgttcacttcattttgcttcagtcgttttatttttgtcatctttggtgctatcttagtgtgctatgatggaacatgctgaatcagaaaacctgtaatttttattgcaaacatgtctcaaggcaaatttataagttgcagttgatatcagaaactactagagggaacatgcctttgttctaaattacaaaatgctctgctattctaaacttgaagtatgttgaatataaactgccttttttgtaacaccaggagcttcacatgggcaatatattaagatattcctctaaaaatgcattgtgtacaaaacaacttctccagctaaactgtattaaaactctatattttcaggctgtaaagctaatatttaaggtgaagctatgtcacagaaacctgatcatattaaagatcttaacatttgatttcagttttcttttcatagaaggataagaaggagcactaatttatttagcagcatttagccagggtgactatttgggcaacccatttatatatttaaatgaaggcactgaaaaaaaaactgcactaaactgtgatctcacctccattagattaaaaccttctgatcattatagttgagtttgattgttagtactgccagacagccaagggcccaatcttgtactggtagggtgtctggtgacctgcaatatgggctttctccaactatagacctgcaggttctagatgatgctgtgtacaaccatctggtcttcacctttgtatttatagaaactgaacaaacgagtattgttgttataacctgtgtagatatattccattccttcttcctgtgttaccacttttgggtatcctccactaaacagggggatatatgtttaaaatgttcatgtttataatacagttttactgatactactgaaaacagcagtaaattgctctcttgaaacaaaatttttgttgttataatatatcaagataattatggtatgacctacaagtaaatgtccactcactttgttattcagttgcatcctagctacatactcattttactcttgcttttgccctcaattattcatttacattatagctttagtttaccttttacaaatggtagaatccgttcaatattttagaatattccagaaaattccagaatcgcactttctcttcagataggatgatttaaatgcattattttatgcaacagatgtgtagagcaaaaaggaattatcatggtagtttccatggagtaaataatatacatcaaaaacacaaaactcaataaaatgcagataaaagtttgctgaaagttactattagaaattggcacaaatactcttctgacaaacatggcccataatgtattgtttccaacacaattttgtacatgatggagattggtgaactgcaagagtattcccagtgcctttgcccaatgctactgttggttgcaaagatcctcaggaaatcattagcaaactccatctagaaacagaccaaaagatcagagatatacattacatgagattcatggcttatggttgtagagttctgtgcgcattcgttcttgtttgaagtacagtatagtgtttcaaagcatctgctcccattcccaaaagttagtgagttgtaactgtgccagtatctgattttaacagtatgtcaaaggcacagtatttgttcttaaatgtcagtcattagagttgggcacctacacaaattcaatgagttccagtggaatgataactggttctttaagctgcaaaatatagagagactcagaaactcaaatggagggaaatcgaccaccaatttagagatagataacctgggacaaatagatactatctgtaacataaaagattgacttaaaaatcttgaagcattattctgaatatgttttcagctttccagaaacatgaaatgtattctcatccaaatagaaatcgctccccccacctccacagtacacacacacacacacacacacacacacacacacacacaatgctaaagcaaatatagcaaacgaaatatagaaataacaaccagtgtcttgcgttggaaatactatggtctttgaggctggacagacccacatttgaattctagctctcgcactcactgactatgacacactgatcaagtcacttattctctcaacctcagtctcttcctctataaaatgggtcaaataattattgatgtgaggcatttctgtgaggataatgtatatcaattgtctgacgtgtgtattcaataaataatgactatcataactactaatttttaagactacatttgacctcaaagcatgttgtttatgtaaattctataattttatacaaataagccttgctacgtaaaggaatgtagaactaatgctgataacatattgaaagttttttaaattactaaattagcatgtgattatctagcagtctaatttaacttgtctttgatggaattgctagctttttctcccatgaagcttcacaaagaaagcattgcattaccactagacgttttcacttttccttcaataataattttgtgttctcataatttgtataaatgccatataccctaacagaagtttttcttacacattatatcctaatatcagaaaacaataaaataagaaaagcaatttgatatatgtttccacacatattgcctttttttttcttttaactttattcccacttgaaaatactcagtaatgtgtctcttgtgtctctcttctctcccaataatcaaggtctctccaggacctttccaagcaaacagaaatcccttatggcacagtcctagactctgcggtatatgagcatgtccgcatgaaaggactgaatccttttgagagggacagcatgtattcccaaatgtggcggatgatcaaccgaagcaatggatcggagaacaatgttctggagtcccaggcaggcattcaaaaggtactgtccatggttctcctttaatagtccttaccattttgtgtcccatgctggaattgcgcagttgagatttgttttttttgttttgttttttgttttttatctttaatgctgacggcaaatttcctgttacaatgcatcttatattgatttaaagaagattttttagggaattcaaagtcctctgtagtgtgtctaacagatcagtttccatttgaattccaaaatcaaatacacacactggtattttgttcagaaaagggttaaggacttaacaaacatgaagtttaaaaaagtttttataaatcccattccaaatatcattcaagttatctgattcttttaaatgactcagggtattttctacactacacttgtttttggattaaaccgtcatctttagttgtgattatgtgaagctatctggaagtaaaagttaatcttgtcaacaaataaggttcctatggatgtctgtttctattccaaatgtgaaaatctttatttacatcttactttttctataactatctatattaaaaaggcatagaaagactgtttttcttttatgtgaaaatcttaaggctatttttactctgagctgtagcttataaacatatatacggaagcaattcaaaccctatcaacctctatgagagatctgactgttttttcttaaaattatctctagtgactagcctagtgaaaatcattgttgacatttaataaataattatggaatgcaggaatgaacgtcagtaatagcagcaatagtggtatacactttttctctctgaccttccactgcagaataatttggactccaagtctgtgtttcctgttctaaaggcaaactcactaatgtcatcctagaggatattttgatgactataaaaattattctgtgacaggttccagcattattctctgctttttcatctggcaccctttatctgccactgctactactatggtccctagagtcagcctagtaattcttgcagtcaacatattgatatcattcttctgagagctggtgatgctaacataaacctttcttcaagtattaatgatgtctttaaggaagtgaatgtcctggagatgttagcaatggcctctatcctctttgcccttattataccccattttctggggctcagttattgattctaaaatatttcttggctttctccaaagaaccattggctcctggagtttcaacatggttctcccagttaatggggttcgggttgagagatggatccaagtgggtgaatgaacatgtatttttggggaagggaggaggagggtggacattttaaggcttactgggtactcatagcatgttaatgaatttgtgttcagaataagtatacactatggctttgaggatgagttattttcctttatatcatctgttaaaaatgaatttgttttttgatgattaatataaatagaaatttatagttcatatttctattccattttaggagccaaagctccccctgccttataacctcattctatacagtattattgcagagaaatttcattttattttctcccaccagcctggtgttaatgggcacatcaatccgggtttgaatccagctcatttttttaaataaaatgtataaacataactagctactcaaaatctctgggccttgagagttgcatcatgaagataagaattctacctcacacagtttttgtcaagattaaataagataatatatataaagcatcaataagtagtatgagtagagccataaacctttctcataagatggccctgaagattacctgagacaatttatatgtgagggatttgtaatttaaagctttattgtttaatatttcctaatcttaatgtaaagttgtgacataataaaaagaagaaacaataaaagaggtagataataatttctattctttgttagtctgttgataaggagggctaatgagttcgaaactgcaaatcaagtcctcaaatatttattataccatgttgattcagttttctgatttactagagggctagtgaaaatgctcttctgaatgaatttataatagaaaatatctaagtgaaatttgtttgtactatatatttctttcaacccaaattagaaacagctgacaattgattagacagagagcagctaataataatacgatgtattttggttcaagcttacaaggtcttggccagcttctattaaaaaaacaaccaacaaacaaataataaccttttcacctgataaagttcattggagtttcatgaaattgagaactatgacacatggaatgtggttgtggattcttattcaagaaactagtcttgaacatttcacacagcagctttttattctctgtcattgatttctaatttatacaggcagataagacatcagaggtcttttaggtcaacatttcacaaaaggccacacttcttctataatatcttgggcaagaatccatatatatatatatgtatgtgtgtgtgtatgtatatactatatatgtatgtatatacatacatgtatatgtatgtatatacatacatgtacatgtatgtatatacatacatgtatatgtatgtatatacatacatgtacatgtatgtatatatacgcatatactatatatgtatatagtatatacatatatatatacacacactatatatggatatatatatagtaactgccttccaggaaggcctgcatcactgagaaaaacagtcctcacaatctataactttaaatagattccattaatgtctcagtctgtatttgttcttaattgtgctactagtctcattaagtttctcttactcgaaggtagataccgatctcatctaccatcttgtttcggcttgtaccaaagaaatctgtgtaaatgagcattaagtcgatgagttctgatttgctaaacttggtagcaaactaccctaagtaaactagacaaatttttttttctgccttgctttaaccaagatcttttgcataagtagaaaaaatatgatttttaaaatgcagctgaattttttatgcattcattcaacaattatttattgagcaccttctatttgtcaagcagtacattagtcactgggatggacagaaatgaaaacaaatgccttcatggagtttgcattatagtgggtataaacaataaacaaaataaacaagctctgtggtatgttcagtagtgagaattgttaaggagaaaaaataaagtaggagaagaggatgggaaataccgagaagcaaggtaatctgctttattaaatcaggtagccagggaaggcttcactaagaaaataacatttgaatacaaactttaagcaggttggagaggggagagtatgtgtacgtctgagtaaagtgtttttagaaagagggtcagccagtacaaaggccctgaggtagaagcatgcctagatgttccaagaatatgaagggggccagtatggattcagaaataagggataatatcagaagtgcaacaaggtcaagaggtaaaagatctggaggtagagagcagatgaatcatgtagggtctagcaatgcaaagtatggtcctgtggactagcagtgtctgcatcacgtgagagcttcctaaaaatatagactcttatgcccctatcccagcctttctaaacgtgaatctcattttaacaatatccataggtggttcatatgcatattaaagtttgagttgtgctaacacaggctgtctagaacatcctaagttggctttttctctggtgggatatcaaacctcaggagagttttgaactgaagagcaacatgataacatattttggcaaatcatatgactattgtgctgaaacaaacggaagatggcaacatggaagctggaagccagttaggaggccatgatggtgactcagcaacattctgaaattacaccatgggaagttcatttctcttaaaacgcaaatacatcttaaaagactatgactttgagtagttactggcattagcaccttagtggaatttagtctattagattattttagatgggcctaggacataaacagatacagcttctgagagcagttgtagaaacttccaggtggcaggtaaggatctgaccagaaatcaaggatcatgtgcagcactaaaatagggaagtccctgattattatgagggccatattcacttcccattaatctattataactcttggggaaaaacaaatcattctagaatctcagcatagaagaccactagagaagtaaataaaaccaggattggtaggatttgtaagtgaataatacttcagactatgaagttccaaggggatgtacactcaaatggataccatagtaacagggaagtcggtggtggtgccagcaccagcagtattcattcataaagatagcattaatgtataggctgtctgtccacagaagtccaagagcaatatggggaaaggggtgctattactggggggaactcacaagctccaaactgggcatcagggctgcaaccaagccactggacttcagggcctagctctaatcctagctggaaaactgaagtattaaaatggaagccaaggcaaaagattagtcataacaatatgggccagtgtcatgggttttagaagactgaggaaggaagacaaatcccagaccctaagaactagtgagtaagcttaccccagttttattcagctctggctgaaaaattcagtggacttgaacctgctattttacatactcattcaacacatattcagtgaatacctattgtttccaagtctctgttctaggcattagaaggtgtaatagaacaggtaaagttcctgcctaaatggagattatattgtagtgaagagaagataacagacaagcataaatgtgtgctctaaagaaaaactggaagggtaagaatggaaaaaaaaaagcagatcatgaagaggatgttgccatcccacattgggaggttgggaaatacttctctgagaaactgatgtttgaatggagacctgaaagaggacagggggtgaaccatgcatatagtttggagagaggggacaggaagtgctccaggcagagggaatgctcattacaaaattcctgaggcagaagctagcttggcatactggagagaaatgtcaagaagatcagtgaggttggagcaggttgcacagagagggggttaggggatggagaggcagatggatatgatcagagtgggaggtgggcaggatggaggccattgaaaaggctgatgcttgggccccactaaagtccaaattgtatcttaattggtaaatggaaggcagctaaatttctcacattcctccaagtgattctgattcacaataagggttgacaatcactgatataatattctatgagtgattttaatgaccttagttactctgagatgagaaaccagtgcagagttttgagcagaagagtgacgcaacataactttttaaaggtccgctctagatgctgtgtggagaccagggggctcaagggtgggagcggggagcttagtgaggaggccactgtaataatccaagtgtgacatgaggcgggggtggaccagagtgattatggtgaaagtgatgagaagggattaaatttaaacatattttgaaggtagcactgacaagattttctaaaagagtaaatgtggggtgaaaaagaggagttagggatgacttcaatatctttggcttacgtaggtggagggatggagttgccatttattgagattgagaaaaccatgacaagagtaggtttgataagtcaaatgagaatttgtctctggcatggtagttaatatgaaatgcttactcattacgcaggcaaagtttatatttaaggccacaaggctggatgtggtcactgaggatatgagtatatctggaaaagaaaaacatataaacacaatttaatatttagaggaggcagagacagagagggcataacaaagcatcaggaaactatcagctagtgaggtaagatggaaaacaagagagagtaagtggtggtttaaaaaccaaaagaaaagaagaatttcaagaagttcagaggatcaactgtctgtcaaatgatgctcatgataaagggtgatgaatgctaaaaattaattttagttttggaaaccagcagtcactggtgacctgacaacaacaggcctggtagagtagaagaagagattagggaaagattagagaaaagaaaagaagtaaaagagaggatgtggagattatgagactagaaagaagagattatgagaaccaggtactggaaaaaaaatgcctgtacaaataatcgaatcaccaagaataaacacagaactaatatttgagagagtgacagagagccaagtgataaaatcttcaagccacgttggaggagtgacactggtaactgtagtaaaactacaaggagatactatagctctttttaaaggagtaactcctttttaaagaaattttgctgaaagaaaatgctgagtaatgagaggagtttctggagtaggatgtcaggtttggggaaattttttacgaaagaagacatatacagtatctgtatattgatgggagtatgcaataaagagaaggaaacccataatacaggaaaaagactgcagtattgctggagaactttctttgattaggagataagttatggcatcttagtgcacaggtagacggtttggacttagaagcacagtccatccatagtaagaggagagaaggacataagttagaagatgtggtggtgggagcataaggaagttcatccttgactgcttgtattatatttaaaccaaagtcatcaccaaagtgtaagcagcagggcagagattctggagatttgaagaaagagaaaataggaatggctgtcctggagaatcaaagagatagtaaactactaaaatataataaactttctagacaagactgaaggggtttgtaatcggtggtcatgactataaattgggaccagtcagcatgattgtgagtatttgtctagccatcatcttcagctgactgagcataagtgcaaagtccacaaagagtatatttcaccagaattagtgtttccagaaaagtatgatagaagataataggagcaagaaaggaaattaagagcacatgcaaaaaaaacataattattgttatgaatcatggaatctgtgctatataaaaggaaagtgatgatacaagggaattgaggatatgaaaagggtggcaggaacaatgcattgcgggcctagatgggactggaattcttggaatcagcaaacaagaaggataaaattggaagtaacatgaagcttgttctgagatgacacgtttgaagttgaaatgatgaagagaatacagttattgaaattgatgacaagggatttggtagctcaggtagtagaaaagacaaaatctttggagaagaggaagacttgagactgaaaaagaaagtactggaaagagatgcttatgtgaataatcaaatcgccaagaagaaacgcagaactcctatttgagagagtgacagaaagccaagtgataaaaatattcaaataatgttggaggagtgttgcagggtcagttagtgaccactcagtaacactgagtggcaggtagtaaagtctgataacataagcttcaaagctggagaattttcgggacaagggtctagaaatggtttgaggggcaaagaggataccaacactggatcctgtcccagtggtatgagtgttgtagcagagaaaaataatcaccacaagaccacaggcaatgcagtatccccagaagataagtacattctacttagcaaaataaagtaaaaggaaatttcaaaaaacaaatggaggttataggtaaggtgattatttttcctagtttgcttgggacagtctcgattttgccacttgtcccagtgttattaactgtattcccactcactctcaagagtattaccattatgacaacaaattatgtgacctccctagatacacacatcctgctgataataaagtttcatagagcagagtagaagaacctggagagttgtagaggaataggaaaactggtcaaaatcaagggatgcgcagatccatatcagtgagatttaaacagtaatctggaaatttcagactttccatgagggcagcatttaggaatccaggaccaacacagactctaggcaaattatgttgataagatgagtgtaggttggcaggaggggtgagcatattgccaggtgcttactgaggtgtggggcccctcttcatccctgacagtggcagtggaagcttggctaacagcaatctcaccagcagctgaaagtcttgagggcattgcttcccacagctgagtgaggctgggaaagatagcagctgatgcatgctagacttaaggatgaagcagctctgcaccatgttgcacaaaggaaaaaaggctgtgagtagaaaacagatttcagctgttacacagcttcatctatacttcgtcctgaccttgcatgtcggccatatcctcttttctgcttgttccattccccttcctcctagagctataagcatcatttgtcattgagtaaaaatgccaaagtagatgacaattaatgagccatcagcagaaggagggtgagggctaattggagctttagtgagcaacttgctaatatattaactaggtatatgacctcaaaatctgggttaggcccttattacagaaataaacaaactgaaaatggcttggggtaaaacaagacaacaaactcaacagctttggttctacgaaaacgccaagcctgggctgtcataccactggacttggagggagcagtgtatttgctgcatttgcccttttgccaaatgattccaacaaatacatgattcacttcagtactacaccctgcagctgagagctccgataccactggcatattttctgctctctagaaatcagagtttttaggtctgtgtcagtcatcacacaaagaaagaagagaactgcacagtgggagaataaaaaagatgtagagatcatttccagcagccgtgctaatgcatttttaatagtagagttggatttttttaaattattattaagacttatttttgtttttaacaatcctcatggatatttgaaatcaaaatcagactcgattagatgttttctcaaaaagaaaaggagaaacctagaatcattgtgacacatgtaaagttgcttatgaagacttcttaggtcatcaccaggaattttacataagttacaatgtgtcaagttttatagcagacaaatcatactacaaatactacaaacaaacatgtttttctagatgccaagaaaaaatatatgtatgtatgtgtatatatatatatatatatatatatatatgtatgtatgtatatatatatatatatatatatatatgtatacaaattctgtgaattatactggatgctgatgcaacagtgaagtactgtcttatgtacataaagatgatactaccaacctgctgttgacagagtatgttcttttaaaattgcttttttccacagtgatttaattcatgatgaaagccagatctgctccaattcttcttttaattagctacattcaattctaattcatctattcattcactcattcctttaatcaacaaacatttattcagtggctgctaagtaaaatgcagaacagcaggtaccccacagagatttgtacaagacattgtgagaacacagggaaagggaacctagcatagcctgaaggatgaggctacttcagatcagtgaagacttcctaaaggaagtgatattaaacttagaatgagtagtatttaattaggtaacagaaataacaaaaaaatgggatagggaggagagggcctgagcaaaggcatgaaggtgagcagagcatagtatgtgcaagaaacaaaaagcaattccagttagaagagaaggtgctgcaataaagtggtgggggaggaaggtgcttgtggaacaaagacacctactgggccatgtatcactggaacttgctaattggacattaatataataattcaaactagatgagcaataagatgtaaaaagaatagcaggagtatttgaaatcagtttctcgattgtgaagaatagagagccactttggacttagttttcttccatattttaaaattgtggaaacagaatttattaattctaagattttttctggaatgaatattcagtgagtctttggacactaatttcaaactgtttaatagcttatgagagaaaatgcttcctaggaaacttcagaggactgtagtgggagtccctaacacagagaccctaacatcaagcctatgttgttagtcctgacttaaaacacagcctcatacccaagtgaaaaaattctccaaaggattttccagctttctagttccccaggatgaaaaaagaatagattgatgcatctttgtttcctgctggttgcattatattctcaaacttcttattccaataaatatccaaggtattgccttggtttagttcttactctcaaagttacttcccaaattggaaaatgcatatatattttttaaaaattttctgttgggtaaataccaaaaattaaaaattataatcctactgataccatttggctctgtgttcccatccaaatctcatttcaaattgtaatccccatgtgtcagggtagggaccagataggaggtgactggatcatgggcgtagtttctcccgtgctgttctcacaatagtgagtgagttcttgccgagctagtggttttaaagtgatatttcctcgatttcacactcattctattctgctgccttgtgaagaaggtgcctgcttccccttcaccttccaccatgattgtaagtttcctgaggcctcctcagccatgcagaactgtgagtcagttaaacctcttttctttatcaattacccagtctcaggcatttctttatagctgtgagaaaatgaactattacacctaccataatttaaaaattattttagtctccaattttaccctcagagtttacctccattaatagcagagtatacatctttatgacttccttctttatttaaacaggccgggcgctgtggctcacgcctgtaatcccagcactttgggaggctgaggcggacagatcacctgaggtcaggagttcgagaccagcctgaccaatatggggaaaccccgtctctattaaaaatataaaattagccaggtgtggtggcgcatgcctgtaatcccagctactcgggaagctgaggcagaagaatcacttgaacctgggaggcggaggttgcagtgagctgagattgcgccattgcactccagcctgggcaacaagagtgaaactccatctcaaaaataaaaaataaatataaaaataaaataaacaggagacatctgcaaaaatcacacatacgcaaatagtcacacatatgaatacaatttttgtttaatttccattttgactttttaaaaaataaaatgttttcatgcccttgtctttttcaattcctttgtcaaaaacatctttcaggttagtgtgtatgtatattatacatatgtaagtttcattcgctttctgtggctcccagtccctggctgttcttttacatcctcaaaagggccctccctctcctctcattctgatttatgtgttcagtgttctacaattttctccttctcaactgctaaattcaattctctgactaaacataaatgccatgactattagcatatctttctgtttttatgtttctcagattaattgtcatcttaggcactaaagcttctgattataaattcctcctttcttgttaaatatccataactctattatttttcttattttaaatcaatatgtcttgcaaaatcctttagggctctgctatctggcgccagctttgcctaggagataataaaataaataaaatttgaatgtcttgatagtgtttgggggaaataaatatattacagtataaaaccatgcttatgttttacagaaaataactggcttcttccattattcctttatttctcctattatacctaacattaaatactggagtccaaaagtgcacaatacattttaaaaaactccataactaaagataaagcttctctttttatgtgataaaaattggcttgtaatataatctaagcacatcacattcatagctttcatatttaaagttcattttttcaatgcaaatttttattgaaattttaaattttatttattttttaaaattataaaatacatgtaacataaaattcaccatcttaaccattttaggtgtacagtttagtagcattaaatacatttacattattgtgcaaccatcgccaccatccatctccacagccctttttcttgcaaaactaaaactctgtacccactaaaaattccctcctcccattccctcttccccccaaggccttagcaatcaattatgtctctacgaatttgaacattctaggtatctcatataaatgtaatcacatagtagttgtccttttttgacgggctttcttcacttagcataatgtcctctaggttcatctacattgcagcatgtgtcagaatttccttcaattttaaggctaaataatattctgttgtgtatatgtgtatgtgtatatatgtgtatatatgtgtatatatgtgtgtgtatatatatcctgcattttatatatatgctatatatatatgtatatacatatacacacacacacatatatatcctgcattttgtttatctgttcattatcaacagacatgggttgcttctaccttttggctgttatgaataatggctctcaattatcttgggtatatatccagaagtggaactgctagacgaaatggcaattctagttttaattatttaaggaactgccatactgttttccataatggttgcaccattttaccttcacacaaataatgcacaagagttccattttttttttttttttacattctcaccaacatttattttgtttttttgatagtagccatcctaatgggtatgggatagaaatcatgtaaatctaaattctattttagtatgcatttttaagaggcactattttggctaataaacttcaataactatcttcttcacattatgctccaataaaaattggattgtgcttgcttatcatataaagctcagcattcctgagaggtaagactcaatctatcccacaaatatggctcatcccagtagtgattctcaaagacagaagagaccaataacctattaaccagcccccagcaaaagaagcaagtcagaatgggggaaggaagtatgtatagttcaacagaacaaaaactcatgttattcggacacatccaattgagaataatttgttttcctaaactctgggaatgtttatctctgccattgcgattcctagaactcatcacagttatggagctgaaagagactgcagggaccttctagattaatcattttgttttatggatgagaaaattatacctaaaaaggttaagtgatttacccaaggccacacagctgattagtgtcaatatttatatctgcagcccacatctcttaattctggtcacttgctctttccatcacagttaaaaaacttaagtctgtaatgtcctctcaaaactaattaaaattcacatcacaatttgagtggttctcaaactttatatgctattaagaattgcctagtgaggctgtccaaaatgcttattcttaaacctccaaacccagatatcaagattcacggagtctggggtgggacccaagaattaaattaatgagcaatacagatgattctgataaacattgttcacagattatcttctgagaatcactcttctgggtactatttaaaagccctggtcttaagccagtgatcttcaaggcatgggccctggtccagctgcatcagcaccacttggtaacctaagagaaatgtaaagtcttagagcccacggcagaactacctaatcagagactcttggggagagactagaacattgtagattaataagctcttcaagtgattccaatgcatctaacatttgagatccagtggcctaggctcaattttagtccaagcaagccactcactttattatgttgccttccaactagaggatttaggaacccagggcttcgggtgcatcaaagtaatccaaaatatttgatcaccctaactgatactgccaagagtgtgcgtgtgtgtgtgtgttgaatgtttcaacactaaggaacaaaaccttccctgtctttgctccttacatgcaattgattgaaaagtagaggttaagtgaggggcatatcaagtggcaaatgttgcttcccgccttgtgacatcgtttacattttaggaacaaaacaatacttatctgcttgctgcaaatcttcacctggatgtcctgtcagtgctcctgccagccatatgtctaacactcaactaattacctttctttgcaagttgacgcttatctttctgtgttctttatttctgttaaaagcatcactgccctccctatcatcaggctgaaaattgaggaatcattttcattgccttcatctttgttaccagagccaaataattgctttaactatcaatcctgcctctgacacatctctccaatttattctctcctttcactttctacttccaatttagtaattcatgtcattattaccatcctcctggactacagaaataactaactaattggccccctcctgcaaattcatcttccctcagcatagcactgaaagtgatccatctttgctcaaaagcctgtaagtgttccactttatctctagtgcaaattgtttatgctagcattcaaaagtctctataggttggtattattctgtttttcagtattcatttactcattcattacttaaataacgcctattctgtattgatttgggtatcttccctttcacatgccatacattactatcaaaccaagttgctggctttgtcttatactctgcaatgttcttacatatcaggtattgctcatttctttccctccatcaggaatgcactcctctgcctgccttctttttctgtctattcgttcttcattttcaaggtctacctcagttgtactatgatgtctttcctaaaatattttcttcctccattaaactttcttaacaatgtatccatctccacaaatggtttccttttaatactgtaattgtctttgcttgtctatccttctagatcatatactattttgggccagaacacatacctgattcatcagtgtatccctctatctctacagcattgagcttgattcttaatctttctttccaacttgagtgactaaaatatttaacagaaatcaatatcagattattcatgaatttagatcccaaaatgtctaagcctgattcctcatagtgttcctcttaaacagactagatatttatatattttccttatgttctgagtagtacaacttattcactatctttaaaggctcccagtaaaataatttataagaacagatttcagtacttttcaattcagtttaaatgctatcagtcttgtctggtatgtttatgtaactgagacttatcactttgattagggaaggatgccatgtagaattatgtttcaagtgtggcaaaatgatcagttgtatgtatttgttttgcattttttgtctagaaagctgggaaataaggcaggaaagacagagtaagacgaaggctaggctcaaacaaatttggcatttccctcaggtgcataaattaagggggcactaaacaaacagaataatcagatgggatcagcattgcttatcttcccttttgccccaggcaccaatatggctccacatggtactggcaaacctagtctttatttgaaattttgatattttataatggatttttgcatgaattttgttcttttcttaaaatattgcatagagtattatttatttgattactgagtttggtgcacccttcaattatgcacacaggacaggtgctttactcaccttatcctagaggaggccatgagaaggaagcagaaaacaaaatggggaagaaaaaaggaaggaaaaatagataagatgaaaggcatgaagggagacagacagtctttattaaatactcttaatctttaagtgtaaatattatattaagttgataatagataaacaaaaacaagtatgatgaaagattctgccaacattggtgtaagcaatgttgtttatttgtatacaatatgtatataccatagacagatgtacattactacaatatatatacatattacagattgcatattttatttctgcatattacaatacattatgttcattgtattaactcaggaaggttgattctgaattatttttatttttcatatttatgtttatttttccctattagaattagttacaattttaccacattttagaagaatttacctgttaatctctgacaatttccaaatcatacttaaatatttctttaagaatcaaagataatatttgacttaaacttttgttgtttgggctaaagaggaagataaaaaaggagtttgaatctgaaattccctactaactggttatgaggcctagtcattgttctgagaaatcaccaggtaaatttgcctaaacgttgcacataatttgtaatttaccccaacagagggataatgtgtgttaaaatatggaaaatgtaaaagaatgggatcaataaacttgggctaattcaatgaatacatgtattttaatctcctgagtgtctggggttttttaacatttaaaaattaagtgctctgtagtgtaaagatgtagtgtttgttttgaaagagcacaggagacttccaggaaagagtagctactcacaaattattgctttcgccttccatgacaaggccaacaatatgctttcatttactgattctcatctaataccttaagcttgagcaccccatctgctcagcagtatgtaaatgtgatggaaggtttctgcctcaaattatactgtcagaaatatattgcatttaatactttgtgtatttaactctgtgtataaaatattcagcctgcaggagagttgtgaattacagtcaagtgaaatgctgtgcttgaattgtgaagctcaagaagcttttatcagcttatcaactcaaaatatcaatattctcctgcaccatgttaacacaaatacatttatgcaattccagcaacagagatggtcttaccatttctccatttggcactttggatataataattatatgcaaatttggacaaatttcctttctgctttagggaatctaatttagtttgtcaatctagctgttttttagaaattgctccacatattatacacaataataaaagactcaaatctcattttctaaccctgcactcctaacaacatttcacagtattttgcatattatttgataatatactgtttgaatcaggaatcttatccagagtcatagaattgctttaagttttgtcttggtgtttgtctactaatgtgcacattttttcagttgcgtgtgctgggagagccaccaaatgatgtattggaccaaaaatatttacccatttgatattctctattagtcatccagcaatttcaaacttaatatatccaaaacccaacagttgtcccaccttttatttttttctttttcacttgatagcaaattcattcttcttagattgactcttgtctttctcttacacctcatgtctaattcatcagtaaatcttgtagggccctttctttctctcttccttccttccttccttccttccttccttccttccttccttccttccttccttccttccttccttccttctttcctttcttcctttctttcttgccctccctccctcccttccttacttctctctctctttctttctttctttctttcttttttgacaaagtctcactcagttacccatgcagtggcatgatctcagctcactgcaacctctgcctcctgagttaaagtgattctcccacctctgcctcctgaatagctgggactacaggagcatgccaccacacccagctttttttttttttttttttttttggtatttttagtagagatggggtttcaccaggttggccaggctggtcttgaactcctgacctcaagtgatccacccacctcggcctcccaaaatgctgggattccaggtgtcagcaaccatgcctggcccctgtaggttttttatttaaaaacatacaaattttcaccacctccaccattattaccctggtccaagccatcactgtctctttcctggattattgcaatagctttctaccaagtcttcctgattttactctactttgccatagtctgctttcaatattgcaatataagcgaacaggtcattcttctgctcaaaattgttcattggctccccactccattcaaggccaaaaactcttacaatagcttgcaaggctgaatatgatctatgttcacccacctcattatctttctggcttggcttatctggtttctttgctgtttcttggttgtaccaaccacactccccttttcactggctgttttctgttcttcctatctttccttcccctaggtagcttcgtgacctactttctcaccatatttgagtcttagttcaatgttaccttttccagaaactttccctgacttccctatttctaaatgcaatacccctgatacctcagcacttcctacacttctttcctgcttttattctgtttccatagcatatgtcacttactaatatataatttacttgcaattttatttttaattaccttatagattttttattatatgtatttaaggtttacaacatggtgttttgatatacatatactcagtgaaatggttgctacagtcaagaaattaacatgtctaccaccttgtatagccatctttttttatagtaagaacacctaaaatctattctcttagcaaattttcagtataccattttcttaattaactgttctagtataccctgcactagaatgtaaactttatgagggcaagaatttttgcctttttcactcactgatagatcccaagcaccttataggtgcctaaaagatagaagattctcaataactaattgttgaaaaataaatttggcccccaaaataacccccaaaaaattaaacaaaagtgaattgataaaaagcaaatgcctctatgatttccttttctacagtaagaaattatttggacaaaatagtcaaagtatattaaattaacaattcttaagttttagagtttgatgatttgatgtatgtatacattgggaaatgattaccacaaccaagctaactaacacacccatcacctcacatggttactttttttttttttttggtaagaacacttaagatctactcgctgagcaaatttctagtatacagtatgttgttattaatcatagtcaccatgctgtacatcacatttccagaacttattcatcttttaaatgaaagtaaaatatgttgatcctttgaccaacatcttcccattcctcacctccaccccaggctctggtaacgaccattctactctctgcttctatgagtttaattttttttagattccacatgtaaatgagatcatgcagtatgtctttttatgtctggctgctttcctctaggtctatccatgttgtcacaaatggtgggattttcttctttttagtagttaaatacattccattttatacacacacatacacatacacacacacacacacacacacacacacacacacacacaccacattttctttatctattcatacactgacagacattttggttgtttccgtatcttggcttttataaagaatgccaccatgaacataagaacacagatgtatctttgagatgctgatttcatttcttttggatatatatccagaaatgggattgctaactcatatggtagtttcatttttaatttttcatggaagctccgtactttttcccataatggctgtaaaaattgacattcccaccaacagggtaacaagggttcttttttctccacatactcaccaacacttactatcttttgtctatttaataataccaattctcacagctatgcagtaataactcattgtggttttgatttgcatttccctattgattaatgatgttggcattttttcttatacctgttggccatttgtataccctcttttgagaaaatctattcagtccctttgcccattttttatttgggttaattgttttcttttaatttagttgtttgagttccttatatattttggatattaacccttcatcagatgtatggtttgcaaatattttctaccatttcctaagctgtagcttcactctgttgattgtttcctttgacgtgcagagctttctattttgatgtaatcccatttgtttacttttgcgtttgttgcctatacttttggtgtaatagccaaaaatatcttaacataaatttatgccaagataaatttaactaagagagtaacatatctatacaaagaatactgtaaaacattgatgataaaatgaagaagacacaaataaatgaaaagttaacccatattggtggattggaagaataaatattgtttaaatgcccgtagtacccagagggatctatagattcaatgaaatccttatcatgattccaatgactattttacgtaaatagaaagaacaatcctaaaatgcaaatgaaactacgaaagactacaaatagccaaagcaattttaacaaagaagcacaaagctggaggcatcacacatcctgattggaaactgtattgcaaagctgtggtaatcaacatagtatgatactggcataaaaacagacacataggctaaaggaacagaatagggaccccagaaataaaccaatgcatatacagtcaactaatttttgacacggaaatcaagaatacacaatggagaagggaaagtctctttaatagtgttaggagaactggatatccacacgcaagagaatgaaactgaatccttatataaattaattcacaataaagactttattgtaagatgtgaaactctaaacctcctgaaagaaaatatagtggaggaagagccatgccattggtcttgacaatgacttgatatttttgacttcttttttttttttttttaacacttgttgatttagagattcaattgtcagcttttaaattcaatctactttgacttgtgtttttaatgctggtcatggctgaaaaagagaccacacaatgattaataaatcaaataaataagggacatatttgtgcttataaatgatttaaattttccaacataattcagtcatgcaaagttttttgataaaattttgacagaaatgtgttctgtcctttaaaggatagaagttttaaattttgatgtattccatatatcttttcttcctttgtcattggtgacatacctcgcattgttaatttttgatgtctctgcatttttttaattagacttctttgcaatctcccctttataaataacactcaatatctaaaaaaatccttgaaatcttataagcttctacttttttggttgtatctctggccatgagattatgtataattattttctgacttgaaaaagtttgcttttctgaaagctaaagtgtttatataactcatcctaacataactttccttagttagttaaacttactaatggcaacatttcattctctaaggctattttcattttcaccccatcaagtagtctctcgatttattattttatgccttcttttagtgtttacatagctcctattttctgccttgaattaagcaggtttttgagagatatattaagatgagaagtaagacacagagattttgcctacaaggaattttgccttctaataaataagacaaatcaattttataaaaacaaatggctataaaacatggtaaaaagtgataattaccatcaaagaaaggcacaaattaagttctatgtgaattgacagaggaaaagataattcttttcttattttactattttcagaattaaatctaaagtagcagtttttctcattatccctttggttcctgtgagataaaattggctagaaggcaaatgacaacttcattcacaaattacatttgattgaaaggaaattgcagaaagatatttggagagttgatgctttctgtcaacattacaacttgtttctccattagccttgtggtcctcattagagatgtttgatccttaacctctattgactaagcaaaatgcagaacaaccccataaaattattttttaattctaaatatttccccctttgttacacccctttacttcatatcagaatatgttcattttttccttttgttatataggttctttttatctcgtttttacctccataatgcagttactaaacaaattttcacaaatcaataatttctaggtaaggctacataaggttttctatcctgaaatatttctgcaacgtgaaactatacaaataaatattttgttacataaaaaatttcaggaattacctgtattctctttttaaaatttttattcgtttattaaaaattgtatactcaaatcctttctctgaacactgttctttaataaaaagtaccaggaatccttagagaaatggctgatgttaagactggtgcaggaaaaatagaaggtgaatctggaaaattttttcattccagaaaataagaaagtgctcaaataacaaaaggagcaagtagggaatgctgagggacaaaggggccaagtggaaacactttctcatggccagaacagaaataacacaagaaagatgaagaattgaatattggattacaacccaaactctaaatatacaagttcatagtgatatgaaaaaaattattgaataaaaaaagtgggagaagaaacaaatatttcttacagagaattttaaataatacgtgtagatactgcgttcctacaggagctttatactcctccattcacgctttaatgtggactggacttagtgattggtttccaaagaaaagagtacggaacaggaaaaaatagagatatctgacaaacactaccttgatcaagatatcagtgatatatagatatcttgatctatagatgggagaggcattccactaccatggtattctttcaaaaaaattcataacccaagtctaatcatgagaaaagaaatcagataaaccaaaattaagggacatactccaaaatactacaccagtactcctcaacactgtcaaggttatgaaaaacaagtcaagatagagaaactgtcacagtccagaggaaactaacaagacataacaactaaatgtaatgtttgatagggttgggaacagaaaaaaaaaagacattaacagcaaaactgttgaaatcctaataaaatctgaggtccagttaatagtaatgtcccattgatggtttctcagtttttacaaatgtaccatagtaatgtaagatattaatattaggggaaaatgggttaaggagtataagagaactctgtgttacctttgtaatacttgtgaatctaaagttattccagaataaatagtttacttaaaagctatagaaacatatctagatttttctattttaggcatgaactgttatttctgactgtggaagacaagaatttagtttctgtccttctcttgcttctaccatacatgtacaaccttcccatctaccaaatccccattataattgtactcatatcaatatattgtatatttctattcacagctgacccatttaacaaactgtaattacttttccttgttgcctatcctcttgttaaactggatttagcaattatctcattttgttcatttgtttaatgtatatgtccttagcacttattcaacctcaagcttttctccattgtctaagtctcctttcataatgttcaaatgtgcccagtattctattcatttctatcgatatggtaaaagatgtcttcacaaactgttccttcaccaatattctgttttcccttagcatgtgttaggtctcttgtttcatgtatttcatgctttttttccttggtttactctttgattttggtaacacagtatctcataaccttcttaggaaaaatgagttggagataaaattgtgagacttgcatgcctgaacacatcactatcctgcttgcattttatttgcagtattggttgggagaatcctttcttccttcagaagtttgaatgcattgttccatggtatctaatatttcagttgagatgtcagaaatatgtctgatgggttttttttgtttgtttgtttgtgtgctctggaagtttgtggtatctcttcttggttccttgtgttctgaaattttactgatatgtccatttctatcatttgtgctgggcacctgagaggcccatttaatctataaactcatgttcttcagttctgaaagttttaaaaaattattttactgatggatactttacttcaattatctatttttagtttctttctggagttcctagtatttatatttaaagccttctgattgattctttcttatttatgtaattattcaatatttgtgtgattttttccttggaaattttctattcttatctttcaaaactcctgtttttcatgtctactagcattttttaacttcaacagcactttattgtcctttgaatgttgtattttctttagaattcaatatttccttattgcgatgttttttaactctaaatatatatataaggatagtgcttttgttgttgtcttggttgtatggattggcctttaacattttcttctccatgcatcgtctgttgctttcaagttgctttttcttttctaattgttttagtcactattgcaatagagacttttgatatctggtaaagtttgaatggaggcccatattttaaaattaagaaccaagaagttaattggcagctctgaaaaacaactaggcataaaaagagagagaaaagcataccccaagtaaaaagaaaagcaggttgtgaaagacctaaggcagggttgagcttgtttcattggcaaaatagggttacaaatgggacagaagagctggactatggtgaggaagggtagaaatgtaagagatcttaattttgcattccagagagaaagttttaggctgaggcttagaccaaaagctcagggcaaaggccaaagagtttcatgatttacacctggaaaatggaaagcacacaatctgtccaggcaggagtccagctacagctgtcttctgcaaactccaagaaaataacaagagctcctttttatgaatgctgtatttataagtcacatgtagctttgtcttccactgaactgtagaaattttggttcattaaatatcaacttcctcattttactggtgaagaaagtgaggccctttcttaaacatattaacatttttatcactaaaaattctctattggaatttacaattatattgagagactataaatatgctactcctagcatcatttaaagttcccaaaacccaaatgaaaaagaatatgacagcccgacagaatttgtttacctaactcgaggaaatgtcgttgagagacactatggagaaaacagcctaactcagtgaaattgaagtatattagattttaaaaggcagaaggaagacaatgaaatctaagagacattttcccaaaaggcacttagtacatgcggacagtaaatcccacagtgtcagtgtgctttttgttcaaagtgcgcagaaattttcttgagagctgtagaattataaaagttaacaacatgactataatgtttcccagcaaaacaccctacaagacagctctttaattgtaaggattcaacacttttagggtacaagtgtattctactcttgtcatggagagagtgagagttaagtgattcttggggtattcttctcttcaaatgcaagctgtgggtcccatttgtcaggaaaagaaaaataaatacaaccccggtgtgagaataagaattctctctctatcttggttccacttaattgtaaaaatcttgccaaaaaatatctgatatatatttcaaacattttgtagtcatttacagactctcatgccatttatacatggtcttgcaggggcagccttgtgagctgtgtctcatttttctaaaaccactagaaggaaaactttatgcagtacggtttgggagttgctctatacaatgtgacacttgatctgaaataccaaatggcagacttttacacagtaacttgaaaaaattatcctaattttgcgtttcatgatatcactaatgcataatcagcaagtaatgattaattactcaatatcgcccttaacttgggaaccctcatcattctggcctctctttgcaaagatgtatggacaataagttatggaagacttgaaaggaccatttcatgtgaatttcctgggaatattatattttcctaaattgaactattttactttagcttgccatttaggctgaaatgattccttactttgcccaacttgggtcactacccctcacatagccctctttaatgttcttcagttcacataccactacctaaagttaacttgattttattttaacttcagattgtctgtttcctctcactagactggggcaaagtgtgggcagtagacaatcttcaaagaccttgtctgtctcctctgttgtattcattgctgtgtttctacccacctaaaataatgcgtagtggcactgaattaatgtttattgagtaaaatattttactatcctgtacccagcctttgatgacttgccagaactgagccccagaaaaaagtaccttttctccttggtttcaataatttttcttttggattctactgaaagagaaaatgtggaaagaattactgaagctagccataactccaacaaatagccaacaattctgatcgccagtattaaaccacaaatttgtaacataaccacatcatagaataagaaagtacagtttcattgtttctgccttttttcactggaagtaaaaagagcagaaaagagcagaggatgggtgggatcataaagtcaataagatacgggaagccatgatttcttttagcttcactttcccccaaggaagatgctgaaaaagtgtgaggagggctggaaacatcacctacctgagaagaggtgggtctggtcgcaatgctcagaaggcaggaggagaccagggcacccagcctctgccttcttattcataacttagggatgcagaaagaccttatcttattcccctactgtcctgtcccgaccattttccttcttctggtaaaatttaaattcctctctgcccagcatcttctcctttcctagaagcagtgatcttaaccatctttcttcctgaagccatgcttgcgtagatcctggtcatatatgagcttacaggtcatgaaagccatcactgaggttacaagccaacaattttaaggggttacacactcatttctacctcaagccttgatattgggcatttgccaaaatgcgagtggtctcctaataacaggtcactgattcgcactgcatcccttccccaagttctcttctggaaactgaacagaagaaatatgatttaaataaaatgaaaaacaccctacttttgctaccaatatttcctaaagttcaaattgaatttggatgctctatgtctgtgattgtaagcttttcaactctcagacagtttgaaggcaaagtaatctgtagctttggtataaggggaaagaaaggagagaaaaaaaatatgaagtacttgactgtcaaacttaataaatacattttaaaagctgatttttaaaaaataaatttttctgagttgccaacagagtaaacattagtaaactttggaggtatgtctcaattatttctctctgattgctgtgcattaacacattatacacaaagccctgaggaaacaagaagaaaatgttatgttaggtattgttataaactggattgtcagcatgaatgagtgaaaataaaattgctggaaatatttgtttattcagttaagccagttggcaataaaatagaatgtattaatgtctcagtagacaataacttcaatgtgtgagaatatcaaacggcctgggagtaagggcaagggagtgagagcaagagaatgaaaacaagagcaagagtgagagtgagtgagagatagagagagagagagagagagagagagagagagagagaagcagcactcactggatcacagggcacccagaaacttatggcagcacagcatcctaaagtcacagtaactgcactggcatggcctttgggcgaccttgaaaaagaaagcttcttattaccaagagaacaagttgtgcagatgctgttataagaacaaaccacaaaaatgcaaccaatgtaagaactataaacttgctttttatattattcggcaattattatcaatgcttttatctattgactcctgaatatttggctctggattaatttttgcacactctctatattacatcaaatactactgtgatgttttcatgctagacacatttcagaggaaagtgcaggaaattggatatagattgccttagttctgagaccagctctcccagagatttgctttgtaaccactggtaacagaatatttttgttttcctcattagtaaaataaaactaatgacacttgttctcaaatgtgtggaatagataatatggaactcctttgagatctctgggaaataatttgtaaaaatttaaatgggttagcatttaaaataagcaagtataaaaacaaatatgagaattattctgtatttatgatatgtcctgatccaccacaaattatacatcatgataattatagtgataataataattaccaattattgaacagatatgctctgccagccctattttatatattctaaaatttagccataaatactaccttcattttagaaattaagaaagacaccaggtacggtggctgacacctgtaatcccagtactttgagaggccaaggcaggtggatcacctgaggtcgggagttcgagaccagcctgaccaacatggagaaaccccgtctctactaaaaatacaaaattagctgggcatggtggcacatacctgtaatcccagtcactcgggaggctgaggcaagataattgcttgaactcgggaggcggagactgcagtgagtcgagatcacaccattgcacttcagcctgggcaacaagagcaaaactccctctggaaaaaaaaaaaaagaaaaaaagaaaaaaaaagaaataaatagattaagaaagacttaggctcagagatgttaagtaagtggcatacctggtatttaaactcgtggctatctgaccccaaaacacctactctaatgctatccctttagaggtgactgcctcattcttaaaatgtgctattttacatctaaaatgatgcatttcaattttatgataccattttacaccccctaagtgaattaatcactcacttctttataactctaccatccatgtgtccattcattcactcagcacatgcattaagcaccttctccttgtcagaccctgagccaggccttgtgatacagtggtgaataagacagtcaaggtctctgccttcatgcagcctaaattcaggtgcagaggcagataacaaagaactagaaaaaatgaaaacggcagattccaatttgtgctatggaagaaggaaatagaaattttaagataagactgggaggaactaatttagattagatgacctggcagagtctttctaagtactgtatatgacgttgtactgctgaattggggaggataagatttagtagctatgggaagagctgggtcagagagaccaacaagttcaagacccagagacaagaatgagtttgtcatatgctaggggcaggaagaggccagtgttgctataatatgagtaggtaatggcagactggtatacaatgaagttgaagaggtagacaagaagcagatcgtgattaggagtttgaatcttatccaaaggaattggaaataatttcctaatgatgtgctagaaccagttaccacctgtccatgggagccgattctaggcatctcttcccagctccatgttcagtgacatcacattggtagcttaaaatcagctatggtggtctttatctaggtggtggttacataactgtatgcatatgtaaaaattagttggactataaagcaaatatcagtacactttaccctatgctattataccacaaaaaaatatttttcagaaaaaagagagaggagcttacagtgaaaaattacataaagaagcaattcactattagtgagtcagtagtgacaaaaaccaggattagcaacacaaggactttaataaagcagcgatttgaaagagaatataaaataatagtgtttttaaaaaggcaagaaaggaaaatatgacagactatacctaaagagatgtggttacaaatttccaaatagaatgaaatcacaaattctcatattcaaatgtgcttcatgtttcattcaggatataatttggagattgctctaagaaagacctgatagtgaattgcatatgaagaatgatgcaaaatgagagctcaaggattacttctaggttctaattgacatgggaaaaaatgggaaagaaataggtttggaggagtgaactaagacctgtgttgtagttgtttaagatgcttattcgagcgccaagtgtaaaagtaaagcggcaattagaagaatctagagctcaaggtgtgcgcagtgaaaagaatttgggaattatcagaatacagatggtatttacagccatatttgtggatgagataccctgaggagaaaatgcagctagagacaaaaggacatagggctgagccaggtgacttcaaagtttccagactggatagagaaggagacctagcaaagaggaccaaggagggcctgtatgttgcatatttcatttctcagtgatgctgttagtatggtgtactaaaaagtaacctgtacaagaactcaatataacagaaacctagatcctgcttagttaaattataaaagtgctctgtgaacaatttttctatctgtaaaatgaaagtaatgactctttttcagtcaatttaataggatacacatgaggatccacagaatttatgaaagtaggtatgctttgtaatctaaagatgcagcggagtcatgtcctggcttttctatcagaatactcttagaggaccatgttgaaaatggctctattctaatttttttttatattctttaaagagtaatattaatatacttggtgaaccatcttgaggtcctggtacctactcttttctgttctagttggctaaaggacttgtcttactttaggtatatcatagaaaaagctggagggtgaataatcctaatcagaagaaattaattcaaagtcatgatgtctagggtctttctaattttgccgtcaacaaagcccatcaaaggtgaaagacacagggctttgccatagcacacagccagcctacctagccaaggcaaccctgttctcaaaattcagctcctagagttgatagagaaaactaatacttttgcttattatatacatttttctctgtttactattttagagtttctcaacagtaaataaaactcctataatagactagggatttctaatctgggtgaatattattacaaaaatatttttttcctagtgatggggaatgggggatggaaggatcatctccctgctttcatctaagatcctgaggactgaagtttctaaaaagtcttaatattccccgattatatactcaaaggtgtttttaacttggcactacatttaatccagtaaattttgaccaatttttaaaaatgtaattagagtccttaagtgatgtgctttcaccaagtggccaagcattgtataattcacagaaggaccattcctctgaaatgtatgctcttagtgagatgtgacttcacgaatgtaaaacagtgataatttacccttttttgtgtttctctctcgggccacatgctaattattatctctaagttacatttcatagtattcacaaaacacagttatgcattaagtacttctgtcacccaattatgaacgtgaagtttgtgagagccttgggaatttctcagactcttacatccagaaagtggtagatctgagattcaaacccatgcagtttgacctctcagccacgtacctgacctaagtaggagcttgtcttttaggcagctatagtagaactgtctgaaatgccattataggaccaataactagcatatgatggtttttctaaatacagagactactaaatttattttaagtaaagagggccaggcgcagtggctcatgcctgtaatctcagcactttgggagcccgaggtggccagatcacctgaggtcaggagttccagaccagcctgaccaagatggcgaaacctggtctctactaaaaatacaaaaattagctgggcacggtggtgcgcacctgtaatcccagctacttgggagggtgaggcaggagaatcacttcaacccgggagacggaggttgcggtgagccgagatggtgccactgcccttcagcctgggtgacagagtgagacaccatctcaattaaaaaaaaagaaaaaaaggaaaaagctctcttcattttaaatttagtagcaatttcaaggcttaaaaatactagtgaagcataaactctttgaagaaaacaatgtcttatccaaagaatgaactgacccacaagaagtacatactagaaaatgttttaaaactagaggcacttgaacggaaatagcaccggacagggaaccatctcatgggaagttgagtcccaattctgacggtaaatttttttcttgactttgaacaaggctttttacttttttcaaatctatttctcatctatgagatagagtcagatatagcagttcctttgtgcaaagggcataatcattgtggaaaagatgttatagtggtaatattttgagctacttgagaacagtactcaatgaaggtaagacagtcatagtatataaaataatcaaagccataatcagaagagtctgtacacttatataccatagttctcagtaagattgactgtcctggtcatagtcatatttttttaagaaagggcagaactatccaattctaatagtgcattgaatcccatttctaaagtcacagtatgcccattttgtggcatatattctgcctactgctaatattcctttagacagatggagtagaactaatgtactggaacatggctttcatttattttcttaataacctttgccatgatcaacagtgaatcacatcaccaaaggaccagatctggattgtgaccttgatttcttgatttagagaagtaaaaaaaaaaatacacatttttcataaaatcaaggtgtagaagaaataagttaatataaatatgaaatgccaagtcccttgaaattcatttgaacttttaaaatatctctttatcaaatcaaagatcaactaaaaatctatagcttaaacaatgcagcattttaaaaaaatttttttctctctcgatcaaatacagttagttgccttggaaaataactgagctatcatttcaccaaaacatgtcaaaccaagatcgcactatttttatcaggaaaaatgaaagagtcaaaaactcatccaagggagagtaaaagttgtgcttgcatttacttataccaaaaagtaggatgtagagaatactctttgataaaattagtatatgataagctggaaaggccttcagataaaggaacaagaatttacaactgtaaaacatgttgtaagaatgaaaaaacagaatcacctattgtcagtggcactactaaaacacattttcaacaagcttaaatatttcaaacgcctatcgaggtcgtgtgtttgaagcaaattcatcgtgtttcatatggcatacttcatatacaaaagtaataagggaaatgttcaaaattcaaattcaaactatcagactttaaatataagtgtccaatgcccagtggtcagacctacaccatggagagaaatttgactgaggataaacatatccataaaattccacagtattttattccttccaaggcatgttttatcacactggattgttgaagttcttgttcataaaaaggagagaacttttctgccaagcaaattaatataattaaggaaaccaaatgtgtcagcctatgttgaaactacagcagagttgagtaaaaactacaaggaattccttccagaaggaaaaaatcataataatacaatgtggtagactgagaacaggtttttaactacactaacttgtagtcaaactactactctgcttcttgcttaccctgcaactcacctgaataaattactcactgtccctgaaccttaggcatgaaatcagaatagcacttacctcagagactgctgtaagaatataatgaggaaatgactaacctggtagttttctctcttcacttatcctttagttccttgactctttctgatatttttattatattttattttatttatttttagagacaggggtgtcactagtctggtcacctacctagactggctctgaactcctgggcttaagcgatcctcctgcctcagcctcccaagtagctgggactatagatgccagccacacctggctttttctgaggtttttaaatctaattttttaaactatatttcataaataagagaaagatacaaacacacctctcatgacaaagtagtttaataatctggtagatctaagggagagactataaaagtagacattgttagagcagaatttcagagaacttccactaatattaacccaatgcttggctattacagaagagataactgtttacaaaggctgcccatgaccctttgatcagcaacatttatgaaaaagtcatccttatagatgtgaaaaatctatttccttataacttgcattcacacatcactgttcttccttctgaaggcattcatagatttgaagactattagatgcctgcattaagactattcactagcctaatattcctaaccactacaaaccttctgtcaagtgacataatttctcaaattttcatcattttgagccctctttaaaagatatattccaatatgttgaataatccttaaataaagctgaacatcatattccagcaatgtttttaccagcacagaatagtaataatgctaatattatgaacatttattgcatacttattatatgccctaaatatttgagatgcatatattttttagtgtagtaattttttcaaattttgtatttagtcatccagtaaaatgttagctggcacctacagtgaggcactatagaataacggttaaggattcagtcttcagagccacacttactggatttgaatgcagactactatttactagtctgtgacctgggggaaaataacttagactttctatgcctcagtttcttctattgcaaatgagattttaagatttgttttaatatcaagctatctatgtgaaacatttagaagagcgcctagtgcatagcaattgtcaggaatgttaatagttaccattattagtactgtagagaccaggtaaccatgtggaggaaatggacaactgaacaagaaataatataactcaacattgaaataagtactgtttaaaaataaagcatagaaggagacaggaagtgctaagctggaaggttttggggatggaggttagatatgtaggtgtaagaaggctgccatagggaggcagcatttgaaaaaacctgaatgaaataaaggagtgagccaaataactgcctagtgggacagtctgcccagaagagggaaaggctagcagaaaaggccctgaagtgagatgagcttggcagagatagtgatatttagggaaagcaagccatccagtgtggctagagaagaataagcaagttaggaggtgaatcagaaagttagcaggggccatatgatgtagtgtttcataggtaatggaaagaaagcacatagagataaaacctcttatctaagttgacagactgatacctattttctttgactctaaagcctgtaactcttaatcacattgctgcccttgacatgaacaatatattagattggtgcaaaagttattgtggtttttgccactgaaaataatggccaaaactgcaattgcttttgcaccaacctaaactttactcatattaaaattccatcagattttttggaagtcaagacacactgatggcttacattgtgcccttgtcagctgaaatatttaaatgtgttttttaatttttttattatgctttaagttttagggtacatatgcacaacgtgcaggtttgttacatatgtatgcatgtgccatgttggtgtgctgcacccattaactcttcatttaacattaggtatatctcctaatgctatccctcccccctcccccaccccacaacaggccccagtgtgtgatgttccccttcctgtgtccatgtgttctctttattcaattcccacctatgagtgagaacatgcggtgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacattcgggttggtcacaagtctttgctattgtgaatcgtgctgcaataaacatacatgtgcctgtgtctttatagcagcatgttttataatcctttgggtatatacccagtaatgggatggctgggtcaaatggtatttctagttctagatccctgaagaatcgccacactgacttccacaatggttgaactagttgacagtcccaccaacagtgtaaaagtgttcctatttctccacatcctctccagcacctgttgtttcctgactttttagtggtcgccattctaactggtgtgagatgatatctcattgtggtttttatttgcatttctctgatggccagtgatgatgagcatttaattatactttaagttctagggtacatgtgcacaacgtgcaggtttgttacataggtatacatgtgccatgttggtttgcggcacccatcaactcttcatttactttaggtatttctcctaatgctacccctcccccagccccccaccccccaataggccccagtgtgtgatgttcccctccctgtgtccatgtgttctcattgttcaactcccatttatgagtgagaacatatggtgtttggttttctgtccttgtaatattttgctgagagtgatggtttccagcttcatatatgtccctgcaaaggacatgaactcatcctttttatggctgcatagtattccatggtgtacatgtgccacgttttctttatccagtctattattgatggacatttgggttggttccaagtctttgctattgtgaatagtgccgcaataaacatgcgtgtgcatgtgtctttacggtagaatgatttataatccttagggtatatacccagtaatgggattcctgagtcaagtggtacttctagttctagatccttgaggaatcaccacactgtggacagtggttgaacgaatttgcactcccaccaacagtgtaaaagcactcctaattctccacatcctctccagcatctgtggtttcctgaccttttaaggattgccattctaactggtgagaggtggtatctcattgtggttttgatttggattaactgtgtttttttatgggaactcttgctaacttggttctaattcctcttgtatatctgtaactgattttggaagaggtttatacgtattatagttcatcttgctcaattattcctctcagctgtgtgtattctgataaacttgcctgctacattttcatttcaaatcctaataaaaagagtggactagaatagaggataaaatagtttgttctgactgctacaaatacctgcaggcttgcatgagttcattaaattatctctaagatacacttgtacaacaagttatgaacctacttttaacttttaaaagttaatccacaagtttattaaggaagatttgtctaaggttctatataattcacattaatttctaacctagtacatttatgagaaaaagaaaatcggaaattagtttagcatatatttatcaaacacaggaagactactaatttttactatctatgtttctaagatgttaatcttcttaatcatgtgtcctaattttttgccatggatattatacttactcaactgtagattatagttattatctgtttgaaaaatgaatcaacatttatctatcttatgacttatggagcccatactaattaatacaaattcctgaaatattactgacagtgattctgtgactttatctctaaacaaaatgtgtttggacctaagatatcaactctgttacagtagtgagattcagtctcactatctctctagtaccttgaaaccattttggtctactattagtatgttgaagaaaattaccactatgaatggataatatatacaaaaaataaaaaggaattggaactttacccaattactttttcttttcatcatgacatcatctgccataaactgagcctcatccctctttgttctcttgactgcaaacctggttataaaagcctttttttctttagcttttatcccaattctcattacactttggatttaaccctcttgatactattcgtagaagcttgaatcttcttttccctctgtccttaattaaattgtccatttatctcttttttctgcacataaatttttttatttttttaaatttttggttacagatatataataaatgtacatgtttatggggtacttgtgatattctgacacaagatataatgtgtaatgatgaaatcagggcaattggtgaagccatcacctcaagcatttatcatttctttggtacaaacagacacacatacatattttccaaattagagataggagtctcactctgacacccaggctggagtgcagtgatgcaatcctagcttactctaacctcaatctcctgagcccaagcaatcctcctgcctcagcctcagttatgactgcaggtatatgaccccatggctggtgagttaggccattcttacattaccagaaagaaatacctgagacgggaggtggctggcaagatggctgaataggaacagctctggtcttcagctcccagcaaaatcaatgcagaaggcgggtgacttctgcatttccaactgaggtactcggctcatatcattgggactggttagacagtgggtctagcgtacagagtgcaagctgaagcagggttgggcatcacctcacccaggaaacacaagagatcggagaactccctcacctagccaagggaagctttgagggactgtgccataaagaacggtgcactgtggcccagatactatgcttttcccacggtcttcgcaacctgcagaccaggagattccctcgggtgcctacaccaccagggccctgggtttcaagcacaaaactgggtggccacttgggcagataccaagctagcttcaggacttttttttcataccccagtggcaactggaatgccagcgagacagaacctttccatcccctggaaagggggctgaagccagggagccaagtggtctagctcagtggatcccactcccatggagcccagcaagctgagatccactggcttgaaattcttgctgccagcacagaagtctcaagtcgacctgggatgctcgagcttggtgcggggaagggagtctgccattactgaggcttgagtagggggttttcccctcacagtgtaaacaaagcttcctggaagttcgaactgggcggagcccaccacagctcctcaaaggtgctatagccagactgcctctccagattcctcctcttgggcagggcatctgaaagaaaggcagcaaccccagtcaggggcttatagataaaactcccatctccctgggacagagcacctgggggaaggggcggctgtgaagtcagcttcagcagacgtaaatgttcctgcctgctggctctgaagacagcaacagatctcccagcacagcgctcgagctctgctaagggacagacttcctcctcaagtgggtccctgacccttgtgcctcctgcctgggagacacctcccagcagggattgacagacacctcgtataggagcactccacctggcatctggcaggtgtccctctgggacaaagcttccagaggaaggaacaggcagcagtctttgctgttctgcagcctccactggtgatacccaggcaaacggagtctggagtggacctccagcaaactccagcagacctgcagcagaagggcctgactgttagaaggaaaactaacaaacagaaaagaatagcatcaacatcaacaaaaaggatgtccacacaaaatccccatctgaaggtcaccagcatcaaagaccaaaggtagttaagtccactaagatgaggaaaaaccagcatgaaaaggctgaaaatttcaaaaaccagaatgcctcttctcctccaaaggatcacaactcctcgccagcaagggaacaaaactagatggagaatgagtctgacaaattgatagaagtaggcttcagaaagtgggtaataaattcacctgagctgaaggaacatgttctaacccaatgcaaggaaactaagaacgttgagtaaacgttagaggaattgctaaccagaataaccagtttagagaagaacataaattacctgatggagctgcaaaacacatcatgaaaactttgtgcagcatacacaagtatcaatagctgaatcaatcaaacagaagaaaagatatcagagattgaagatcaacttaatgaaataagtgtgaagacaagattagagaaaaaaggaataaaaaggaagcctccaagaaatatgggactatgtgaaaagaccaaacctacgtttgactggtgtacctcaatgtgacagggagaatggaaccaagttgaaaaacactctttaggatattatccagaacttccccaacctagcaagagaggccaacattcaaattcaggaaatatagagaacaccacaatgatacgcctcgagaaaaacaaccccaagacacatactcatgagatccaccaaggtagaaggacaaactgttaagggcagccagagagaaaggttgggttacccacaaagggaagcccatcagactaacagcagatctctctgcagaaatcctaccagccagaagagagtgggggccaatatttaacattgttaaagaaaagaatttcaacccagaacttcatatccagccaaactaagcttcatcagcgaagaagaaataaaattttttacagacaagcaaatgctgagggattttgtcacagccaggcctgccttacaagagctcctgaaggaagcactacatatggagaggaaaaaacggtaccagccactgcaaaaacataccaaattgtaaagaccatcgacactatgaagaaactgcatcaactaacaggcaaagtaaccagctagcatcataatgacagggtcaaattcacacataacaatattaaccttaaatgtaaatgggctaaatgccccaattaaaagacacagcctggcaaattggatagagtcaagacccatcagtgtgctgtattcaggagacccgtctcccatgcagacacacataggctcaaaataaagggatggaggaatatttaccaagcaaatggaaagaaaaagaaagcaggggttgcagccctggtctctgatattaagagactttaaaccaacaaagatcaaaaaagacaaagaaaggcattacataatggtaaaggaatcaatgcaacaagaagagctaactatcctacatatatatgcacccaatacaggagcacctagattcataaagcaagttcttagagactacaaagagacttagactcccacacaataatattgggagactttaacaccccactgtcagtattagacacatcaacaggacagaaagttaacaaggatatttaggacttgaagtcagttctggaccaagcagacctaatagtcatctacagaactttccaccccaaatcaacagaacatacattcttcccagcaccacatcacacttattctaaaattgaccacataattggaagtaaaacactcctcagcaaatgcaaaagaatggaaatcataacaaacagtctctcagacaacagtgcaatcaaattagaactcaggattaagaaactcactcaaaactacacaactacatggaaattgaacaacctgctcctgaataactactgggtaaataatgaaattaaggcagagataaataagttctttgacatcaataagaaaaattcataatgtaccagaatacgtaggacacagctaaagcagtgtttagagggaaatttatagcactaaatgcccacaggagaaagcagcaaagatctaaaatcgacgccctaacaatgaaattaaaagaactagagaggcaagagcaaacaaattcaaaagctagcagagggcaagaaataactaagatcagagcacaactgaaggagaaagagacacgaaaaacccttcaaaaatcaatgaatccaggagatggttttttgaaaagatgaacaaaatagatagactactagccagactaataaagaaaaaaagagagaagaatcaaatagacacaataaaaaatgataaaggggatatcaccactgatcccacagaaatacaaactaccatcagagaatactatgcacacctctatgcaaataaactagaaaatctagaataaatggataaattcctggacatacaccctcccaagactaaatcaggaagaagtcaaatccctgaataggccaatagtaagttctgaaattgaggcagttattaatggcctaccaaccgaaaaatgcccagaaccagaaagactcatagccgaattctaccagaggtacaaagaggagctggtaccattctttctgaaactattccaaacaatagaaaacgagggaatcctccctgactcattttatgaggccagcatcatcctgaaaccaaaacctggcagaaacacaacaaaaaaaagaaaatttcagaccaatatcctaatgaacatcaatgtgaaaatcctcaataaaatactggtaaaatgaatccagcagcacatcaaaaagcttattcaccatgatcaagtcagcttcatccctggattgcaaagctggttcagcatatgcaaatcaatagacgtaatccatcacataaacagaaccaatgacaaaaactacatgataatctcaatagatgcagaaaaggcctttgacaaaattcaacaccccttcatgctaaaaactctcaataaactaggtattgatggaatgcatctcaaaatagtaagaactatttatgaccaacccataaaaccatatgaccaacccataaaacctaggcaatagcattcaggacataggcatgtgcaaagacttcatgactaaaacaccaaaagcaatggcaacagaagccaaaattgacaaatatgatctaattaaactaaagagcttctgtacagcaaaataaactatcatcagagtgaacaggcaacctacagaatgggagaaaatttttgcaatctatccatctgacaaaaggctaatatacagaatctacaaggagtttaaacaaatttacaggaaaaaaccccatcaaaaagtaggtaaaggatatgaacagacacttctcaaaagaagacatttatgtggacaacaaaaatatgaaaaaaagctcatcatcgttggtcattggagaaatgcaaatcaaaaccacaatgagataccatctcatgctagttagaatggcaatcattaaaaagtcaggaaacaacagatgcgggagaggatgtggaaaaataggaacacttttacactgttggtgggagtgtaaattcgttcaaccattgtggaagacagtgtagtgattcctcaaggatctagagccagaaataccatttgacccagccatcccattactgggtatatacccaaagtattatgaatcattctactataaagacacatgcacaagtatgtttattgcagcactattcacagtagcaatgacttggaaccaacccaaatgcgcatcaattatagactagataaagaaaatgtggcacatatgcaccatggaatacaatgcagccataaaaaaggatgagttcatatctttgcagggacatagatgaagctggaaaccatcattctcagcaaactaacacaggaacagaaaaccaaacaccacatgttctcactcataagtgggagctgagcaatgaaaacacatggacacagggaggggaacatcacacactggggcctgtcagaaggtggggggctaggggatggatagcattaggagaactatctaatgcagatgatgggttgatgggtgcagcaaaccgccatggcaagtgtgtacctacgtaacaaacctgcatgttctacgcatgtattccagaacttaaagtaaaaaaaaaaaaaaaaaaaaaaaaaaaaaaacagaaagaaatacctaagactgagtgatttataaaggaaagaggtttaattggctcatggttctgcaggctatacaaacatggcactcacaactgcttatcttctggggagcttcagggagcttttactcgtggtagaaggagaagagaaagcaggcacatcacatggtggaagctggagcaagtgtggcggggagctgccacacacttttaaacaaccagatctcatgtgaactcactcatcaccaagaggatggtgctagctaagccattcatgagggaaaagcccatgatccaaacacctccgaccaggccccaccttaaacactggggataatattttattgtgatttggtgggacacagatccaaaccctagcacctggctaatgtttttatttttatttatgtagagacaggattttgctgggtttcccaggctggtctcagattcctggcctcaagcagtcctcccaacttggcctcccaaagtactgagattacaggcatgagccatagggatgcctagcctacctatatattttatacagacatcatggatcattctatgcaataaaattgttttctttagatattttacccacggtttctatttttaatttcaatgcttttgtgtttgtattttagcaataaatatttttatttaatatttatttgataaatatttatatttaatatttatttgataaatatttatttctcttgagtgagcttccttcatatggttatgaccttacatttatacttaggttttctctgagcatttaaatatatcctttttggtgtttattttttaaatgatatgatgtttgagatttacttcaaaataacctgcaacaggcagtagggggagtcagataatggaatggacaaaataatattggttatcggttgctgattgttggagatgagtataatgagtgcatgctagctcattatattgctttctccatttatacgtaagtttgaaattttcctcaatgaaaaattaaaaataaaagagattgtatgttagtaccagctttttagagagtactaacagagccctaataatgcacaccaccaatttttcttaaattgtgtttatcataattttaaaagcttttaattctcagggtagttttaggtttacggcaaaattgaaaggaaggtatagagattttccgtataccatttgcccctaaacatgtatagcctcccttattattaacatcccccatcaaaatggtatatttgtcgtaattaatgcatctacaatggcacatcattatcgtccaaagtccacagttcatgttagggttcactcttggtgttgtacattctgactttggacaaatatatgacatgtatccactgttatactaccatacagaattgtttcactgctctaaaaatcctctgcacttcacctacttactccctatcccctaaaccctggcaaccactgatcttattactgcttccatacttttgtctttcccagaatatcatgcaattagagtcacagaatttagcctcttgggattggcttctttcacttagtaatatgcatctaagtttcctccatgtcttttcataacttgatagctcattttttaagctctgaataatgttccattatctggatgtacaacagtttatttatctattagcctactgaagtacatcttggttgcttccaagttttggaaattatgaataaagctggtataaacattcatgtgcaagcttttgtacagacacgagttttcaactcctctgggtaaacaccaaggagtgcaattgctgaatcatatggtaacaatatgtttagtaagacaccaccaaactgtcttccaacataattgtactattttgcatttccaccagccatgaatgagtgtctagtgctttaaattctcatcagcatttggttttgtcagagtttttttttttattttggccattctaatagtgtgtagtgatagctcattattgttttaatttgcatttccctgatgatatacgatgtggagcatcatataataataataagatgtcatatgcctacttaccatctatatatcttttttggtgaggtatctggtaaggtctttggcccatttttttaatcaggtcattaattttcttagcattgaattttaagttctttctatattttggataacagtctttatcagatgtgtcttttgcaaatatttttccaaggctgtggcttacatttttatccccttgaaagtgtcttttatagagcagaagcttttaattttaatgaagtccagtttatcaattttttggattatgcctttggtagcatatctaaaaagtcatggcaaaagccaaggtcatctagattttctcctatgtcatcttctaggacttttatagtgtgtgttttgcatttaggtctgtgatccattatgagttaaattttgtgaagggagcaaggttactacctagatttctttttttctctgtgcatgtccagctgttctagcaccatttgttgaaaagactatcttttctctattgtattgcctttgctcctttgtcaaagatcaaattactatatttatgtgagtctatatctgggctctctattctgttctattgatctctctgtgcgttcttttgccagtaccacacttcctagattgctgtagctttatggtaagtcttaaagtcaaattgtatcctatggtagctttattgtaagccttcaagtcaggtaatgtcagttttccaactttattcttcttcagtattgtgcaggatagttttatagcagtgaaaaatgcaaataatgtaaatgtccaaccatttgttcatgactagtgaaataaaatttggtggttatgatgaaatacactgaattattaaaagcaaactgtcagtcttaggtaagtaaatgcaagtttctaaatctatattttaaaaagcaccatttatatccctatctgtctaaacatctgttgagttttttaaaacgtcattgtttccatttataatatcctttatattttcttagctctctaaatggtgtatatcttgttgacctgaaccactggtcccctcacttaaacatgtttctttctgttgaacgtattgtagcaattcattttctcattttggtcatgagttgtgactattgtcttttatgaaagtaaacattcagtcctaaggacaaactaaataagcttatcttttctgaatgtatcgtatagatttgtaccaaaaataaaattggcccaaaagccccactgttgaagatatgtatcatgtaactttatttcttaaagattgtattagagttccaagaaaaagcctacaatttattataaattaaatgaagcataacaatagtgtgttttttaaaaaaatctcattcccacaaagcaaagtcagatctaaaaggaaaagtggccatgaagttctctgtaggcttgttttattttatcttttcagtgccttggtacatagattagcttaaacatttgaagaaatatgtgccatgaagaaaagtttttgttggattctatgaatacatttttatttatcagatttagtttgctcacatttactatttattgtagtgtttcttatgctatcaacaaacatagctaaatgttactacattttaatagagtaacactgatttcaaatctgtaaattaaataatgaaaaaaataaatgagaagaaaaagatgttaatattaattgaggaaaattttctgaggtctgctattgaccaagaaaataaattatatgtaaaattttacagtggaaaataaatatatagaaacttggcctcctcagtactatcctttcagaaattaataaaaaaggtagaagatattattaagtcagataaatgccagagaaagggctttttaaaaatctataagtttgaaactgtttcatagaaatatgtcaaagtctgaacttccctgacttgattttgcgtgattggcattcttcaagggacaaagggagttttctggtgcaatctgcctaatggatgtccttttatttatttatttatttattttgtttcattttcctttcctatttctcagatgttcttagcttgaaaggtttattccataggttcagtggtcttctttagaccagaaagaacttaggtaagacatgaagttaaggtcgcactgagtgcactttccagtagtcaacttagatatttgtcaaaagtagtatgacatttggcaaggtaattgacagtagcactgactttattctcttaacatgttgacagcacacaaaagctcaaaatctgctttttaataagtggatggtacccctaggctaaagaataatgagtgtacattttggggcatcttctctttatttaacctgccatgctgtactttatgtattagaagtagacaccacagttgtctggtttgaaaatactggtcttataagtcagtatccctctgcataacagagatgagctagcttttgccaaaaataaaagcagggagagaaagataaagaagggtttgtgaaattcatacagtagaatttcaggaaaatacagcaccatattacaaatatacgtcactgtttactcaatttatatctgaaataatttgtaactactcacctgataatagattttagcatcccacaaaaatacttgtcaaataaatattctacattttcaattagaatgagaaaacacttattaaatgcattttacaaaaagaaatattatatggcttttgaaataaagaggaaatcttaatataaaacatatctagttgcaattgaactgtcaaattagcttaattatagaactttatataaatatttccttactaaaagattttatttcataaatgatctcttaaaagtataacaatagcaataaagattataaatacctttaagaagtgagtcattcattttaaaaatctaccacaggtaataaaatattatgaaacttaatacaccacacacatgagattaccagtaaaactgagaaaatctgaataacattggtggatttcattcatatcaatatcttgattgtgaatattgccctatggttttgcaaaatgtcaccattggagaaactaggcaaagtgtacaaggtgcctttcttaccactgcaaatgaatctacaattatctataaaagtttcaataaaaaaaggaaaaaccctacatttttatggacagaagtttaaattttcaggcaggagaatataatcaatcttatttctgttgcacgaaaaaacctattgtattaaaaaataaaagaaaatacattctaaatgcaaacataatttaagaacgaatcaatctctaataaagtcaatagagaaatgcaatgagtaagcaaattattccataaaaagtatggttcacatgcagaaaagaagaaaaatctttttaagcaaatagttattccttctttaaatcctagcatacgtctaacctctttcttcattctcattctccaggtttaaatctaagctttcttcgcatttagagtctaaaaattcttaggaatcagtttatctctgaagagttatatatagcatcaaggaaaagatacagtttcacacaatcacgcacatgcacattatcttgccctttttagaactgatagtataatttagaggcactatattagagtatgaaaactttggtggcttaacccaacaaaggtttatttgacactcatctgaaagttcaatgcagtggtgggggatttgctccacacagtcattcagggaacaaggattttttctgcgggtgatttatcatttttctaagacgtcaatgtcctctaccatatttctacacctgactggcacaagcgaagaacccaaacacccattatttagagaatggaaaagcaaattgtgacactatcaggatacaggatactactcaacaatgaaaagaaacaaatgattgatgcacgcaatgtgcagtattgtggattaaactaagtgcaagaagcccagactcaaaaggttacaaactctataattttatttatatagggcattctagagaaaataaaaccaaagggacaaatgagtagttgccaagactaggagctggggaagggattgactgcaaggagatgaggggatttttgaaggttttagagatgtgtatattttgattatggtcatgattatatgattatatacacttttcaaaactcatcaagttgaggctgggagcagtggctcatgcctgcctgtaatcccaacactttgcaaggctgaggcgggtggattgcttgaggccaggagtttgagaccagcctgggcaaaatggcaaaaccctgtctctactaaaaattcaaaaattagccgggcatagtggtgcgcagctataatcctagctacttgggaggctgaggtatgagaatcgcctgaacccaggagatgggggttgcagtgagccaagcttgcccctctgccctccagcctgagtgacagtgccagactgtctcaaaaacaaacaaacaaatgtcaaaaaaaaaactcatcaagttgtgtgattacaaagaatgaatttttttatatatgcattatatattaacacacctgactctttaaaagtttaatacatgctttatactttttatctcaactttcaaggttagaccaggagaaacatattttttaaatgtctgcaaaagtatcctcccttctgtgccactgtaaggggtggtcagcagagcagcagcagcagcagctctgggagctatttagaaacactcttttgcccccttctccaccttccctttgcagaccttttgaatcaggatgtctagttgtggagcctaggaatctgtgtgctaacaagctccttgggtcatgccaaagttttaaaagcaatgatggtttataagaaaatacaaatcatgattatttttccagcaataaacatatacttcacttatagtaaatttaaatctgatatggttatttccccccacattcctatttacaataccattttcattttcacattgtaacattctactgtcatgttaactaccttttaaacaatttaagttgtaatttgagcttgtgctatattaccaatgcattagtaacactcgtacaaatcaaagcaaggaagtttccaacttctctgccaaaggattgagaaaggcgtcttctgatcttagattaattttacaaatactaaaattttaaaaataaaatgttaactggtcttagatttgtgaacatgaaggcatatctcttaaaatttccttatctaggttaagatgaaataattaccaactctgaagaaaaggctaaaataagacagataatgtaagatatatgtgtgttgtgttgggaaataaaaggcacaaatttaacagacatattttcacttgcgttgtgccagacttgctcagaacattaatgtaagctttgcccatggcttgctgagtggtccattctcctcttgagacttagagaatggaacagtaaccttgtgaccagggtcactgccatgctcccagccttgttgatggattttagaggcagcctaaactaattccatgaacagtgaaaatgcatttggatttaaatgttttataggctgtctgtcacttaccttctggaagttagcttttactctgcttcattaaaccaacttacagtattcacaacagactggcattcacagaaacgaagtcatacacttatgaaatcctttatttattcaagtagcttggagaattacaaagagtatgagcctaaaagtcagtcagacacaaatagatacaatctcagctctgccctatctgtgtgtattgggacaacatacctaacctcctccaggttctgtttcctcacctataaggtaggaattagaatagccttgcaagcatggtcattgtgaaaattgactgagataataggataattattattttttattgtttaatgaacatatcttaagagtcttatctgcttcaggcactgtattccctaggaaaaggaaggcacacaattaaaataagacatgattttccccctgaggagttccatggttctcaaagtggttggtaatccccttctagggattcctaaaactgtgtggagatattattggatgttacaaagactggaggtgctattgatacttcatgttcatggattctaaagattctaaaatgcatgggacagcctgagcaacagcaaaataattatcctacccaaaatgccaatagcaccccaattgagaaacaccgtagtagaggaagctgaaatgaatcgactataataatggatagaaaacaaaacaaatttcataatagatagatgcagtaagcacatcattaacaacatcataaccatcattgtaataagacaatagtcctttacaagacagtttgcatcatttcatttaatcctttgcaacaaaccatcagggagtgcactatatatctgtgcttcacaattttcatgtgtgtaagaaccaaatggggatcttgttaaaatgaagcatctgattcaataactgtactttaaacaactcatcagggggccacactgagttggcatgttatgtataatcgtagggaacactgttggtattgtggccaaaccccctgagacacctgttaccatttttgtgctttctgcgcccacctcaaccctgcgcaagatttacttccaacacctgtacctgtgattcccctgggcaggcactgtggctactggagctgctttgccaaaatccgatataaagttgtaaatgcctggaagtttagatctctctagggagaacttgagttaatgactagctggtatgagagtatgaaacctcaattcctttgccaaatcaggacaaactctgaggcatcacttatccagagtcccctgcagaatttagttcaagctactgtcttctggactatgcctaaaatcatacctttacttgcccttctatttccctgccctcctttcattactcccaccacagtttcctgtgggaacacttactcaataaatcactcgtatataaaacattatcttagtttctgcttctggagaagcctactctaatacatcctcaatttctctcttttcctcaactcacgcatccttttggttcaccttccaaattacatcccaaatccacccatttatcaccaaatccagtgctacactcaggtcaaagcttccataattttacctggactcatgcaattgccttttgacaaccccaatccattttctgcattttcctgagggatcgtttgaaaagtaaatgatattatgtcacttttatgcttcaaatattaccactacttccttttgctcttagaataaactccagacatcttactatatctacagttgtttacattctcaggtccctacctccgtctttactgacatctgctaacaaatcctagctttgcccattttccttcagccgcactggtctttgttttttcttccatgtgtatttcacctcaaagacactgtgattctgactgtgctgttctctcagattttctcatcattcatctcagttcaaatgttactttaaaaaaagaaacctacctgactacccgatctaacatagaatcccatatcctccaacactttccatcataaattactgcagttattttcttcacaatatttgttattatgtcacattaacttgtttgcttttgtttgttactgcttacttattgacatgctctcaatgttattagaatatgttaataaattcttgagaccagggaccttgtgaaatgtatcatcaatgtctatagtaccttgatcataacagaagcttcattaatattttttaaataaatgaaatataagtgattctcatttaagagatgacaaaaataaggctttatatattacttgtccacagtcacacaaggtcactcagtagccagtggtggagctgggactcagctgagctcttggtcatgtgttatacttttcccctgtttctggagtttgttctgctcaagaactctgatcaaattcagcctcattcagcctcactgttgactcacagactttcccttagtatttacaccacataatgctagaatggaacttcttaggttgatattgaggaaggagaaaaataggaaagctaagtaagataagtggaggaagatagaaaaaagtggtggagacaataagttggttaaggggctgtcggggaaaataactactctagaggatagcaatcatttattttaaaaagctttattaagtgatgcaaatgattctgctatgggtaatgagataaacacccagcaagcctaaagcttgctaattaccctgatctaatcacttacattatgtacatttcagaacatcactgcgtactctatgaactccatgaatatgtacaattgttatttgtcagctaagaactacattaaaaataaagcaataaagtatatgttgaaaaaattaattataatacaaagaaaattacagactaaggttactatgttacataaaatttataattatagacatcttatggatttagtttgatagtctagctgtagatggctgggcatcaggtaaattggccctgaattcctctcattgcctcttcatatggatttacaaaatggtaaatggaggcataaaatccctaaagaaaactacttccctctccttctgcctttctttcattcatccatttattcatccctgttcattcatttaacagctatttataaaacatagagagcgagcaagagggtgagagagaatattattttgtctgggatgtcaagataagtttctttgaagaagtttaaactgagctctgaaagaagactaggaattaattattgctactacttagtgtatctctagtatgctaaatagaaatcaaatagagaaggaatgttttgggcagatggcaggggtgaaggtcctaaaaatgtagggctcatgaaacataccttctttctctgtttcatcttgaaatctcatctctaacaataaatacaagtaactttcttgaggttatttttccccagaagtatgtggaagaaatgcatataatgtatatagtatatataattgtgcatattattacataaattatgtaagtatgtattatatctaacatatctgtagagacagttgtggatgattgccattgaaagctaactttcatttgagtagtgcagtttcacattaaactgaacttgggcatgaatttcagaaagagtatagaaagggttaggccctttttaggcccaacctaaaattttaaagcctttaattgaaaaatttatgacagtttcaggttagtcatttagactaataaagtttagcaacatcacatcatctgtaataaattgttgcttatcataaacctattagggaagaaaagtttaagtcaagaaaatgtatatataaaagtaatgcttattttatgggaaaagtaatgcatagtaatgcatagctcaacatggaaaggtatgaaatgaaaagtaagaggaatgactcagtgtgttacagaaaagggaagataagtttgtgataatatggaggcagaaccgaagtttcagaaacagaggctaagaattttactccccagctctgttaaccttctagatcactggcaaatggaaaaaaggatagtggatggatcaggcttaatcgcagaaaaggtttcatgatatttggatacagaaaggttttttaaagctaattttaaatgaattaaacatcagaagcaaatgagaaactgatggttgctggttggccttcctctgaggtaaaaggtcaagtgattgcttgaaagatcatctaacttggcctatgaaatggaatgtgttcattttattcagaacttattcatgtgtcaaactttagaggattgtataaagacatcggcaaaactcttgaactatctgatacgtctatttcatataaaatgcaaaaaattgtgtaattcaccctttcaaagaaccataatcatttagaaggcagtatgagaagcatttcatttagcctatcaaggtgacctaagatagttagtttagatgtgtaagcatatgctctagtattttgcacgatatgctttgagttccattatgagcatttcaggtagaaattcatttttcaatcattttcttctctttttagacacatatataatttaatataattttagagacctcattatattataattttgtcctctcttctccactttttaaatgttacatctttcctatttgattacagtatattaaaataataatgagcttgtcagtcttatgattgacatatatagaatgtcttattttagctaggtcgaaaaaatgaaacaattctaataaaatatgtatggtaaatatgatagatagacttattgcagcaaaggaaacttgaaaatagaatttatttattcattacctgtgtttccatggctacatctcaggcacacgaccacacccacagtagcatttatacccattcatatcacccctttcctggtcagaatatggagagaggggttgccatattgggtcctaagatacagcaacctgcagcacatgcttttactaaattgcagcctctcacttattttctcaggtctgtattattgtacatattttaaagaagtgtgagtcctaaggcaaaatttaactgcgaaatatataagtagtacatcatttccccctagaatgtaagctccaccagggcccagatctttatcagttttgttccctgaagtatatcatgtacctagatcagtgcttagcacctcgtggaatacacaggagagagacagagagaaagagagaatatataaattacatatcaggctgacctgctattccaaggcaggaatgtgttcagttaactttgagtttttattgttctttgctacctgtcagactttgcacatatcccattatctttcatcactaggcccctattgtacaactcttttaaagtatcttgagtaagattagaattttgaggtaccttttcttatttccctgctatttaaaacaagagacagaaaactagcactaatggagtgtccatcatgtgtctggcacagtgctatacatgttaatgtatatcatctttttaaacaaagaagactgaaattggtctaatgcaacatgactgtatgctgcctttatcttcatcagggtgctttcaataatttggacagctgcaaatgagattgctactggatagctgtgaatcaatttaataatgcagattaacttgaaacatgagagagacatctatgggattttttctgccagatcctccttagtaaagcatggactatctattaatattgctgctgctggactttttaattctatgaagtatatccagatccccctttacataatttttaaggactatggtgctaacattttagtatatctctagtatgctaattgggaatcatagatatccttcttaataaaatcatgttcttttgggagctttgcaaccttcatgtaaccctggaccactgcaaatagagttccacatgtagataaaacattgttgaaataatttatgagttggaacctaatacaaatggattcaaattccaactccacaacttattagctaaacttagattcctgagacttagtttatttgtaaaacaggaaattatttcagcactgttgtaagaattagagaaatcatgggcaataattgaagggtagatactcaataaggatgctataatcattgatagagggtagagataggaaatagtaatattttacctttacatttgtattttccatttcaacatatgttcagaataaaggtttgggattgtgacttaaattcacagtccctattcaatgcccatctttcctccaaggcacaaattgaattgtacttcctccagctatgcctatctcacattgatctcttccagtatcatttatctttcctgtagtgaaaattgcttgcaaacacatgccagaaagcctgtgttaaatatgaaatttttgcttccttcattatatgactttgggcaagtcagtttacatttccaaggttcaatttccatcttattaaaatggctgtggaattgtactgaatattgtattagtctgttttcatactactgataaagacacccaagactgggcaattgacaaaagaaagaggtttaattggacttacagttccatgtggctgcagaaggctcacaatcatggcagaaggcaaggagaagcaactcatgtcttacctggttggcagcaggcagagagagagagcttgtgcaggggaactcctctttttaaaaccttcagatcttgtgagacttattcactatcacaagaacaacacaggaaagacttgcctccatgattcaattacctcccaccaggtccctcccacaacatgtgggaattcgagataagattttggtggggacacagccaaaccatatcaaatattaagtaagataacgaataaaagatattcaaaaactttatagtgctttataagttgtctcagttatctgtggctgtgtaataaatcacaaaaagttggtgagctaacacaataagggttatttctcaactctataaagtctaggatcagctgggtagctcttctgctcaaaatggtgtccaaggatggcttcttcactcactcgtctggtgccttaactgacctggctagaataactgattctagctgggcatctctattaccatatgttttctctggcagcatagccagaacattttacatagtggttcagggatcttaggagagcctattccaagagaaactcaagtcttaccttgtattatgcttgttaatgttttattggccagagcaaatcacaggacttatcccacagccaatgtgtgaggtgacaacacagtcacatggatcccaggaggtgtagttcatttggggccaccaatgtaacagtctacacacaaatgtaagcagtaattgacattcccatttcatttctattactttgctataccacatattttggcatttgttttgcctccatagtcttcttcattggttcacgtgtgtactccttgtttcaagatgataaattttctagtggcaaggactctgttctaacatcatgttaccttgattctaacatcaaagctaatatttaatgatatattggaatatgtaggctttgatggttttgtagaagccgaatccttcccatatctgccacttaacagccattgtggccctgagcaagtatttgacctctttgagcctcagttttcccatttgcaaaatgaggataataatggtttcttccttcacatgattgttataaaaattaaattagttaataatatgagaaaagaatagtgcaggtccagaataaattttaaatgttagtgttatattttactgatataaagatagcctgatgtacttgtttaatttgtatctgatctctcatccatgggccccagtttaatacttcataaaggaatagatttcttgagtaattcacacagaaatattttacagcctcaaaatttggagtatttatatataaaataaattctatattttagcactgcattctcacaagttagtgaaggccttgatatttttgggcattggtgtttttaattctaaaaggaggaaactattctggttgtattcctaacctttttgagtttgggcagtcttatttggtaatctgagttaaatacattttaaaatagttatgctaagatattttaattgagaagcttgtgatatttattgaaacttctatatagaattcacttacctgtaacatcctatgatataaggatattttggtattgcttacatgtgaaaatgttaaagtggatataggcactcaatgatagtcaagttatccctgccactatgctaccctttagaatttaagacctccttttgagcaaggaatgtttctggcagcatcaatagcaatcaattttctactcacattctctcttttccacccagtgaattttactgccttatgggcagcaacagttgtaccctctgattgactccactactctcctcttcacatccaaaaacaaaatccgctgacaaaatagctttgctttgggaagagattgaagggattagaccacaaaatgctactttttgggggtcaggacaagtagaagttgaaatagtcaatatatttattttgcaaacactattttaattaacttttggtcattttaacaataacttcatagatatttaaaaacctgataagtatcactttgcttttttgcattagaagctattaaattatctatatatttttcaaatatagagaatattgcccacatgaagtacatattgcccatatgtagttcacaacacttttttgacgttttagtgagtctgtgttgctggttcttcgatacgtgtgcatttccttttattttttttctcttgatccaagaattttctttaaagagatatgctttccagaagaaaaggaacataaaagtacatatgtgttttagtgttcagagtatattcaggtgattcatattggttgggaggggcaggagatcaggtaaaaaagggtgaagaaaagaaagaggacacagttttcctggaaatggaaggatgaaaaagaaaaatgcttgaacaaatattgtttctgttttctcattgatccaggaaaaatagtttagaagtatattcaaattgcctaggtccatgtttttaatataacaggaaaattatacaaatcaaaaaatcatctgcctttccccaaaaatgtgtgtttttttacccatttggtttaatatagacaaagagtctgccatttcttccttaattaagcatgtattaagtgtttacactcaagcgtcatacaaagccctcaaatatcttaaagcccagtgtggcagacagaaatatgaaggaataaggtcaaagtacaattatggatttcctaataaatgtctgtgctttgtaagaggagggggtgggcatcagggagttgtcatggaaacatttatagaagagaaaacacttttaaatgcaaaggcagccactaaaaaaccacagtgattgaaggacccttctaattcaaaaatataaaaaataaaagggaaagtgtaagtaaacaaaagaagaaacaagatgataattttccccaaattcagtcaagatttaggatatgaagaaagagtattgaaaatacattgtcatgcatgtattaaattctgtttgaaattctatcagtaaatgtttgccaattttttggaggaaaagattacatattttggtgcatatttattcatggaacaaatgctatgtgccagaccacaggagttactgggaacaaaatggtagggataaaactagtccttgccttcatggagctgaaagtgaacatgaaccaaatgtttccctcaagtcttctgtactcccctttacaaagtgaaatggcacaggcctgaagtgttctgtgctttataaagcgtgcaagtagttttgtcagctttctggaaaaggcctaatattattaggaagcaaatttgcatttaatatctacttaactcaggtcatattgttttctgttttgactttaaaaagaaaatgtgatgggtaataacaataaaatgggcacaattatttagaagaggcgtgtttgtgccaagaaaattacagaggcagagtaagatttgcaaggagatggcatttttctcataattgctctctggatgtgtgtgcagcaggtttcatttgagggtggccactgttgagaacttctttcacagcaaagtgctgctacacctaaagttttatctgctcttccgtggtttcatcttagctaccatagcaacactaacagtgctattccaccctcccatcaacattcaggagaaggcttctcttgtctgcacgggattgcgcttacatccacttagagagcattcccaattcatcagatgtatatcttttagaaacggtttcctgaggagaaaaataggtattttgagagatggttatgatatttttagcccactgagcaattttgatagccttatcatagacacagatccaggttctgtgggttctaaagattatactgttaaaagtggggaggggttggggatggaaatactgttttttgaaaagaatacaaatttacaaattcaaaattagatacaaaaatgaatatttacttaggatgagaaaagcaatcacatcacattacaaagctcggaaagctgatatataggtatcacaaactccagaaaaagaaccttgtcttgttttttgtattttttttttttttttttttttttgagttggagtctcactctgtagcccaggctggagtgcagtggctcgatcttgggtcactgcaagctccgcctcccaggttcacgccattctcctgcctcagcctcccaagtagctgggactacaggcgtccgccaccacgcccagctaattttttgtatttttagtagagacagggtttcaccatgttagtcaggttggtctcgatctcctgacctcgtgatctgcccgcctcggcctcccagagtgctgggattacaggcgtgagccaccgcacccggctgccttgctttcattaactgtcagacattcttccataatagtttttcctataattttatatctgtatactcattgatttcctctttatgaaggacttcgtaggagcatttctggagagcaattagaaaatgtctttccactagcatagtgatccaaatcaattttttttttattcttgacagtctgaaataacttctttcagcttcacagctcattattggttatgacatgtacatttttagaattgttgcaaaatttaggaaatcctctatcaagtttattttgtatgtgaactgtcagatttggaagaatatttcacagactagcttttggctctgaacattccaaaccgtttttctcctccactacccacacagttccagtgtcaagcaccagaggacacgttcatatcacagtacaaaatccaactctggtaccttttgtcgggaagctcaatattgacagcccaataggtgataggaatattccagtcctgacagctggtaactgcaaaactttaggtgatctgcggtcatttccacacaattaaccatatagggaaatgaccccaaatcacctaaagttttccttcctaaacttatttaaaatatacccaagtgaaattcctcttaccctcatgcaaaaaaaatacttaaggctattccatcgccacctgaccaatgggaagtatgatagaggggtagttggtgttgaaagagacagtggtcttgactgattgcaattaaagtatgttaattttgccagacaactgagggacactgaccttgagctctaggggcttctcagtgagcctgcatttgtttaggatgcattgaggcaacgcttgcccacaccaatctcccttagcctacatctggccctaaagagagtccacatgtctaaggtttgcttaacattcctctcaggctttccaactccctcttgctttcgttttctttatccctgtcacttctttatccaaccaaagactgagtgatcaggaggaaaataagactgactggcagagaagatgtgcatgcatctgtcattcggatcatctccaatgctctgatctatgttctttgttattaaggctctccaaaaattattttgaagaatggactgagtttacatctctgatatttcatctgtattctgccttttcatttttgtagaaggcacataacagatgtacaattaatataaaaaagaatgagtgccagtgacttcagtgaatattgatgaaaacatttcttctttggtgtgtaggggtgagatttttcagtgaagtgctgccagcatttgctctgcacagtctctagaacttctagaatgagacattatgcagccatatcaacagatcagttgaacatggagaaggtgataggaagcttttgttaaactgtgacagatgaactattatcttattcttccccgtttcctaccataaaagtaggcaagtggggagagatactgatgtgttgatgcaatagcacccactgacgcacaaaaattgtttctttctgaatatttcgagaaagaactcctgtgttttcaggcttgtagttcagccacatgtatccataattgactgcagtatggaataaaacttacaagatagctatgaaagttgactgttttgtcatctagagacttgataactgttttgttgcaccaggcatgaatgttttaggcagttttttgtttcgtatgtcatgatgccatattctaaatgagcatcaccacttcccttggcatatttttgaaacactctgcaaagcattacatggttaattgtcagaaaactgtcactgaggaaagtggaaagtgagatcctcttccccagtccctggcaaagagcattttttttttcttttttttggtattggtaagcgtttaatatccagttctcaaaacaaccccccccagtaacccccataccacaaaataacaataacctgatgtatagcatttgcaaattgtcattatatatatatatacaatttaacttctgggatacatgtgcagattacagtatttgcaaattgtcattttatatatattatatatttaatgtaagttctgggatacatgtgcagaacatgcgggtttgttatataggtatacacgtgccatggtggtttgctgcacccatcaacccatcatctgcattaggtatttctcctcatgctatccctcccctagtcccccaccccccaacagccccccgtgtgtagtgttcccctccctgtgtccatgtgttctcattgttcaactcccgcttatgagcaagaacatgcattgtttggttttctcttcttgtgttagtttagatttttggaatttcctgagtgatagaggtgaaaggagaatattttcttattcataagtctcactgaaatggggcttattataaatggttaattatccaaaaatcaaagtgaaaaaagtagaaagagttatttgtagaataaaacagaactcaaggtatatccagggcctccatgttcatcaattaatccctaaactacacagcatttatatccgtaaatatgttatagtaaatctggaaatataaaatattttaaattgataatgttagggaagccaagagtcacagagttaagagggctgctctgaactgtttttgtttttgtttctgtcttatagcttgtttaaactagaaaggaccaaatgccgaacctactcatgtacagatgagaaaattgatatccaaggaaattaagtaacttaccctaaacctacaacctgctagagatagtcagggctaaattctatgtctgctaattaactcagaactctttcactgaaatatcctgcatatctctatcaggatatctctatcctgatggagaactctttctctatcaatcctgcattattgaataattttatgtgatgtgacactcagtttgcaaattagactgagcagtactttggatcctcaggaactcctgtttttaaagagatgccatgttctcttttgttcattatcattgaagatagaaatgtcaactcttaaaaacataagattttgtggttgaaatttttccttatattttatagaaagtctctgcatattttgtgctccatgtattgatttcctgttgctcctgtaacaaattattacaaacatggcttaaaacaacacaaatttgctattttatacttctctgggtcacatgttcaaaatggatcttactggctaaaattaaggtgtcagcaggtctgttttcttcctggaggttttaggagagagcccattcccttgtctttttcagctcctacaagtcacctacatttctgaactcaaagccttttcctccattttcaaagccaacagcatcgtatcatccaatctccctctgtctctgaccctcctgactgtctcttaaaaggacccttgtcctttaagattaggcccaactggatcatcccagataatctccccatctgaaaattctcaccctaatcatatttgcaaagtctcttttgtcatctatggtatcatatggacagattttagggattggaaggtagacatattggagtgggataaagcattattctgcccaccacactgccctcttaacttaaaagaattattttaacttgtttctcactagacgttgctttagttttacagtttcttcaggtttatcagaaatagaatgagaagtagcgatcatctcagacatttgcctaaaataaatataatttctgacacttacaaaatgtatttatctctctcatattccagtttaataatggagaccttacttgttatgtatttgtgttttttttaataataaaataaggagaaaaaagaaacggaattgtgagattatatttagattggggaaataaataattccttaggttctttaaagggtgagagaacaaagccccttcaatagaaacgattttgtatgacattgtattaatttcctagggctgccataacaagtcaccacaagcttcctggctcaaaataacagaaatttctctcaaagttctggaggctagaaattcgaaatcaaggtgttggcagggccacactctctctgaagtctctaagaaagcatccatcctgtcctgcctcttccatcttctggtggctccaggcattccttggcttgtgggagcatcactcccatctctgcctccatctttacatcatggtcgtctctacgtctccatgtgtccttttcggtctctcacaaatatactttcattaaagttagaatcatcctaatcttcatccagatccttagttatgtcttcaaaaacctatttccaaacaaggtcacattctgaggttcaagatggacatgaatttcgaggggggcactatttaactcgctacaggtataattatgtatgaaggaattattctttataattaactttctagtttgtgttacacttctctttgcttaaaaaataaataacagcaaatcattagctgctttcttcttcggtgctgtggacgtttttttctgttattattaatattgatccagttcttgggaattttctcaatgctaaatgataatgagaggaagaaagataacaatgattctcattgaatgttttttgctatattcttggcatagtgctggatactttacaaacatccaatccccataacaatcctggcaagtagttatattattatagtacacataaaaaactgaagttcaaaaaggctcagtaacttgaccagcattatatacctaggaagtggcaggggtcagaatcagatataacaaaatttctctctcttccaattttccagtattctcatcttagggtccattctgtccaaggccgttcctcagacacatccattctccttcagttctcacttttgaattcacctccaagcttatacactagcaattgacaactaatacatagccttcaagctttttgcaaacaaactacaacaatagcacaacaacaactagaacttcaaaagtttgaagagtagtgaaaaaagagaaaacaaaccaatgaacaagacatcactaaacagtcctattggatttgggaaccacaggaagcagatggaaaatgctgaaacatttctctagagtcattgaaaaatgacctctattaaattggaaagaattttagggttccggtcttagatcacaaatgaaataaaaacagtttcataaagacacaactgtttctgagtaaaatatatctagaagttccttgacttactaaatgaatttaccttgggaaaaaacatatttcttgaaaaatattttaaatagaagggctatccctctaaaggctctcttataacataactttgaaagtaaacataagccaacaaacaaactagaaagcaatattgtcactatattggttaataaataaaactgggaaaaaataatatgaacattttgaatactggtccttaaataggataagtatttgaggatgttgacagaatcagtaaatacattaacaattctttttgataaacatttaagtagagcttttgaaaaaaattttcttcctttctttattatactatccctcaatggttgaaaatgttgttttttgacatgagggatacttcctttctcttattgattgaactattgtgttctagtcttaaatttattctctttttgtaagaggatacaataaaagtatgagtcaaagaatatattggggatttcaaaaaattcattagaaatggaatttaacataagctcttaatataagctccatcaagttcaagacatttttgtaaatgatgataccatccatttgctccattcctaaagaactgagggtcctgggaatttaactatgtttatgctgtcttttctgcataattaactgaagaaaatgggtatcctttacagatttttttaagattaggaaacaaaaatcagtcaaaaggagctaaatcaggactataaagtggatgcctaatgatttcccatcaaatgtctcataaaattgcccttgattgatgagaggaatgagtaggagcattgtcgtggtggagaaggactctctggtgaagctttcctggatgtttttctgctagaactttggctaactttctcaaaacactttcataataagcagaggttatcattctttggccctccagaaagtcaacaagcaaaataccttgagcatcccaaaaaactgttaccttggcctttgctattaccagtccacttttgctttgcctagaccaagttcacctcttagtagcaatttctttgattgagtttattttcaggatcatactggcaaacctgtgtttcacctcctgttacgattcttcaaagaaatccctcaggatcttgatctcatttgtttaatattttcattgaaagctccgtttttgtctgtgagtgatctgggcacaatgattttggcacccagcaagtggaaagtttgctcaactttaattttgcagttagaattgtgtacgctgagtcaattaagatgtctatggtgttgactgttgtttcactggtctttttcaattagggcatcaacaagattaactttttttcccacaaagtgatgtggatggtctgctgctgagggcttcatcccacaacatggtctcaacccttcttaaaatgaggtccatttgtaaactgctttcttgtggggcattgtcctcataaaatttgtgcaaagcattaatcatttcattattcttccaccccagcttctccataaatttgatgtttgctcttgcctcaattttaggggagttcatgttgctaataggggcacctttcaaactggtatcttatccttcttcatgcttcaaactagatcctgcccagacatgttataacaagttaatacaagttattttggtacaaaaaaaatgaaatctatgcatagttttttcataacacacattttctatgaactttttgaagactctcttgtacatggcatatccacctttagttactgaataaataaataaaagatgctcttgcttaaattgttcatgtgtgctagaactttatcccgagcccttcattctcatgttttgcactttcctgtggtgattttacataaacccatgagtttgttaatatctgttaaattgatgacagccaaacctatggctccagcagagattctactcctgagtgtctgacctctatatccaagcacattttatgcttgactacttaaactacttgagtgatcctagagatcttaatttccacatattccaaactaatcatatcatcctttgcccaaaacctggcatttctgcagatgtaccaccacccgtatcattcaaccagttcagacatctggggtcaccagatgtttccctcatactcaggacttatctggccaccaaatctggagatacctgtctcctaaacttttctcatatccttcaccttatctccaattcttctgctcacctacattacagtaagacctaatctgtctctatccctagattcttgactccattcaaatgagtacccctctgccattaagtagttttataaatccttaaatagcttgccctagctttcagcctaagatcaataataatggtgattgccatttttgtgcctattatatgtgaaacactattctagacacttgacatacatatatttgcattagctctcatctgatatcagtctggtaagatagatattaccctaattttataaatgaagaaactgaatgtcagaaagcttagatgatttactcaagactactgagccagttcatgatggagctagggttcaatcctaggatgatggtctggatgcaaaaccttctgttccactggacctgttgctgaattgaaacttgtaagatcaggacacaaaggctgttgatgatctggaatgctcagatgctgatcttccctagcatgggcagttgcttcagtaataccaaagtattaccttctctttcttctctcttttttaacctcatacatatgtacccttttaaaaaattcatggaagaatacattcaggttgttaaaaaattcaaataaagtgaaagtaattagaataaattatacatcctccacacagccccaatctcctcccaagagagctaatcactttcagacactgatgttgactgaattcatttaatctaaagacttagatctcttctcctctatgaagtttctttctgtctatcatttctctttattccctctgttctctgcctctgaaacttctacccagcattctttgtgccacagactgctcgagacactgagcacagcctatataactatatttaaaattgtataaaattagatgcacaggattacaaaggaaaccaattttattaaaatgcagttatctaaatattaaaaagtataatataggaatacaattatgaatgcatcaataacaaaatctagcaacgtatttgatagatatgttaattctgcactactgatgagcacagattgtattttgagatacttgcagcaataatactatcatgaaaatacctgtaatttttgctgatagcaaagtgacatgtactgctaatactactgtgatttttgcctacatccatatttgggggagttattaaattttagttagagtatattttaaaacatgtaatttcttttttctatccaaaggctccttgaaatctatccatggcctcattttagtattactgagcttttaggatttccactatcttcaatatttcttgtactttctctaatattttctagtcttttacactgtgttctaaggttaactttctatttagatattttactccaatggtaaagaaaatttattatattacattataatcattgttttctacctagccctgttataattttatgagtaaattacatataaatgcattcaatcactcaaagaaaagcttccaaaggaaagagaaattgaagtaaggttgatgtggatttcttgaaaggaataattaagaaacattttgcatattattaaaagcggttatcagataatcattctttctgcaaaattagataaacccagggatgatccaagaatccagagataataatcctatattaacctttgctgttactttatggttagtctagaaacaatgcagtggtctttcaatttggaaatgaaaatgttaacatgtaaggtagtatgaaaataccttcatgaaaagtatgaacaaataaaaaatatggtcaagaacttgtaaagttgtacttacatgttatatggtaaattttaagaggtgatttttccaaatagaaactaccacctaaagaatataaaaagaagaaagggggagggaaggagggagagacagacattatttttaaatgaataagctaaagaacatttataaaacaatcaaaattttttttgcagttggaataataggttttttatacacattcattatgttgtaaatgttttcctctccattaatttacattaatgtcatacaggactacaaaaaattagggttcagagttatagataacctataagccaatgcaaacagtcgatcaccagtgtttctgtaagaatgaggatggtttattatttacatccttttactttgcagtaactattcaagggagaaggcaaacagaaaatgcatcaaatctcagtattattgtctatgtttttctgttgccatcagctaatgctctcattctgattcatacccacccagcttctccactgaagtcaatgagaaacttcctttaaaggctgcagagtcacactcacaattgcctacagcagatgggtaaactaagtctgagccctgccccttctcccagtactggtcccctgaaggccaaggcctgagaaatgtttaaaaatacttgcattccctgacaacaagataaatttgtaatgtggattttttttatttctctgaacaaatcagaacatttgacaacactggacctgctttccagctatacaacaagcagcaggttcctgattttgccattttgccccatcaagttcaatggggcatgaactctccagcaggttcatcatatacattatacccagaatgaagtcctagcttttcagcgtagaattcaacaacgttcatgattctgcactcccctgcttttttttttattatttatttattttattattattatactttaagttttagggtacatgggcacattgtgcaggttagttacatacgtatacgtgtgccatgctggtgtgctgcacgcactaactcgtcatctagcattaggtatatctcccaatgctatccctcccccctccccccaccccacaacagtccccagtgtgtgatgttccctttcctgtgtccatgtgatctcactgttcaattcccacctatgagtgagaatatgtggtgtttggtttttttgttcttgcgatagtttactgagaatgatggtttccaatttcatccatgtccctacaaaggacatgaactcatcattttttatggctgcatagtattccatggtgtatatgtgccacattttcttaatctagtctatcattgttggacatttgggttggttccaagtctttgctattgtgaataatgccgcaataaacatacatctgcatgtatctttatagcagcatgatttatagtcatttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgtcgtttcctgactttttaatgattgccattctaactggtgtgagatggtatctccttgtggttttgatttgcatttctctgatggccagtgatggtgagcattttttcatgtgttttttggctgcataaatgtcttcttttgagaagtgtctgttcatgtcctttgcccacttgttgatggggttgtttgttttgttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcagttttgtcttttgttgtcattgcttttggtgttttagacatgaagtccttgcccatgcctatgtcctgaatggtaatgcctaggttttcttctagggtttttatggttttaggtctaacgttttaagtctttaatccatcttgaactgatttttgtataaggcgtaaggaagggatccagtttcagctttctacatatggctagccagttttcccagcaccatttattaaatagggaatcctttccccatttcttgtttttgtcaggtttgtcaaagatcagatagttgtagataggtggcgttatttctgagggctctgttctgttccattgatctatatctctgttttggtatcagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctctgaagaaaggcattggtagcttgatggggatagcattgaatctgtaaattaccttgggcagtatggccattttcacgatattgattcttcctacccatgagcatggaatgttcttccatttgtatgtatcctcttttatttccgtgagcagcggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacgatggggttttctagatatacaatcatgtcatctgcaaacagggacaattggacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaaagttgttgaattttgtcaaaggccttttctgcatctattgatataatcatgtggtttttgtctttggctctgtttatatgctggattacatttattgatttgcgtatattgaaccagccttgcatcccagggatgaagcccacttgaccatggtggataagctttttgatgtgctgctggattcggtttgccagtattttattgaggatttttgcatcaatgttcatcagggatatgggtctaaaattctcttttttggttctgtctctgccgggctttggtatcagaatgatgctggcctcataaaatgagttagggaggattccctctttttctatttattggaatagtttcagaaggaatggtaccagttcctccttgtacctctggtagaattcggctgtgaatccatctggtcctggactctttttggttggtaaggtattgattattgccacaatttcagatcctgttattggtgtattcagagattcaacttcttcctggcttagtcttgggagagtgtatgtgtcgaggaatttatccatttcttctagattttttagtttatttgcgtagaggtgtttatagtattctctgatggtagtttgtatttctgtgggatcggtggtgatatcccctttatcattttttattgcgtctatttgattcttttctctttttttctttattagtcttgctagtgctctatcaattttgttgatcctttcaaaaaaccagctcctggattcattaattttttgaagggtattttgtgtctctatttccttcagttctgctctgattttagttatttcttgccttctgctaccttttgaatttgtttcctcttgcttttctagttcttttaattgtgatgttagggtgtcaattttagatctttccggctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggaggaggttgttcagtttccatgtagatgagcgattttgagtgagattcttaatcctgagttctaatttgattgcactgtggtctgagaggtagtttgttataatttctgttcttttacatttgctgaggagtgctttacttccaagtatgtggtcaattttggaataggtgtggtgtggtgctgaaaaaaatgtatattctgttgatttggggtggagagttctgtagatgtctattaggtctgcttggtgcagagctgagttcaattcctcggtatccttgttgactttctgtctcgttgatctgtctaatgttgacagtggggtgttaaagtctcccactattaatgtgtgggagtctaagtctctttgtaggtcactcaggacttgctttatgaatctgggtgctcatgtattgggtgcatacatatttaggacagttagctcttcttgttgaattgatgcctttaccattatgtaatggccttctttgtctcttttgatctttgttggcttaaagtctgtttcatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagaatttagtccatttacatttaaagttaatagtgttatgtgtgaatttgatcctgtcattatgatgttagctggttattttgcttgttagttgcagtttcttcctagtctcgatgggctttacattttggcatgattttgcagcagctggtaccggttgttcctttccatgtttagcgcttccttcaggagctcttttagggcaggcctggtggtgacaaaatctttcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaaattctccaggataatatcctgcagagtgttttccaacttggttccattctccccatcactttcaggtacaccaatcagacgtagatttggtcttttcacatagtcccatatttcctggaggctttgctcgtttctttttattgttttttctctaaactttccttctcgcttcatttcatttatttcatcttccattgctgataccctttcttccagttgatcgcatcggctcctgaggcttctgcattcttcacgtagttctcgagccttggttttcaggtccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcgttctccgtccagctttgttccgttgctggtgaggagctgcattcctttggaggaggagaggcactctgctttttagagtttccagtttttctgttctgtcttttccccatctttgtggttttatctacttttggtctttggtatggtgatgtacagatgggtttttggtgtggatgtcctttctgtttgttagttttccttctaacacacaggaccctcagctgcaggtctgttggagtaccctgcagtgtgaggtgtcagtgtgcccctgctggagggtgcctcccagttaggctgctcgggggtcaggggtcagggacccacttgaggaggcagtccgcccattctcagatctccagctgcgtactgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttccaggctgctttgtttacctaagcaagcctgggcaatggcgggcgcccctcccccagcctcgctgccaccttgcagcttgatctcagactgctgtgctagcaatcaatgagactccgtggggtaggaccctctgagccaggtgcgggatataatctcgtggtgcgccgttttttaagcccgtcggaaaagcgcagtattcgggtgggagtgacccgattttccaggtgccgtccatcacccctttctttgattaggaaagggaactccctgaccccttgcgcttcccgagtgaggcaatgcctcgccctgcttcggctcatgcacggtgcacgcacccactgacctgcacccactgtctggcactccctagtgagatgaacccggtacctcagatggaaatgcagaaatcacccatcttctgcatcgctcaggctgggagctgtagaccagagctgttcctattcagccatcttggctcctccctccactcccctgctttttaagacatgctgcctgctctcctcaaacaatggtgacctccaggcctctatcttgtaggatccaacttggctttcatctttttaggaagcctcctgtaatatccctttcttcaatgtcgattgttcatgaaattccttagcatttagttgtggcctctcttatgacaccttatcgtgggtacattgagatttaattttattagtatttaacatttcataattgtgtgtgtatgccttcttttcatgcattacataatcttttcacaactagaccaagttctgatatctgttattaggagccaaacccagccctgtatttacttgctgtgggaacttgggcaaattattgatcccctctaatcttcactcagtcccaatatttgtaaaatgggaataatacctactcatgaagttattgtaaaacttaatgaaacactgcatgaaaagcattttgctcagtgtcagggatgcagtaagaactcagtaaaaatgtttgtgttataatttctctaccattgtcactctcttgagagctattaaatgacttatccctgatttcttcttacctataggccttttattgccctagaagtttgcacaactaactttccacaattcttcctggtaataatattaccgtgaaaatattcttccaatattttaagattccctcatcattatattactttaatttctgtgtaaagatcatatagaatacaaataaaatgagatcgttatttgctcttcaggtaccacattaataacaatttctacctaccatgtattgatcgcctattatgtggcaggcactgtgctagatatttatttttcttgccttgtcgctagtgttcaaaactccacaaggaaagtattttgacacgaattttatggctgagaaaactgaggtcccgagtagttaagtaaattatttgtttattctacatctgtgtggcagaactgggttcgaaatgagatctatatgtaaaggctatgcactttttgctaatttcctattgccttgtgtttattatctagttcactattgagccattcagatacaaattagccctagtaaacctttgtaatttctagaaatattgcaattgtatatgtttaatgtacaataaattcttcttaggctatcgctaataatatttctaataccccaatatggctttcttagaaaataaaggctacttgagggctgggtgcggtggctcacgcctgcagtcccagcactttgggaggccgaggagggcgatcacgaggtcagaagatcaaaaccatcctggctaacacggtgaaaccctgtctctactacaaatacaaaaaattagctgggcatggtggcaggcgcctgtagtcccagctactcgggaggctgaggcagaagaatgcggtgaactcgggaggcggagcatgcggtgagccgagatcgcgtcactgcactccagcctgggcgacagagtgagactcggtcttaaaaaaaaaagaaaaagaaaaaaagaaaagaaaggctacttgagaatgaccaagttattatattaagactttttccagatgcaagtaaaaattacgttacattgttttgtgttgtagcattaacaatgctcaatgttttgattaataagtgtctgatttgatatatcagttggatattacttgtgaaaacacgatctgtctcattgttggatattggtttttgatagatcagatttaatgtattacatggacatttatgaggttcttctacatacaatataattgatttaatacggatctggtttatggctggtgtatttaatttcaaaatatatctggcttaatacttaatgtatttgttttgatattcggcattttgatgcaatgttcaagtgtatgatttgataagaaatatattgctcatgggcatgaagaaaattgtaaaagaaaattatcagtagacagtgaacagatgtgtaattatgcagaaataatcacatttttagagcagaaatctaaagtgaaaatatgtttcaaaaagatgtgttagttttgtttaggtaaacattggattctcagcttcattcaattaaacaaacaataacaacaaacaataagcatataagacctcccaaagtcagctatttttttaacaaattgaaaattaatttactttgttgagtctttcctcatgtgatagtaactattttatatattttgataagctgttacttgaagtaaatatatttctacttgtagtttttatgtgtttctgttttgaaaatctacagctccgaaacatcatgatgaatgttttacagtcttctagttcacagggaaacagaatgcaagagacttaccagcttctcctaggatgcgttaggagtcagtatactttttagtttatgtatgagattgttttgcctgacttaccaatagaatgaattttaatgctctcctgctcatttgtgatttctctttcctaggagagaacttcctataattccctcagaaccatccctgtccctattgttcatcatccttatcagagcagtcactccagcgaatctccttatctcaaaacccagaagtcccaagacactcttcattgcctgtcctcttttgcctcccaaatttgttagcttgcaggttcagctgcttctttctacttcttttgaatccaaatatttctttctgcctcaacgaaaatccttgcctacatacctaccttacaaccaaatgttagtcacttagttcctgttatgttctattcccaagctgtgtttcacacttgaacttccatctactgaatttcattttttgctactctatatttgatacctctggatcaaatataaactgttgcattgaaagctttctgttagatagccctgacttaaaggattgcagccttattccttaataatatcaataggaaagactaaaaatatagacagtttgctgtgaacgaacaatggactatcatatactctatacattctctggtacaacatacatgacaactatccaagttagggatgtggaaacttaagctcgttgaagttaacacagtctaataagaggaatgtcagatttcacatttcacacccgggcggtctgactctagactctgtgttcttagatccaaatgatatcacttattgttatagcttccattccacataggcaatcttacaacttcataaaattattccatttcttccagctgctatccctccccccatagtccactgtctctttcttttcattctttatctctctttccctcgttcactcattccttctcatgcttcctttctcactcactctcttttaaagtttttttactgtgctaagcaccaatgaattttgcttcaaatcactgactctaagaggtttctaataggtttcttgctgacaaagagaataaatgttaacttttccctcttaggttgttgctctcgtttcttttcaaccaaatttattctgattaatcttacttatttttctaagatttaacccagttttaagaagatttccatatgagcaagttataatactatctatatttgcattttagtatgttttgtatttacagattttgtatctaccaaaatgcatcttcttgaaggagaatgcacctctagatgcaaactaaaactatcttttgcctctttctttatcctctttcatagctttctgtttctgtttctatgttttattcagacaaaataatgcaaatttgtgcatatctgtgtgcagagaagagattgaagcaagaattgtataaaatgtgccttcatattgagtatatactgtaattattttttatttataatttcttcaaggcatagaacaaaacccactctaatctgtcactaaataatgctgttaatgctaattttttctttttaagtttttcagtaattacatatataatctagactaagaaaatcatattctgaattaaacattgccacaaaattttacttccaactcgattctaggatatttaaaaccaggaaatgatactgtctcctttcacttctggtctgacaccgaatagagtgctggtgcacagtccatacccaacaaatgttgttggatggacttgaatgtgaatcacctgcagcactctgtttaatgattcagcatctattccactagagaatgcaaaagaagcagatctggagaagagaaaaattttatagcactgtcattagtggtcacttctaagcacaaggaaacttaaaagtgtttcacctacaatttagagtaagaccagcctcttcaggtgtacttcaggtaaatagattacaagtaaattgtaggcatttctttaagtgaaaaaagcttttagatgattacagaaagtctcacaaaaataattttatcatcattgaaactttctgtaattttctcctaagtaaatttcacttccaaatgtgtcatttcagtttgagataaaataatcctaaaactatggcttccatttgcttccatcaatctactggaaaacaatgtgattatatacacacagaaaaatgttatgttctgattccagtattggcttagtatcttataccaaactaaccctttcacaaaagcagccagaacctgaaagagatatgacccttgagagaagaaactgcacaaggaaagagtcgcagttacatggcttttcccctgagcacacttccaagtccacacacagatcaagacagctagcattcaagaataaagttgcagttttactggcttggagtgtcacaggatggagttagggttgctagacatctgaaaattaagagggaataccagaaagatgagaatcagaacaggaagagtcctaaaattggcattcatactgcccttaaattcttggataaccctgaactgtgtatgcacaggggagaaaccatgctggaaaaagcaacggctagaaggcccaagatttaagcgtaacttagctgccatataccacagcgtagacaaagtttggagttcaagccctgccaaattaaaagggctgagtaaactcatcaggtattccattaaaattccagaatgaatctgtaggattaaaactatgtctcagtacaaatacaagttccttaaacaaaaacacaaacttgatacattggattttacaaaaacaaaaaaaattctacttatcaaatattctattaagaaaattaaaaaggtaagccatacaatgggagaaaatatttaccacacatacatatctctgacaaagaccttgtatctcatatataaagaactaaaatcaataatgaaaagacaaatagtataataaaaaataaacaaaagattggaacagtggtttcataaaagaaaatatacaaattaccaataaactcaaaaatacttaattaacatcattagccaccaagaaaatataaattgaaaccacaatgatatacatttcacatccaccataatagctagaattagaaagactaatagcaccaaatattggcaaaaatgtggagtgactagaacttacatatattgatgatgtaaaatgcgtaaaaactactttggaaatctgtttagcagtttcctaccaaactaaaggcatatatagcctatgacttagcagttccaatctcaggtatttacctaaaagagaggaaaacttccatccataaaagactcatattggaagcaacccaaacgtccaacaatggggaaatggaaaagcatagtggtctactcagacctcaatactgcaagaaataataatgagctactgatacacaaaccagttggctgtatctgaaaagcattgtgctgttcaaaactagccagagtcagaagagtacatgccatttgatatcatttctatgaagctcaagagccagcaaaacaaatctgtcatggtgagagaaatcagagcaatagtgcccagagggtgaggaagagggcaaggaaaatttctggagtgatggaaatgttctgtatcttaactgaggcagtagattcacaggtatattttttaatgaaaattcattgaatttgagactcaaaatctgtgcttttcatgataagtaaatttgcatgctacaaatggttgtactgtgtgatttgaattggatttggattaaatatagcatgattatggtttggattggatggacagttggactggattaaatacagcataaccagatgataagaactgaaaatagagtatatgcctactcaaggaagttcctgactcacccctctcctatacatcatatcctacccaacataaatacatgggtgtcctggaacatgtcccattttcatgccttattcttcacttctattctttaggattatttccttttcctggggtttactcttttaataaattgggaactgctgcattcaatgaggggcattttaactaaggaatcctgataacaccaacagctgagttattcttgctagctagtaatttccaaaagttcagccatgaaaaagattagtaattgaatctatgcaagattaagccaaccaagacacaggtttcactgaagcttctaaaatattacttgtaaaatgtttactgggattagtcctgtttaatctctgaccaaaatttctattcttcctttgttcctctgtctttaaactttgataatgataatttttttcatcaagccactttatagaattttttccacattgatgagaaaaaatactgattctctggcttctttgaaagacattctatccttatttggagtaaccatgttattatgaataacactattatattacacctttattttctcattgctgggccaagaagttagtgagatactgaattgtgacaactgatcaccatatagtttctttttaatgaccttgtgtaatgtgtaatagactgtgaactatcatcaccttaaaatgtcatcatgttttcataacatgacaaagttataatgtaaaaatgctgaatttagtaattgaaaactgccatgctcagcgagtgatattgccaacaccaagtcctaatttaagagttagtttactcattttccacttcattttataagaaaatcttcccattttgcttttcagagaggattgtgttattatacgggcaattctttttcactattaagcaataatcaaatgctgagtttttccttaactcttatgtagttgctcttgcccaaggcaatcaatttagttaagtgttacctgtatagtcagtctaaaaaaagttgtctgccctaaagctgcttttgatgcatgagtgtaccttgttttatggggcttattgcactccacagagattgtgtgttcagtaaattaaaggtttgcagcagccctgcatcaagcaagtctattgatgccatttttcccaacagtgtctgtcacattttggtaatgatcacaaagtttctaactttttcattgttattatatctgctgaagtgatctgttaccagtgatatttgatactactattgcaattgttatgaggcactgtgaactgtacccacatgatggctaacttaatcagtaaatgtgtttgttctggctgcttcaccgactgacagtttactcatttctcttcctctgctcaggcctccctaatccctgagacatagcaattttgaaattaggccaattaataacctacaatggtctctaagtgttcaagtgaaaggaagagtcacatgtgaggaagacaggttgaaagccaagacaggctaaaagctaggcctcttctgtcagatgattagccaagttaaatgcaaaggaaaaattcttgaaggaaattaaatgtgctactccaatgaatgcatgaatgataagacagggaaacaggtggggtgcagtggctcacgcctgtaatcccagcactttgggaggccgaggcgggcaaatcacctgaggtcaggagttcgagaccagcctggccaacatggtgaaaccctgtctctactaaaaatataaaaattagccagacgtggtggcaggcgcctgtaatctcagctactcgggaggctgaggcaggataatcgcttgaactcaggaggcagaggttgcagttagccaagattgtgccattgcactccagcctaggggacaaaagcaagacttcatctcaaaaaaaaagaaaagaaaagaaaagaaaagaacgtgaaacagcctcattgctgatatggagaaagttgtagtggtgttgttagaagatcaaaccagctgcaacaacattcccttaagcaaaagcctaagccagagcaaggccctaacttttttcaattctattcacctctatgagaaacatgagaaagctgcagaagaaaatttagaagataagagcttggttcttgcggtttaaggaaagaagccgtctccataaaatgaaagtgcaaaatgaagcaacagatgctgatgcagacactgcggcaggtgatccagaagatctagtgaagatccattgatggaggtggctacactaaacaacagattttcaacgtagataaaacaggcttatattgaaagaaagttccatctaggactttcagagctagagagaagtcaatgcctggcttcagagcttcaaaggactgtctgactcttgttagggcctaatgcagctggtgatttgaagttgaagccagtgctcacttaccattctgaagatactatggaccttaaaaattatgctaaatctactctgcctgtgttctataaatgcaacaacaaagtctgaatggcaccacatctggttacagcatggttcactgaatattttaagcccactgttgagatctactgctcagaaaaaaaaaactttcaaaatatgactgcccattgacaatgcacctggtcactccagagctccgatggggatgtacaaggagatcaatgttttcatgcctgctaacacaagatccattctgcagcccatagatcaagaagtacttttgacttttaaatcttattatttgagaaatatattttataaggccatagctgccatgtaagtgatttttatgatgaatttggacaaagtaaattgaaaaccttctggaaagcattcacctttctagatgccagtaagaacattcactgttcatgggaggaagtcaaaatgtcaacattagtaggaatttggaggaagtccattccaacccccatagatgactttcacaggcttaacactttagtagaggaagtaactacaaatgtgatagaaacggtaagagaactgtaattagacataactgtaattagacatggagcctgacaacgtagctgaattgctgcaatcttgtgatgaaatttgaatgaataaggagtcacttcttatggaagagcaaaggaaatggtttcttgagatggaatctactcttggtgaagatgttataaacattgttaacataacaacaaaggatttagaatataacataaacttagttggtaaagcagcagcagggcttgagaggactgactccaattttgaaagttctactctgggtaaaatactgtctaaaagcatcacatgccacagagaaatcttttgtgaaagaaaaatttgatgaatgtggcaaatttaattgtcttatttttaaaaactgccacagacactccaagcttcagcagttaccaccctgatcagtcagtagccatcaacatggaagcaagaccctccaccagcaaaaagattacaacttgctaaaggctgagatgattgttagcagtttttagcaataaaatatttttaattcgggtatgtacattggcttttataaacatgatgccattgcacacttaatagacttcaatatagtgtaggcataacctttatatgtactgggaaaccaaaaagtcatgtgattcactttattgcaatatttgttttaatgctgtggtctggaactgaacctgcagtatctctgaggtatgcctataattgggaatagtaatgtatagatatgaaggagctaattgaaatgcaagcccatctatgattatatgccaaaaatgactgttcttgagtagttctggggggcaaaaatcatacttttccataggaacaaatatcttcaaatttgcaatgtccaatgtgataacccactagccccatgtgactaatttaaatttaaatgtgttaaaattaaataaaatttaaaaattcaattcctcaatcatattagccacatttcaagtgctcagtagccatatgtggcttgtgggtatatattggacagcatagacatagaacactgccaacatttcaaaacattctatgaaactgtgctgagtcatacctacactttttgaatcttttggtatctatgctacttaaaccacaatggtttaccttaataatggtaacttaaatacctttattctgatggaacactatgtatagtctatatatagtagaaatatcattgatctgtcacaacattccgttattacttggtccttattaccaatgtttgagaattggaatatagtaatagttgaatgaatagggagttcaaggtatggtggtcttgtgaccacgagaaagaaagaaagtgaataattcttcaacaaaaagtatttatcacttgcctactcctgataatattgggccttgtgctagacataggagaggtgatgatactagcatgaaaagcatgcagttccagcctaccagaagtttacagttacatggcatagaacaaagtcaaaagaggtaagtataatgcaatgtgctaaaatgctgctttaggagtaaatacaaggtgcgataggatcatataaggggacactaaccaaagcctggggtcctggagaatttttaggaataagtgacatctaagctgatcccagttatgaaaagattagtagaagttagagaggatggtagaaagtagaactgaggctggccatggtggctcacgcctgtaaccccagctctttgggaggcagaggtagctagatcactttgggtcaggagtttgagaccagcctggccaacatggtgataccccatctctactaaaaatacaaaaattagctgggcgtggtggcatgtgcctatagtcccagctacttgggaggctgaggctggagaatcacttttacccggaaaacagagactgcagtgagctgagatcacgcctctgcactccaacctgggcgacaaagagagagtctgactcaaaaaaaaatacaaataaaaaaatgtagaactgagaggggaaggtgaacaggaaaacactccaagcaaaagaaaatgaatatctaagaaccaagggcaagaaataatacagccatttagggaattttaagtatgagaaatgagaacaaatgctgttcatgaaggtgagcccaactagagataaaattgatttctgttataaaagtagaaatgtctcacttattttaggatttaggttgttttacaatataatttcaaaagcaaactttctccctagtattttttcagaatccatatgcacatacctattaacagtggttgggaaagggaaatatagatggacagatggcaagatctagcaattttatcataaattttatgtgtattgggtttcttccaatcttcttccattataattttatgtaaacatattattcagtttaaagttaaggtgtgtcaatggccctcctggcctgactaggaataaatcagttattagagcaaagcaactatgagcatgtaattatgaataccctaggacttatacactcataaatcataggactcaaaagctaactattattttactgtatatgttaatgatggtatttaaaaattctaaacataaaacaaaaatatttgggcttttattcagtattctttactgtatacctaaaaattatgaatttgactatgtataaattaggccttaataaacttgactttcaaaaaatcttattaaaaaacaaaaaccttcaattaggtatttacacacatgtaattttcataaatgcataaatgtaactacacttgtcttttagagcattatttttactgttctgcttggcttttccccattcttctcttttttcacacctccagccatatttttctaccttcaaatgataacaaatggaatacatagtattattccatatttttctctaagcatttttaataacgtactaacatgtttacacatatactcatgtatttatataagtcctggtcattgttggtttaaaaaataggattacattataaatactttctgtgtcttgctttttaatattctgcaaacacatcgtagaaatccttccatagcaccttgtatagctctagtagattcattttaatggttccataatgtttcctggcaggaacacatcatcattctatgactgatgaacattaccactatttccaatttgatgtcacaataaacaatgatgcactgagtattcttgtattttaatccgaaatttttatttctcttggatagattcctgggaatggaattgctggaccaaaagacatctatgtattttttaatttgaatagatgttgcttttgaaaaaggctataacattttcctgtttccactagcaatatgtgagagtacacttctccatacatctccaccagcaatagatattaagtattgccagacatttaatagatataaagcagtatgcccctcattttattttgtactcaccactaatgagtttgggtatttttcatatgctgttggacatatatatttgtactattttgcattgcctcttcagatgccatctatttttattttgcacacgctattcttttctagttaaatcattagagaagcatctgtataattttaaacattaactgtttgtcccccatgttccaattttttccaaatttgtcagtcttttcttggctttgtgaatggtgttttttctcatacaaagctacttttaaatgcttcatataaaccaaatgtctaactttacatatatatatatatacgtatataagtatatatatgcatatatatacacatatatgtatatatacacacacacatatatgtgtatatatatacgtctatgtgtatacatatatacacatatgtattctggatttaataagttggttaaaaattccttccttatatgtattacatatgctcccctggtttttcttatagggattttattattttattttaaactatttagtccaactgaaaattatttttttttctttttttttttttaattttttttttttattatactttaagttttagggtacatgtgcacattgtgcaggttagttacataggtatacatgtgccatgctggtgcgctgcacccactaacgtgtcatctagcattaggtatatctcccaatgctatccctcctccctcccccaaccccaccacagtccccagagtgtgatattccccttcctgtgtccatgtgatctcattgttaaattcccacctatgagtgagaatacgcagtgtttggttttttgttcttgcaatagtttactgagaatgatggtttccaatttcatccatgtccctacaaaggacatgaactcatcattttttatggctgcatagtattccatggtgtatatgtgccccattttcttaatctagtctatcattgttggacatttgggttggttccaagtctttgctattgtgaacagtgccgcaataaacatacgggtgcatgtgtctttatagcagcatgatttatagtcatttgggtatatacccagtaatgggatggctgggtcaaatggtatttctagttctagatccctgaggaatcgccacactgacttccacaatggttgaactagttgacagtcccaccaacagtgtcaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatgggattgtttgtttttttcttgtaaatttgtttgagttcattgtagattctggatattagccctttgtcagatgagtaggttgcaaaaattttctcccatgttgtaggttgcctgttcactctgatggtagtttcttttgttgtgcagaagctctttagtttaattagatcccatttgtcaattttggcttttgttgccattgcttttggtgttttgggcatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagccaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctgttgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacttccggtagaatttggctgtgaatccatctggtcctggactcttttaggttggtaaactattgattattgccacaatttcagagcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaaggtttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgttgtgtctttgttctcattggtttcaaagaacatctttatttctgccttcatttcattatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccccctggtgcagagctgagttcaattcctgggtatccttgttgactttctgtctcatggatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttgtctcttctgatctttgttggtttaaagtctgttttatcagagactaggattgcaacccctgcctttttttgttttccattggtttggtagatcttcctccatccttttattttgagcctatgtgtgtctctgcacgtgagatgggtttcctgaatacagcacactgatgggtcttgactctttatccaacttgccagtctgtgtcttttaattggagaatttagtccatttacatttaaagttaatagtgttatgtgtgaatttgatcctgtcattatgatgttagctggttattttgcttgttagttgatgcagtttcttcctagtctcgatgggctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctccaggataatatcctgcagagtgttttccaacttggttccattctccacatcactttcaggtacaccaatcagacgtagatttggtcttttcacatactcccatatttcttggaggctttgctcatttctttttattcttttttctctaaacttcccttctcgcttcatttcattcatttcatcttccattgctgataccctttcttccagttgattgcatcggctcctgaggcttctgcattcttcacgtagttctcgagccttggttttcaggtccatcagctcctttaaacacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggagctgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcttgctgggagaaccactgctctcttcaaagctgtcagacagggacacttaagtctgcagaggttactgctgtctttttgtttgtgtgtgccctgccccaagacgtggagcctacagaggcaggcaggcctccttgagctgtggtgggctccacccagttcgagcttccaggctgctttgtttacctaagcaagcctgggcaatggcgggcgcccctcccccagcctagttgccgccttgcagtttgatctcagactgctgtgctagcaatcagcgagattccgtgggcgtaggaccctctgagccaggtgtgggatatagtctcgtggtgcgccgttttttaagccggtctgaaaagcgcaatattcgggtgggagtgacccgattttccaggtgcgtccgtcacccctttctttgactgggaaagggaactccctgaccccttgcgcttcccaggtgaggcaatgcctcgccctgcttcagctcgcgcacggtgcgtgcacccactggcctgcgcccactgtctggcactccctagtgggatgaacctggtacctcagatggaaatgcagaaatcacccgtcttctgcgtcgctcacgctgggagctgtagaccggagctgttcctattcggccatcttggctcctcccccctgaaaattattatttagagtacaaaatgatttgattttattttcttcctgtcaattatgccaacaacattcattaaaaagtgaccagctttttagatagacaacccagaacacaaatgcatcagatcaaaacccataaaatatagtgtgtaataataattatatatgttttattactttaacataaaaacatgaaatagtcatttatttaaaattatatattattctgtattatttatttttattacaaaatgctatataaacaacaggacgagttaacagggtcaataagtagtaactgatagtagtactaattaaataatagatgtgacaaaagtataacaatattttaataaggttttttttctgtcctctgatacagcagttatttttaactctttgctgacaccgtgctggatatttacatttgtagtgtgtatttaagacatataagtgtgaaactttttaaaaggggaacataaatactacaggactaatttaacagatattaactgtattaaataacaacagcaataacatgttcttttctgtccccaaatatagtaggacaattttactctttcttctccgataatacttcaatgaattgcctgtaatttttggggcttccttttcttttattcagttgtagaactgaatatagtcaaacataaaatgcactttggtgtgcaatgctgctcttatcaagcctgcattacgttgattctggtgtcattccaatgtgatgacaccaagctaaatatactcttaacaagcatttgactataaaatgagagttcaattattagcaataatgtttttcaactcatagaaattagttccagctctccaaaaagatgtccatactctttgattctacaagctttcttttaaaggccaggcttttgtcaatcgtctttgcatctataaattcatcatataagctaaatatatctaaggtgtccaccatttttaaacactctgaagcactttggatgttattataagtgaaatctctcttaggaaaatgattttaaagcacaagagtaatttgaattttgtgaaattggtgctagattctaaagttacagttttagtaaagaaatagagaaagtctttatagtagcatgatttataatcctttgggtatatacccagcaatgggatcactgggtcaaatggtatttctagctctagatcctggagaaatcaacacactgtcttccacaatggttgaactaatttatactccaataaatatgtacaattattatgtgctaataataaaaggccttcaccccaaaaaaaaaaaaaaaggaaattgaggaagttctgtgtaacttggctaccttgttgtggtgacttactgttttattttttatttttattgtttcgtagtaaaaaagttttgaagtagttgtatttttttaatgtgtcattgtttcactctgagtttttgttacaatctacacataccatcaaacaacacaggtgcagtcagttcatccttttttatactcctatggtttttttcaaaaatcatcaagcaagtttggaaatatagtatataaatttttattttactgtattcttttctgcattgtcactcaatgtatttccaaattagagaaggacatttcttcttgtctcacactttgaaaatggttttatgatagtccaacattttagccattcatagtcatcttgtagtcatatgtctaaaggagctagttatctccttccatctctattaagtaaaaatcctcaagtttttctgcacattttgaggtaactgaaaagtgatcaaaaattttaattatgaaagctttaatatcacaggtaagcaatgttgtacacaagctgtgcagttcattttgcaggtaagatcttttaattttcttagataagaagtttatagactaaggccgggcacagtggctctcgcctataatttcagcacattgggaagccaaggcacgcagatcacttgaagccaggagctcgagacccgcctgtccaacattgcaaaaccctgtctctaccaaaaataatacaaaaattagaccagtgtgatggtgcacacctgtagtcccagctactcaggaggttgaggcaggaaaatggtttgaaccctggaggtggaggctgcagtggtctcagacgagctactgcattacagcctgggcaacagaatgagactctgttgcccaggctgtaataaatataaatatttatttttataaatatttataaaataaatattttattatatttataaaataaatataaaaaaaagtttatagactaaacaaaacttgcttaaatttacacttgcaatgtctatagaatatgcaggtagagggcaagtatctggacaaaatatcagtaaacttttgctttatgttttctgcagttttattaaaatattcataaaaatcagtgaggcgatcgagaccatcctggctaacatagtgaaaccccatctctactaaacaaaatacaaaaaattagccaggcgtggtggtgggcgcctgtagtcccagctactcgggaggctgaggcgagaatggcgtgaacccgggaggtggagcttgcgtgagctaagatcatgccactacactccagcctgggcgacagaatgagattccatctcaaaaaaaaaaaaaattcataaaaatcaagaagatgatttgaagctccatttttaaaataaaagtacctaaaagctagatgaatcagtttttgttgccattatttgacacaaaactttactgcagaaaacattcaagtaagatctgaaagaatcagctctatagagtaagaggccaacacgtctgttagcaaaattttgtccttttgttttcccacggcacattttatttgaaacctagtaatgaggaaaagtagcttcattccattttatagagctatcaggggaatggtacaataatgtatgtttcttgatgtggtatgcccaaactaactcatagccactgtttttaactgtgcattggtgtcttttgggagacacagaatcttttgattgatttagaagtattccctgtcttattccaaactatgagattcagtctgcatatgtgtttttacatcgttttcctccatcatacccaattgcaaatttcttttctgcagattgtgcagtagtttgtcttggttatttgcctccctgatccagttatttctgtccttccatctgtaataagataacattgtcatttagccttatttttcagcgatattcgggtcatgctggcattggtattataatcattctcatttttattatctgaactctcagaaaaaaaccagtatcgaaagttaaattaacattatcttggtatcgagatgataccaagaaaaccgttaatccacagacaaaggactgttaatactcatgaatacaatgtgcttaagtaacacacttaagcctcagcactcacagcagtgcaacaaggggtgattcattattgtgaacagcaaatcacagttgccaacatcagcagtcaggaggaaaaacagtgacagcaactgtgggaaacataatctatgccatatccatctgctacaaaaacagtgttgctttcagctattttttgagccgtggtatgggtttgatactaccccccctaaccttctgtacccattgccaaaaacctggatttgttgcctccctgaaagtttactcatgacatggggcttttgtgctatgactgggcattggaggcaaacctgggcaattgtcaccctagctcttcctattaagcttacatttatgagcatttccgtcaattcatctattcaatactttggttgagaaactggggctggattatttgttgtagcctcaaagatttttttggtctcacttgaatccagttaagtgctcttcttacttttctgttagaattgtaatcttccacactgctgtttccctggagtgtattctacttgttctaatttatttttccctttccgactgtggaactcactacatggattattctttttcttcgtcagctcatgaggattcaggtctagttgttgaagtagcctagggactggcagtcttgctaattgtagaaggtaaaatatcctctcttcctgtgggccagaacaaacaaggtgactccattcccctcctgagacacacagaagcagctaagggctctccagtcttctggtctgacccaaggcacaggactccaggatagggaggtctctgtccatccattcaactctttctggccagtttaaaggcaacagaacatgtatattaatggtaacaaatatctaaggaaggaagtccggaggacttgggagccacagatctctgtgaaccaagctttcctcaaacttagtttcttccttgccttccctgcaggttgcacttgttttcgcagacacacccagcctgaaggagagaatcaccagttcttttcccacatgctctacctagagccccaacctttctaaccttctgtcttccagagcccagcagccatttgtttcaagaaaaagttggcagcggagggtaaagaagctacattcagttttctattttcctagaatgcttttaaaaactttaaaaaatatatttagtattcctgataatctccaaaagaacaggcaagaaataagatttagaggtgggcataacacttcttttctaggttaaaaaattgatttttttaaaaaagttgatgtttattttaaatacattcatatattctttttgaaagtttgtgccctatgataactatgtcagagcacaaattaaaattttgacaaaataacagataaattatcataggccaacaattaaggtagcagtaaacaaaaccatatatattttaaagtcagtcttaagtacttaaacttgagtttgatcatgatttattgtgctgtataaattcagaagaattgatgaatgctgctaaattattaatttgcccaaagtgtgagaggctaccgcccagaaccatgtgttataaatattaaagccatcccatctttaggacttatgtgggcaatgaattataaggaccactgtaaatcaattctgggttaatcataactctttgcgcctgtgattcacaatcacattatcccccactgaccattagttaaaattggaaagaagtttgcagcttagtgggcaaggctagaatttatttccctcacattattctcaggccttttcatttttatttgatgaggaaaaatagattttcattattcaagctttattttaattttcaaaagctctgctttgtttcattcctaagaatcagaaatgcttagagagcaatggctacaaaatcaacaggcctcgagggtccagagtcatataaaccaaatattcattttttccaatgatcttgagaagtaagcaacctttttcttaaaagcccaatttttttttaccttaataccgtgatcatatagaactgaggaagctgcatgctttctgtggcccttgccgtaaactacatagcattatatttctttacgtaactgttgtttctcaaactccataggctataccttacaggcaaaggctattctatgtcacatgcttttgcattcctatggagaatctcccagaaatttatatttaatgtagtgcaaagagcataggaagatagccttgatctcacattccaaatctaccgcaaatcattggtatgacttagagcaagttacaattacctcacctgtgaattagatatcctatcagctgtctcacagtgttgtaaagaacaaataaatgtgtatgtaaatggcatttttagcagttgaaacatgtttggtaaatgttatctattatcataagaaataaatggaggacagagggaggattttctttagcaaaggaaattcctatctaacccttttggtttaatgtcacttttccataattgttcccactgaatgttttttaataagaaaggatcatcacttctgtgtctctgaagccatagattttggagtgagcttttaagaaatttactaaattaaagattcatgtgagaaagagtattgtcctcccgattcaaatcaaaattggtgagataacaggtagcgataagtctgtttgtggcatggacttctgtagttagtacaggaggctgctacctaatgaattaaaaagcaaagtgctttcagcatcagctcatgatggagatgtcagaacaggagcatacaggacacaagtaatctatatacaaatagaaatgtgtcataatccctaacatgttgaggaacataggtgcaggttttgaaaatgcactttcccattcttcactttacttggcaagaaatgcaaatattcaagaaaataacattgaatatttacagttcttcacctgacaaatggaaaatttcaaaaaattttaggctagaggaatgtgcataaacgagaaatggtctccaaagcatatctatgttttcaattggttaggtactattgataaggaatttaaatatttggggttttcttatacagctatttcagttaccagaatatttgagacttgtcctgattccttccaacaaaaattaatttcccttttcttttacgactttaaacaaaatctgttcatatgatccttaccataatgtgattcgtgttacaacaattttgtacttgacttatctccactactgagttgtaagcagcttgatgatgggggcccaagtcttacctttatattccttatagacttaaccttcaggattttagagttaatgtgtaatgattgttagtaaaattgaatttaaacaacaactgttaaagaaaaatatagaaatgggaacaaaacctagctcctagtgttatctgggaagtgagaaatttatcacggggagtctattgatatctcaggcactattacgaggacacaggtgctgagcctcaatagttaccaatgtcaatcaataaccatagcatcctagcatctctactttggggtctggagattgaaaacactagaggtagatatcactttggattatttttcttcctcataatgagacctggaatatgctgacatgaagctcccagattcacttttgctttcttctgtttaacctagtatgaaggactctgctggtgtggaatccattagtaaataaatcaatggcatgtgattcagttgcctgtctaaacatggcctcaagaacagggctagttgaaaaattttaagaaaactccattacctagtcagatggattgaaaatttttaggccagtccttcaattattattctgttgaaaggtgacttcagactttgttgatgagtattttatagagttttcatttgatggttaaagaccattcaaaaggcagtgattatatgttttaattgatgaaaaaggccagggccatttttaaaagctaaaatagtttgggttactatgcaacctttcattgccattgctacaggctataatcacactgttttaatgattctctttttaaaaatccattcataattctttggaacattagtattgcaagagacagcatatataatggcaaggataatgttactatacatttaagtagagctctacagttcacaaagcattgacaacaatgctagaaaacttttctaacagcaaagcaatatgtcgcctactggggaggtcccttgaggtttgtaaagaagctgccaggggatccaggaggccagactaacagtttaaaacagaagataatcacaaaaatcaaagtaggttgttagaggaagcttcaaggtcactgctactcccaatcactgtaaatttagacctagggagctataagcaggtctgcaagttggttgcaaagatcagagaaaagaaggaaactatgggataactctgtgggtgagaaatcaatgcagacgaaacctaaccaagtgtttttccttctctcacactaacactccaagcatctcctagttttataattatatcaagccccacgtatataaaattgtttccgatgatattactcatttttttatcatcagcatcattagtaataaaaaagtggtgtgcataagctgtcaggattgttaaaatgcatactcccaggccttaaacatcaaacatcatcatgcagtaactttgggattagatctagaatctacatttctaacacaaaaatcccctagtaattctaatggtggtagtcttcgcatcacattgtgagaaacactgaccgatagcacctaaactagggtctagggtaccacagacactccatgagtaatacttgaattaaatgctttctttagggaaaaaacttttgtctgtttcaatacctcatggtttggttggggttcacctcaacaaaagacagtaagtatccactgagcacagttaactggactgaaggttttaggccattcattgtttcatacaaaactttttattgggtatccaatattggtgggatctaagcaaatttattaaaaggcaacaattaaatatttcttctatatttgcttcctttacctttatgttttgatattccattcttttttcagtaccaaaaaaagtctcgcatgttcttctagtttttcttttcttaaaacttggtctttaaaaaattatatttaatttattccactacggaaatttattttgtgtgatgtgacatagtgctctaatattgacatttttgcaataatcacctgtctcacgttttttgaatatttcatatttgccacactgatttgatttatcgactttctaatacagtcttttttttaaagagaggtaaaagttttatgatggcagatgattcttttttttattattattatactttaagttctgggatacatgtgcagaacctgtgcaggtttgttacacaggtatacacatgccatggtggtttgctgcaccaatcaacctgtcacctacattaggtatttctcctaatgctatctctcccctagccccctgaccccccaacaggccctggtgtgtgatgttcccctttctgtgtccatgtgttctcattgttcatgtggtgtttggttttctgttcctgtgttagtttgctgagaatgatggtttccagcttcatccatgtccctgcaaaggacacgaactgccagcaattccattactgggtatatacccaagggattataaaccattctactgtaaagacacatgcacctgtatgtttattgcagcactattcacaatagcaaagacttggaaccaacccaaatgtccaacaatgatagactggataaagaaaatgtggcacatatacactatggaatactatgcagtctaatacagtctttatataacatttatatacttttaaaaacagtaaacttttgttctgttccactgattttctattcttaaatacattttgtactgttttatttttaagctttataacatgtctcattacttggtattctaagtctctgataattattaattttttaattttcaaaatttcattactattcttgtctgttttctcctaattaaatttgcaaaggtcttaagaggttctaaaataaccttcaggcattttatttagaattacattttgtattggagaatctgaggaaaatttaaatgtcttttgtaattatgcatctgcattcttaggaatatgttatgtctatacagaaacttgttcaagttgtcttcagtcaggtgttaaggtattcttcatatagctcctactaatttattgttaaatttctctctatgtatttatatttaatgtacatagatatttttactcaaactatcatctcattaatatattaatagaaaagcaaatcatttgtatatatccatttatgatcaatctatttttttaatctgaatttttaaaatactttttcacttgattctggtgggcttcttgaatatatcatcaaataatgataattttgtctctactggatgataattttttcctaatagattgcaatcatagttttgtttccatccttttttgcataggataaagttgttacaataatgttaattttggattactagcaagcataattttctttactttaatggcaatgcaaagagagtttaagcttgtaataggcttgctgttgtttgaagtattctgtatctcattacggattttttttcttcctggtttaccaatagatagataacaggtagacaactgtttataattttgccaagtatctttcttgtgtctattgaaagatcatttaaaaattttataaagcctcatttgtaagatatgttgtcaccccagtaacatttctaatactgaaccaatgttgcttttccttgtttaataatgttacattattcttttaatataagcaaactaaccttggagtttaactattacttctatttattttatgaatttcttaagtccatttttatatgtgaaaaagttgaaaatataccttattgagatgtttaggatagtaggttgggcttttattgggtaaatttgtgacttagtgtatgagtgattactgaggggaaaaaaaataatcactaaagacattgtaagtgaaccagagtaaagttgtgttccttaagtgatgatagaggaggttgtggaatcgttttattttcctcattgcaatgcccaccagggagttttcttctaagttcagctgcaagatatccataggccacatgtgacaatagattaatttagaaggacacaggacaggagatatagctcatcagcagggcagcattgtcattttttcttcaatgtgagttgtacttgcagctttcatttagaatagggatcacatgcaagatgatacctatactgagtgagtacagaagcccacctggcttagaagcctagtaacccaaggcgtcagtagctcttgtcataaccccaaaggcatagctttcagggtccccagaaggggcagtcccagtcacatgaatcactgaactggtagaagcacaaagacatggcttcctttcatgcattttttgttctctcaatccaaatgacattttccactcaggggtcattttactataagcaacgtggcctaaaagtatagtaaacattcgacctttcccatgttttcagaacagagatataaattaaccaaagtacaaattctcattcagaataaaagcttacttagaaatacagtctgccctccatatctgcaggttctgcatgtgcagattcaaccagccatgaactgaaaatatttttaaaacacaatagagagtaataatataataaaaatacaaatgaaaaacaatacagtgggccgggcgcggtggctcacgcctgtaatctcagcactttgggaggccgaggcgggcggattacgaggtcaggagattgagaccatcctggctaacacggtgaaaccccagctctactaaaaatacaaaaaattagcggggcgcggtggtgggcgcctgtagtcccagctactcgggaggttgaggcaggagaatggcgtgaacccgggaggtggagcttgcagtgagcggagatcgcgccactgcactccagcctgggcgacagagcaagactccgtctcagaaaaaacaaaacaaaacaaaacaaaaataaagcgcaacaactgtttacatagcatatgtacattgtattaggtatcataagtaatctagacatgatttaagtatactggaggatgtgtagagattatatgcaaatactatgacattttatataaggacttgagcatccctggattttggtatccacaggggttctgaaatcaatccccaacagatactgaaggatgattatatgttctattatttttagcataattaaatatataccaatgtaatgtttttcatcctgtctatgtaaattaaaattccaactttaaaccctatttcttcttttgttcttcattttttcacaggtaaaatatggaaattatgctttcgtatgggatgcagctgtattggaatatgtggctatcaatgacccagattgttccttttacaccattggaaatactgttgctgatcggggatatggaattgcattacaacatggcagtccttaccgagatgttttttcacaaaggtaagatttgtgtatgaccaaataaggggagagatgaaatttagacaaagaatatccatttggttaccagatctggtttattacattttgtttcctttgttaggagaagcacaataaacaacaacaacaaaaaagatagttataagtagttgttcaataagacactcattacctaaaacatgaagtattgttttttccataagtagcgggaaaaataatgctacatataactggttttactctcaaaaaattgacatggaaaagaaagtaggtgtgttagtaatttctattagaattaaactagtagtctagtctgaatttttagcaacaaatgtcacagagttaagaaaatgaattcattctgaggatacaaaagcataacataaacttcaggaccaagttaaagctctgatggactgaagcagataatgacagggatgtttccacctgaatttttcaaaggaaatggttaagattttggagttccccgcttaacatcaaagtatatgtgagattttgtcatggaaatcaaggagataacttattgagacattatatccattttcaaatcagaatttctatgatgaaggagttgtttacaatggaagatttttaaatatatattttagattaacaatgcatatgaaagacttgggcctcaaaggagtgcacaaagattactgcatttcattatatctcctaccaaacaagcttggacctaagacagattaatatcttccacatagaagtatatccattttatactgaaagtacattttgtttattttctagattttcttctacctattctctagaatctaatgacagtccaagaggacagttccagatagtactaaggccctaaatttcaaacaacttgagttatatttctccaaattttaggataacaaaaaatccaggcattttgtgtgtatgtttttttttaaaagaactaaaaatcagtagttcacaatttgtgtcataactcttccattagcaaaccataaaaatctaaacctctctcatgacatgcaaaatgaagttagattaattctaaggtcctgtactagtcagcttttctgtgtagcaaacaactctaaagtataagtgatttagaaaagttacttctcattcatgaaacaaggctgtaatttggttgtgttatgcttcaagctgtgggtcaactgcagtcctactctgtgcaagcttctcattccaaggcccaggctgaagaagccgacctaacagggacatgctgttctcattgcaaagagcatttgtaaaagaggctggcagaaacctgcagtgcctcctgtgtttcttgcttggatgtggcatatgttccatctgcccacagatcacaaaccaaagcaagtctcatggccaagcccaaaatcaatagagtgggtaaatgtaccccacatatagggaaggaaggagtaaaggattatgaataggctggacgcagtggttcacacgtgtaacctcagcactttgggaggccaaggcaggtggatcacttgaggccaggagtttgagaccagcctggccaacatggagaaaccccatctctactaaaaatacaaaaattatccaggtgtggtggtgcatgcctgtaatctcagctacttgggaggctgaggcatgagaatcgcttgagcttgggaggtggaggttatagtgagccaaaagtgaaatacatatgcattaactgggaagcaaaatactaaataataatcaatcaaaatacatttattgacgagcaaattctaagaggaacaaactacaaaaatcaattatgccatagggaatccgtctgtaaagcacttggcatctagttggagatataagacccatgcacaagaaacaaagaacaatatagacatttctataaatgtgtgttgatatatatgtatataatatcagtattatttatttatattattttaaattgtgtagttaaggtactgaaataattgaacagcatacagagtagttaagcaaaggaaaatgagtgaaagctctccagagaaggtaagcctggaacttgaccttgatggggcaaggggaaatacggagaaggaacaaatagaagagacccttctaagggaagaaacacaccactgcttttaatttagttgtgaggatggaaaagcataatagaatgaaaagggatccagggtttcatggtaaaagaccagcagaaatgtttaatgcatgcttaacattacagagctagttgagaaaaggattattgattattgattagttatggttaattggctttttcattgctaaagatgttcttgcttttcagacttgattttctggctttttttttttttttgagacattgtttcgctcttgtcacccaggctgcagtgcagtggtgcgatctcggctcactgcaacctccccatcccgggttcaagtgattctcctgcctcagcctcccaagtagctgggattacacatgcacgccaccatacccagctaattttttgtatttttagtagaaatggggttttgccatattgggcaggctggtcttgaactcctgatatcaggtgatcctcccgcctcagcctcccaaagtgttgggattacaggcatgagccaccgcgcccagcgattttctggattttttatgtaaaaaataatgcatgaacgtaatagtaattaaagaaatgtttaataaatcacaccaagtgttgcatttcttattagccctgcagtgctttacctatcagagattttaattctcagaaaatgtactctagtgaactgctaaaaagtattattaagcattaagcattatttttcctttgtttgatatgcagtacagatgttggcagtttaaattgtttctttctgtggagtttcttggtaacgacaccctgcatcctgattccctggacatatggagaaaaggagagccaggaaagaagcaggacctggcgatcatcagtgtgccagctcctctctttatacacatgtgccacattaatttatcacccaaaacctctcgctaaattcagaaaatatttgcatttgttccatttttttatagccataaggaaaaagagatcttccctttctgttaactgattttaaaaattataaagatcatcaaatttaaccattttagtacactgtggtcagtatgttttatacatcagcatccggggccattgatattacatattactattgtgattattttcactgaaaatatagtatactaggtgatttttaataattcaatattacttttcaggtgactatatttctataacacaacttctaaaatattaagttactttaatatgtaataaatattagtatgtaaaataaaaaatatatagtgatacagtaactacatttattatctgctacctgccagacgtcttatatgtttatatatttcataggcactttagaacaatcatatgaggcattgcacatttgttcattatagcattgcttattagtgcatgactgctatgctacaagtacatacactgagtggatgagtctgcacctggacaagcatcaaattcaggttcggagacatgggttatatcaatacactcacatgtatgattgtatgtgagcgaacacacattggaatgacttcaaggaaccagtaagtgctagaatttatataaccatagaaatggctagaagagttttgcttccttttgtgtcctttctgcacataaactagataacttggcagcagaagttaaagtcagtctttttttttggtcatcagatgtgtgcgtgagtgtggtaagtaaggcttgcagtgaattctctacctgacacgatttgtcatcagatgttttatgtggttctcatcttgtaacttcttagtttaaaaacatttagtcatatgttgcctcattaaaggcattcaagaatgaagaaaactgaatttttcgggttgacttcattgtgcaataaataaagttaactccagtgttgacttcagaatcttaacaatgcagaaagctaaaaagataaccaaaaagtatgagctcaagtctattctcaaatcttaagtggatattgggaaaaattcattagtttaattttatagttcatccataaagaggtcacattttgcttattggcttctagaccctaaacttgggatatagaactacccaaagtcacaaaaacaattacgtgttccaagttgcatggagaataatttttcttagattcatgatagtgacacatatataaacagttgttcaaactaatcgcagaatttgagaatttttagaaatggaactaacagtagctatgccctttctgacagggatgaaagtagtccacaggaataaacaacttgcttagaatcacaaaaaaaagcaataaaattggaaaaaattcaaaatttctgatttcatatccagttttctggtcactgtacattctgtcttcccttatatttcttctaaaagcatataagaataatgtcaagcttatattcttatattgtccttactatatgctagactctcagctactacacataataacccgtgaggtaaatactgttgctgtcctaattgtacagatacagaaactgagacatcatgaagtaaagtaacttgtgcaagttcaggaagctgtcgattattagagctgagactcaaacccagagtctggctccaaaaactgggtctcttaaccattctgctatactgcgtttcacaaaaatgacacacacttttaacaagtgtgtttcaaataaacacttagggattctcttttttttttattattatactttaagttctagggtacatgtgcacaacgtgcaggtttgttacatatgtatacatgtgccatgttggtgtgctgcacccattaactcatcatttatattaggtatatctcctaatgctatccctccccactccccgaccctaggacaggacctggtgtgtgatgctccccttcccgtgtccaagtgttctcattgttcaattcccacctatgagtgagaacatgcggtgtttggttttttgtctttgcaatagtttgctgagaatgatggtttccaccttcatctatgtccctacaaaggacatgaactcatccttttttatggctgcatagtattccatggtgtgtatgtgccacatttccttaatccagtctatcattgttggacatttggcttggttccaagtctttgctattgtgaatagtgccacaataaatatacgtgtgcatgtgtctttatagcagcatgatttacaatcctttgggtatatacccagtaatgggattgctgggtcaaatggtatttctagttctagatccctgaggaatcgccacactgtcttccacaatgattgtactagtttacagtcccaccaacagtgtaaaagtgttcctatttctccacatcctctccagtacctgttgtttcctgactttttaatgatggccattctaactgctgtgagatggtatctcgttgtagttttgatttgcatttctctgatggccagtgatgatgagcattttttcatgtcccttttggctgcataaaagtcttcttttgagaagtgtctgttcatatccttcacccactttttgatgaggttgtttgttttttccttgtaagtttgtttgagttctttgtagattctggatattagccctttgtcagacgagtagattgcaaaaattttctcccattttgtaggttgcctgttcactctgatggtagtttcttttgctgtgcagaagctctttagtttaatgagatcccatttgtcagttttggcttttgttgccattgcttttggtgttttagatatgaagtccttgcccaggcctacgtcctgaatggtattgcctaggttttcttctagggtttttatggttttaggtctaacattgaagtctttgatccatcttgaatgaatttttgtataaggtgtaaggaagggatccagtttcagctttttccatatggctaaccagttttcccagcaccatttattaaatagggaatcctttccccatttcttgtttttgtcaggtttgtcaaagatcagctggttgtagatgtgtggtattatttctgagcgctctgttctgttccattggtctatatctctgttttggtaccagtaccatgctgttttggttactgtagacttgtagtatagtttgaagtcaggtagcgtgatgcctccagctttgttctttttgcttaatattgtcttggcaatgcgggctcttttttggttccatatgaactttcaagtcgttttttccaattctgtgaagaaagtcattggtagcttgatgcggatggcattgaatgtataaattaccttgggcagtatggccattttcacgatgttgattcttcctacccatgagcatggaatgttcttccatttgtttgtgtcctcttttattttgttgagcagtagtttgtagttctccttgaagaggtccttcacatcccttgtaagttggattcctaggtattttattctctttgaagcaattgtgaatgggagttcactcatgatttggctctctgtttgtcttttactggtgtataagatctctttctatctctctctctctacacatgcatgcatgcacacacatagacacacaaagagtagaacaaatcacaatccttggtacttcacaatactctcataatgggtccataaatagctacttttattcatttatttgattagttttatactccttagttgtagtcttttttcctataaactattagaatatttaatttaatattataactataagaatttttttcctattaagtattagaatatttagtgctttactttgtatttttacaagtaaaaatacaaattattcaaaaaattattcaaaaagagaacattagatctttttacctctctctatcttgatacttcttacactttacctcttgtttcctacctcctgttggaaagctcctgagctccttgagttcacacgtgtgtttgtacatctctagtgcccactttcttgtttagcatgcagtaagcattcaataattatttcatacatgaataaaagatctacttaactttttggctaaagatcagcccatttacttacagccagataaacctctgtgcattttgcttgcttgataatttctaaagtcttccttcttatcataattattttttctttcttggtttctataatttttcatccaaccaataaaaaagctaagaaaaaaaatctaagaagaaaaagaaaacaaacacagcacctgcctacccttctttccaactccctgctgtaataatttttatgctttttcccacaaggaaagtaaaaaacattcctttaacttgacagcataatcctaatcctttaataccccaattggaatggggtgctttccaagcattctgttcaccattcagcaaggggaaaaaagcagcccccattgattgcccacttagtagctccaggattggtcaacaaatggcttaagctctgtattcagctggttaaaagaatctctcagaaaggtacataaaaccagaagttaaacagttaactggcttccctttagagatgcaaaatataaactagccccaagctctgagagcagaagtgacattattgagacacatttgtaaacattaagcaatatcaaagtatacattaaactatatagtatagacaatacttgcaggaaaaattttaaggaaaacaaaatcagtgaaggttagaataaaaatggttactagacttgagcagggagaattcaaaaataaatcgaatttggatatgagagcaggtgcaggtaaaatactcaggaaaacatgagagattcacataaataaaaacggccatcatgtgttgaaaggatgatgagaaggaacaacttcactggaaataatattagttgagggatttaggtagagaaactaaaattgaatgtgatagactatcaacagctgctagttataaagcatctactacactaaacacttgatatgtttcatataatgcttgccacaactctgtgcattgcatttcataaatttgaggaaactgagcctcagacttaaatatcttgccaaattcacacaactaataacaaacagatctaggcctcaggttgaagctcgtgtccttatgcagcaccgttcaccagctttgtggggctctgagaagagaaatatctgtacagacgaggatttgaggagtctgaggtgttaggttagcttttaattgaagaaggccatttgcaagtattctagctgggaagcagtaagaatactacaaaagaattaggaaaagggattagaaaaaaagataagtttggagaaaggatagggagaacttggtgaaaaatcaaagaagtgcataaaatccaggaccctgaacaagaaaggctatgcagatttaaatggcaacaaacagccccctcttttctcctacttcttccagctgtcttacttctccttttcttggtcatctattacaagtttgcatcagctgtatttcatcatttttagaaaggcagtgattatttattttaattatgatcatttactacccggtaaataaataattatttctaagaaccatacaacctacagatttctattctgttgttgctcacatcacagtaacatattcctattggtattgttcttctctctcacaatacatcagacttttttttaatttatatatatgttttatttaattttatgtgtgtatatatataccactaacatcagctggtttcattgtatccacattttctgttccagatcaagaaaacaagataattaagatgggcagataattaagaaaggagaacatttgaagagtctcaaaataaaagcaagaaagaggacactgaaggttcactctcaaagggagacaggagtaggatgctataataatatatatattatatatatttatacatatatttttgctttaaaagaataacattttatgctataagatgtgaaaggaaattgttttcttttctcatataatacacatctatttagataaggactagcctctggaatccatacaaaggaatatgctattcctatttcagagcaacctcctctttaaaacatctgttttgaattgaggatttttaacttaaagaacttcaataaacaagaaaaatgagtaagcttttgtctatcattctttttctgtttcctgaatccttgtggagctacttttatgacggatatcctatgagttttagcaagcaccctgactgctacttctagtggagaatccaaataatttacatttattttagagtttagtctaaatagatgacagaataagtatagttagtgatatttccagtatgtgaatttttcaaaaatatttatgggctccatatgatttgagattagttttattagtcttgccaaactgtagccaaattttaaacaattataaacctttactctcaagaagcatatagcattctcactgctaagcacaaacctagacatcaaacagcaaccccatggggtagatttttaagtgatacaaatttccattcttcttgcactacatcatacagcattcagggaacactatattcaagatgcaacagtacccttaatgaacaagcatctttattagatttttctgagataagtcctgagctacagggaagataaatgactagtgcaaggtgcaaggcagtatttcagctggataataagcccatgatgctggaccaagctgcttttcaagcagcaagtctgattagcctttttacaaataagatttgtgctgtttctagatctcagtaaatattgtttattcagaaacccattggtttacaaaaagcatagttattttactgatataatctaggtgttactaaaggctttttaacaaaatattccagaacttaaaaccacaaatttacactgcacttgaaaatacacacacacacatgcgcacacatacacacgcacacacacatactctccagagtaattataagactctctccaaaactcttttattcccttatagttaaatcacatttttaacactcaaaacactcattctactcaacaaacataacgtcaagacactttttactgtttgaaaaattcagtctacttttaaaaggaaaatttgatgtcatcaaaaataatcaaagaacatgctactttttcataggtccttaaaatattgtaaacatagtgacatcatgggaataaacgtgtgggcttacataataattatgtctatagaggaaacaatcatagattttgagcactgagtgagcctttggcatgcatttagataactctctaatttttcaaatgtgaaaccaagaagggaagtggggtgccctgcccagagtataacccttggttaaaaccatgccctggagaccactagtccaggctcccagtccagtgtcccatcccctgccctgttctgccagttccttttgtttaaaaaagtcagtttttatccctaaaatttaccagtaaaatatatgttttcacaaacatagtcatgtcaatatattacataaaagagcaggaatattcattaggaaatactttcaacagggtcacaaacataactagaacatctgtttaaaaattgtcattacttcatagacacaagaaaatgtagcacaaagatgaatagagtgctttggaatgtgttctctaacttataaagaaactatgctgtagactaaaatagtagtcgacattcattgaaaactcaccaggtgccaagtatcactataaaggccctaactatgttaaataatttaattctcacaataagcttgtgaggtaaatattattagtagctttattttatagaagaggaaactaaatcacagaaatgatttgaaattttccaaaatcctaaaactgataagtgacaaagccaggctttgaacccatgctgtcaaagacaatactatcctggctcatattcccacaagtctaagaacatgcaccagtgctggaaaaggataataaggatctaaattgtcttcatgactgccgacatggctgtcttccttcatattaaaatgctgttgggcattttagtttaaatgaaatgcagaatattttcagaaacttaaatggtatgccaataacaaagggtcctccattacagggagggagagatccatctgaaattgaaactgtcttgcatcagctgaccagaagtaaatatattgaaaattgaaagctatgggacgatactgaaatattttcccttcctctcatcttcttttgctacaagttagtttaagactctacttaatcaaaactttaattcttccttcatggaagttttaattcatcattacattttaattggtggaattcgtaattgcctcttatctatcccatttcatagttctttgagcagctcaaataaactaacatcataattggtcagacagtctactcacatgttaaacgtttactaatatgaaacagaatctgatacttctagacatgaattattactaagataaaaatataagaatttttatatggaataagagtcattattctatatagcccaggtaagtctaacataagctctaacgatttctgtctttgtgaacgtagttctctgttttaataccaatttcaaatagagaaatatgtacctcaatgtgttcatttacttttttcataataatccattctgcttctgtcattttataaagctctttattttttaaatgttagtaactaatgaaaatgatcaaaatcaacatgtttttattttgtatgttgctgcctaagaaaacatatttaaaacttgcatcttttttttttttttttttaattatactctaagttttagggtacatgtgcacattgtgcaggttagttacatatgtatacatgtgccatgctggtgcgctgcacccactaatgtgtcatctagcattaggtatatctcccaatgctatcccacccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatatccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggttcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagcggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctgtccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggcatcagaatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcacttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttcttgaggagtatctttgtggcgttctctgtatttcctgaatctgaacgttggcctgccttgctagattggggaagttctcctggataatatcctgcagagtgttttccaacttggttccattctccacatcactttcaggtacaccaatcagatgtagatttggtcttttcacatagtcccatatttcttggaggctttgctcatttctttttattcttttttctctaaacttcccttctcgcttcatttcattcatttcatcttccattgctgatacccttccttccagttgatcgcatcggctcctgaggcttctgcattcttcacgtagttctcgagccttcgttttcagctccatcagctcctttaagcacttctctgtattggttattctagttatacattcttctaaatttttttcaaagttttcagcttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttcaccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgcccgttctcagatctccagctgcttgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttccaggctgctttgtttacctaagcaagcctgggcaatggcgggcgcccctcccccagcctagttgccgccttgcagtttgatctcagactgctgtgctagcaatccgcgagattccgtgggcgtaggaccctccgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctccccactaaaacttgcatcttaatgatatttttaccaatgttccatgagcaatgtccatggcatgacagaaaggaactggcacgctaaaaaaaatcgtgagatttctactctgtaaggtttttaatctttatccaaaatagtggttttgatagtaaaatttttgttctgatgatttttctcaattttctgtgtattttccattaatgaaccaagatccctttagtactccctaaaaaaaccatcgtggcccttctagggagcctcttatattcttggtgctaatcagcatgaattttactagtattaatttcctcttttctgcatgtttttagcaagtgcagaaatttgccaaacaaattacttcttaaccagaatgtattcagtaaagtgactcaaaatcattcattaaggtagatgagaaaatagactgggtctcagaggctgtaaatatcagaccagcctgactcaatttaggacaaggggaatcattgaagggtttagtaaagcctagccataatcagaagcatgctttttgatcagtttgaaaaaaaaatatgcaatgaaatgaaaggaattgactagacgagagagtaccacataggaggccatgctgtatctataatgtctccaagaaggcagagatttgtgtctgttttattcagagacgtattccaaagtgcctggaagaaagcctaatacataatagctgtttgataaatattagctgagtgaaaaaattcatgaatgaatgacccaggcaaagtcaaaggcctgacctggagtgaaggcaaaagaaatgaaagggaaggaaaagatattgtgaacttagtgttgagcatcaaatggacacagaaatcaacggaaagaggggagcaaaatcattttgaaatctttagcctcaccggctgagagatcaagaagtcattaacaaaagagaagccagaagaggaaactggtttgagagtgaaagtgctaattttggtctaggtatgttgaacttggggcaccagaggatgatatacccatataaggaaatgtagggaatatgacaaagaaatgacaaagtagggtgggaatttgagagagaggctggagcgatggttattgacttgggcaaactctccattaaaacagtaaaagccaaagatagccaatggaaagggcatagagataaaaagaaaaaggttgaggcaaaaatgtgttttcaaatgtctcttttttgcattcctattctttccattccatggtcacaaacctaattaaatctcttagcacatcatgttgcctgtctcctggatacctgggtcatccctttctctccagactattcacatctaatacattttgtggacctcaccttatgaccagccttaccataaggcttctatagaaaattcagctctttattaaatttccatgttttatcttccctgtaccactgatgtcacatttttgttaattaatcatttcttgtgttcatacttgacatttcaaatatattctaaattcttagcttgcaaagaattacaaaatctatcttacacttcctttttcatcttccataataaagtaggtgttcaatgaatttttgttaataatatttgagggggaaagaagacaatcctatcatcactatgactactaaggcaagcagtttactagagattagaattcatgtttattcattcaatcagtaaatatttattgagcagttacttagtgcttgaaactctttgatttatctagagataaaacagtgaacaagactgacaagattattactttcctgaagcttacattttactagcaagtcagaggaagacacagacaataaataagaaaacaaaataaatgggataattttatattggaaaatttgccttaaagaaaatataactgggacagagaataaaggtagatcagcatgggggtgggacacagaagactatccaaaggagggaacattttattacaacctcaaatggaaattttggaggaagaatatccaatgcataagaagcaacagatataaaagccctgcattgggaaccagctgggagtgtttaaggaatgactaggaggccaatgttgactcaaagagagggaacaaacaaggcagtcatataaaaggagattaaagagttagttgggcccagatatacaatagaaccttgaaaaacatagtaaagacttaagagttttttctaatggcaaagacaagccattggaaatttttaaagaagcattttttacctctggctcttaaagtagagaaagatatatggtgagaaggagagagtgcagcagaggcagtgagcaagagtgaatgtagtaagagaagttaggaagccagtgcagtaatccaggagagagagggtgatgactcagtctagggtggtgtaattgagatgtgaaagtggcagctacaggtctctcatagctgtgaaactgataggactggaaactgtttggatgttatatgatgggtgaggtaaagagagaaatcaggataagcttattttctgaacaaataaatggatgatggtatcattaactgaactggtcaagcatgaacccaaagtaggttaacaaacaagggaaattaatacctcggctttgggtttagtaagcttgagatttttattagacagattaatctaagttataacagatgtataaatgtgaaattcaggagaaaacaaaataaataaaaattacaatttgaaaggtagaaggtacttatgaaagatttctgtgttagatgaaggactttgagcttgatgatgttagagattagtagttattaagggatgcttaaatgatctgagagatacactgaagtgggtgggaagagaatcgaagcagaaaaagataggcacctttttataaagttcctaaattctaggaatgagaatggcaaatgacttcattatacgcttttgactgtaagaaaggaaatctgaaatcaaatgttcctaagaaatttatctcacatagcgacatatttaatgatagaatgggctccatgattgctcaattcagaggttcaacaggacaatgttctcaagaaccgaagttcttttcacctctatactcatccatccatggtgagtgagacaaaactgtcctcaggcagacctgccttgtgacagaagtgtcctgtccacagggacagaggtaatatagttccttgttctcattcaggagaaatctcccctctcaaccagaaacagattaatataactctgtctcttcagctttattagttcatcttaggtcatatgtttacccaaatcagttcatcttcttaggtcacaggtttaccacggactgagcagatccacacaagaatatatactgatggcttagactgtgtacctaatgggatggaagaaatgttggaaggtatactatactataccatacctatactataacattccctacaactaatttaaagaattgacagataatagagaatataaggaacaaatgaaaaagaattaacacccacaataaaatagctatcatttattgcacatttattaagtgccagctacttttctaaagtttttacatgtactaactcctttagtccttataacaccccagaagagctgctattatcgtttcattttatagtcaaggacactgacacatagagtagctactcaagttatagttaataaatggctgagctaggatttgaatccagacaaatctgacttcagctgtcatgcccttaaccagtttgctctagttaaatgaaaatagaaagagggacgataccataaactcaactggaaaattataaacaggaacatgagaagggggattgtatgggaaggaagagtatgatattggtttagctatgttgaatttgtaatgacatcaagaagtctgaaaactgtggaacgtatgagacagaaggttgggtaagatggaggaaagaaatatggatttaggatttatcaataaaaagtaacatggggaaaaatcaagagaaactatgtgcagagaaaaaggaacaaagcccctaaggactgatattaaaggaaaaagaggaagaggctttagtaaagaaatgactagaaacatgccttataagtaatgacagcaaactatgaaatctgtacatcctcaagaccttgagcaatttctgtacaaagccattgttgaagggctatttcttaaatgagagaataaacagctgctatagaccgcttcggctcatcctgtgtttcctcactctaacacaatggttctccatttttagccaagcatcaggatcacctgaacggtctgttaaaacacatttctgggctccagccccagaggttctggtttcgcaggcatgtataatttttatttctaacaagttccaggtgatgctgtgctgctgatctagatctagtccacattttgagaaccactcttgtaatacatggtctttgacttctttgctcttattctctcccttgtatctttttcttgcttctttattctcttttttttaccatgttttttggatttcatatgcaaacacatacagttgctactactctacattattttatttaattcttgcaaaacatcactgagagaatgattattgtgcctgtcttatagattataaagcaaagcttagcacaaaggatagatactttagtactgaatcaataaacctaaattatacaacagactaacattctaatttctttttgaactaatattccccaattccacttatttcctttcttctacttgatcaaccatgatatcatcttcaacaaccaaaatcattttttaacggctattttgaccatatcacataatttttaaaatcgttctgtgcctgttgttccttttgcctgtatagaatccttcttattgatcaactcatttctctaacttggcctaatgtctcaaacagtgctttgcctataggaaatcaacaacatgatgttaactaatgcattgggtagcagtctttcagactttcacctaagccaatatcctacttggccactctccttatcccagtaaagtttcatttatttttttcttttattaacataataattatttgacaataaaaactttgccttttatagtcattaaagcttgtttggttttcatggagggtgaagaagaacttactaagaaaagtttttttcacttaaagaaggaaaacaagtctactatattcccaagtctatactccgagtattttctccctgcatcacaccataaagtctataggtctcttgataacttaaaatcacagaaccataaactcaaaactaagagtgatattttatcatctgtttcaaagccatctttatccaggtcactgtgaggaaatgaagtctccaagaggagagatgaatgggccagagtcattcaggtacagcctgacagagttagagttacagaaaatcccagatttccctattatcagtcttgtgtaattctttctgtcgcataactttataactccaaaatcctagtccatctccaaaacattatgatgttcagaatgtgactagctacataggttttgaatcaggcactatgaagataaaaaaaagaaaaacagaataaataaaaagaatcctacaagtttcctcccccagctcaccttgtatatgcctttccccaccaccacctccctgacccagccccccatctgcattccaaggcactagggtactcttggtgcctgcttctgtgagggccttgattcctaggctcacacttcctctggttaactcctgctcaatttcctatctcactttaaatagcctgtccctaaggtgaaatccagccacctttattgccaacttccaatgcctttccatagacagaaagcagccctaaggatatgttccaaaattcactggaaagtggggaaaaaaaataaggacaaaatcatcagatgttaactcaattacctcaattaaaagaactgtctttttttctgagattatatcctttttatatttggggaattatatgttattttatttatgaaaaagcatagatttttttttaaaatacctcaatgaaataaaagttgagcaacctctgtcaatccctccaactttttttcctgaaatttgaaagtcttggaatgcatattccttactcaaaattactgtgcaaagattcagtctagaaaaaggggcacaaaaataagaaatgtgcaaccaacttgctgtacaagaccctctgttttaattcctttttaaagcaacccagtgcttgtatagtggtgtgtgaaacataggagtttctaagcaaatgctttttagattccttacacttaaaaaaagtcctttgggatgttttatgcagaatgctacgtcctagtttaaatctaagaactcttttgaccttcagtgcatgtagaaaaatgtaaaaaataaatgagaaaattaacctgttcaaagaaaagctttaaaaaaattcttcaagcagagcttctccctgttatcattgattaaaataagaaggggaacaaactgaaaggtttaaaaggagttgtcccttaaaatattttatatacatactgcaaaaaaaaattcattctgaaaacaaaggcttctagactcagtttactgaatgcgaaatgatcagactcgtcttattcagatgtgaaggtgaccatttgaggtctcaaatagccattgtaaccaccctgcacaaaatcatttctctgaaaactggctacctctaggacacagattctgcatcacctcacaaaagatggtagtgaaatccctttaggaaatatttaaataatgagccaattcatattcccttcagagtttctcatatcttttgtcaacattgaaaatccatcttatccctcacagcaaacaaccacttcatgtgtttcctaggggttagactgttccatttcctttccaccaaagatgaccttgtgtacaggaccagttttgcaggcagcacaagagagttattctttcgataacataggatttaaaattcaggacagctaaatttcataggaagagctccaaaaggatgtggtcacttggtggagcatatactgtacacagctgataggcttcacaatgaaacacctggtaaagcgtatctttgaatccttaagcttccctttcttctgcatctttacactttggaaatccatgaagctgctgttaggcagagcatttaatggggatcttgcatcacctcaatattcccacttgtatgcctattttgatgcagtcacactacgagtctaatatgaaaaataacttttaaaaggcaatgaaaatgtaagtcaacctaaaaggaacatatatactgagactggtagattcagccatgcattatgcttaatatgttttaagttaacgtgaacttgtttgaaaagagatagaaaaatatatatacaaactagcagtgtttcatcccatttaacaagtatttgttaaccacctactaaatgccagacactatggtaggctgtggagctatagctttgaactatacacaaccccagcctccaaacctcttgctctctagaaggaaaggtgaacaagtgaatgagctattttctgtttggtgtgataggtgttttgggaccacagggaagcagtgtagacctcaggtgaaaattatcaggaaagcttcctagtggaattgatactggaaagattatttaaagaacaattgatgttggttaatgttatgggctaaattttgaagtcctaacctccagtacctcagaatgttactatatttgaatacagggtcttaaaatgtaattaaggtttaaaaaagtcactggggcatgccctatctaatatgacttgtgtctttataagaagaggttagaatacagacatgcacagagggaagaccacgtgaagacacaaggagaagacagccatctataaagtaagcaagatatctcgtaagaaatcaaccctgccagcaccttgatctcagacttcagcctccagaactgtgagaaaattaatacagtcatgtaccacataatgacgttttggtcgatgacagactgcataaaaaacaatggttccataagattataatactgcatttttctcgtaacttttctatgtttagacacacaaatacctatcattgtgttacaattgcccacagtattctgtatagtaacatgcagtacaggtttgaacccaggagcaataggctatatcatatagcctaggtgtgtagtaggctatacggtctaggtttgtgtaactacactccataatgttcataccatgacaaaaatcacctaaagatacatttttcagaacacatccttgtcgttaagcagcacatgactatgtctcttgttcaagccagccagtccatggtacttggttatggcagccctggcaaattaatacagtcgatgaatgacagtaaatgcagtaaatgctaaaaaaaaaaaaaaaaaaaaaaaaaaaatgaactggaacaaaagagacaccacttcgaatggagtattaatcaggaatattaatcaggaagtggcagcaaatgagcctgggaagatacacaaaggacatggggacttcttagcttcattgagaagggcctgagatgcctggccagagttcagactcaatcctgagcatgaagggatgccaccagaggtttttaagtgagattgaacataaaaagcttacattttataaaagtcactctggctgcagtgttgattattagttgtctgagagcaagactctttgaagctgggagaccagtcagaaatttaatctagatgagagatgataccaacctaaaatacagtgaaaatggggggaaaaagtttggaaacgtaaatttgagttataataaaggaacaatgtgagaacaaagttgttagaacaatctctgagtctcctccacgctgtcacatttccaccccagtgcttagtcttctcataatagccatatttgtaagagaaggcaaattccgtttttattagttaatatatttggcaacttctcctaaggcacctgccaactccagtgtatctcaggcttttactcttgaactctgaaacccgagaatgctaaattaattcacacttctaagaagaacatggattgaggcacattctataatacctatatttaaacacttcccagaagtgtgctattttgtatgtgtgaaaattgccaacacaacattcacaaaccctcttaacttgcatctccagccttgacgtccctgaagaagaataaactgccttctaaatgtagttagctaagagaaaagattaggaaaggaggagtagaggaaggagtggaaatggggggaaagaaaagagatttttaccacccactagtttgactgtttagtcaatctctttgtctcaacaacctacttttagtgcatgaaagatgtggttactctctgagatgagagtataatctctgctggaaagtatacatagtcagcgtgtctgattttcttaggagctctacctttggacaagcaggagttagcaagaagtatataaagtcagtgagtctcacacatgggaaaactttatttgccatctatgaaatgttcaaatattagaaggatttatttttattatccttttcttcaaagcactccattttaaatgtcagtaagcttttcaacaataaagatagatttcagcaaattgccagtcaaggtttttcttttatttcctgggtgtttcttaataagtggacttattgtagcccagatgtctgtctgtctagtggccagccttttcatatccacgatcattttctctctctcatcatatttcccaactacgctttactgcatttatcttcttaaaccatgtgtgactttctataccaggaaattttcaagggaacatcacttcattttgcttccaatagaagcccaggcacaaagagaaatgataaaactctggcccctgctttattcataaaacactttgcagagtgcatttagtaatttgccattgtaaccactggcactaagagctttcagggccgagttctgatgctgtatttagttcatactttgactgctcagctaaaacttccatttgtatgcatttattctgcttcacacattatgttgtcagtcacttgcaatatttcaaagtcacagcaggctttttctgacacatatttgtcagaatgaactgccttgattgctattattacagactatagtgcctgagtaaggggaaaaaaaacttatgtagtaccagaatattgaaactgcctaataaaacaatagatacaagagaataaaaatagaataaatgcatataaatggatgctttaaaaggccaacaaaatgtaggattacaaaatagacatatagaacccaaaaacccattcataaaaaggattggaattttttgaaaatgataaggagccgaatgagaaaattccactgccccagtgtcagtgagtaagtgagtatcacatacttcctttccagtaaccagggatttaagtagactctgctaatggatgctgtcattgagagaaattttagcatgaaatctcctactgaacaacaataaaaacacatgctttgaccaaaaataataaaaactatgaggaactaattagaaatccagatcctttatcattcttgataaactactgagcatgtaatctgaaaagacctgtgccccatttggctgctcttttctctaccttttgatcttacccatacttcagaactgaacaccatataagtaccatagaaatccacttgggaatcagggaatttctctgccgatagggatggcccttccttaggattcctcaaatttcaagacttgcataaagcataagataagaaaattaaataagacataataattagttttcaaacctcttatcaaaagtaaattataaaatacaaaaatctaaaacatttttattaatgccacagatcagtagaacagaaaaatctaagctgtgttgctcttgtctttggggcaattatataactttatgaatttgcttcacttcatatgtttctccacatattttcctaaagtaatattcaagaaattatgctggacatgaaaaatctctaacagatccactgtttggaaaatcatttctttttttaaaaaaagaaagttatgatgaagagtaattatcaaaactggaagaaattataaagtaagaaaattgtaaaagccgaaagataggtcatctacttgcttactctatttctagaaataagatttaattctttctaaagatgttgtgtttaatctgaatgttattaagaccccaaattaaggatgactcttttatttctgtttgaatctttataacaaaatattaaaattacttttggaaagctttaggaagtttaaattgttctaaatccctcattgtctcacctactcattgtcttggaacttcttacaaatattaatggctttttgatgcatattgattctttatgtaccatatgactaatagcataactctagatgtacactcagaaaagtcattacagtgatatatacaccaatgggattcagaaagcatttttttaatttaaaaaataccttcattagcatagttttcaaatttgtaaacaagttttatattaaaagcaataccttgttgaatattaaaatgctgagatacttaaaagaactcaaaagttatgcaatatatatcataaaaacattatatatatataaatgtatcttcagtacatcaaggcaagtttaaaacattaacaattttattaaaatatccattttatttgataataataaaaataattgattctaggagtcaattattttttctgagaaaaaaataattgtttactggagtcagtagtcattctactaaattgtttctatttaatgtattagaacagataaatgtattttgtctaagtgggaactatttaaatattaaataaatattttcaaccttaattgtattccacagtctatgggggcattgagaataataagtaccataaagtgtaaagattgggggacaagaaaagctctaaaatatattaggtaatttgtttgtattaattaacctatttgctatttttgaaaaattattgtcagcttagatctactacagatgattatgtctgttactaaataaagtaaatttagcctattcatcaacatgtaaatacctatatcaaataagacaaataggccgagcgcggtggctcacgtctgtaatcccagcactttgggaggctgaggcagacggatcacgaggtcagcagatcgagaccatcctggctaacacggtgaaaccccgtctctactaaaaatacaaaaaattagccaggcatggtggcgggcacctgtagtcccagctactcgggaggctgaggcaggagaatgccgtgaacccgggaggcagagcttgccgtgagccgagattgcgccactgcacttcagcctgggtgacagagcgagactctgcctcaaaaaaaaaaaaaaaaaaaaaaaaaaaacaaataattccagctgtcatttcaattgaattttccataagaggttcaattttttcttgagactttttaacagtatccacaatttcagacaagctcacatgagtttgttttttcaggtagttttaacagtgtgataagatggtttactgccctagagggaaaaggtgtcaatgtgttatcagttggtatgttctgggcctttggtatatatagaaagtctggcattttagtaactctacctaggataatatacattgataacatctatttaagaataagaaattcattagctagccctaccttcagatgatattttattcatatttttatttcttttcacacagtatttctttataaatctctgcttctacttcttaagtatttgtatattggtagaaactcactttatcttaataattataatactttaatgtatttagaatattgtatatcatatgtaatacttaggatactgtacatattttaacaaataaggagtgaatactgaaattaaactgtagattgactaaatgaaccactgttatagagcttcggagatacagaggagctcccaccaaatcctaaaatttttctctactttaaatactctatcatggaactattcgatttgatgggacataaatctttttatcgtaatgtcatcctggataaaaacatgcacacatgcacacacataaaaacaagcaaacaaaaaaccaagtaatactacactctttgattcatacctgtgcaccaaaggctcaagcgtagatgtaggaggaaaaaaaaaacaaaaaactgatccctctacttccagtcacttctgccccaacttcaaagaactcaaactcaaaccactagttctatttgttcgtttgttttctgtggctgagttcttactcaaaatgttctacttaagcctctccttgggggactgtctccaagctacattgaggacagagtctatagctagattgcctaaggtacaaatttcttgtagaacccaatacagctgccaatttgcttttgagggcaatcaagatgttcattagtaattgagttgaaacagagaggaacttcatttgtactgagtcagtgacctggatcgttttcagaatgagtgttgagctgaaatggaccattcatttctacttccattgggatcctgttcaaaaaggttattgctcttaccttcttccaacaacagtgataggaattttcagaagcaaaaaacaaggttttatgtttgccacttgtatcttagggcaacatttataataatgggatttttaatcaatcttagagcataaaataaaccctatcattttagactgacctgttggactaatttcaatgactttagctggtaggtaattgaaataggatgacagtacactggggtgaataagaggtttcaaaaatagacaaagataacaattagacatatttggagcatcaacagaagttagtataaaattacaggaattttagaaattaataaagaggtcttatttatttaatattgaaataataccatttaaataattttaacagcaaaggtcaatataaggcatgctatcaccaagcactattctaagagctttatatacctcttgttacttgcaactaccgtgttttacaaataaaaaaaactggagattacagaggttaagtgacttaagtagcttacccaagatcacaagagcagtatataatggagttggtattcaaacccttatagtctggctccagagtccatgctctcatcccctctactattaccagtctcaatgactggcaaaataagccatcagcattatattgccttcagattctgagtagttctctagagaatgaatgagtcataagggatgaggatgcttggctgaatagttttgcccccattattagagggtaagagcaattttagaatttcatagtgttcaatctccagcgaatagtttttatatagggaaactgaacgaagcaactgaaaaaactatttttactcaaaatttgtgcaagaacttgagagcacatgttaacaaacctttgtaatcagttagcagagcatggctcagaggataagtttttctccacacttctggggagactccagggccctggagcaagcatttgaacggaggccttaatggacttaagggcagagccagcccagtagcagcagcagccctgtcaccaggaagacagtctagcgtagcaatttagcagcagtggcagcaacagctaagttaaggaggcatgtttaccaggcttccaagttttgaaaggtcttagaatcaggcaaaaaaaaaaagtgccaaaaactggaagtaaaagggccatatgacatcccaaagtccagaagtgcatgtaaaatgtgcacaggtgattcccagaattaattgaaaggaaatttacagaggctggaggtctcacacttatgggtgcatatggaccagatgaatactgcttgtttataaagttgtcgtcacacctggctccattgtgggtataggctgagagacacagattatatattcaccaacgaattactagtattctttcccatacatcttttggttatgttcatcatattatatttaacttaaaaaaatgtgttaaaattcaatttgacaaataaaaagttctgaaattaaaagagaaaattttaatttgatagatgtcaggtcttaagaagggatgatgaatggaagattatattcccttttttagattttttagattttgcattctgccataaatttccctgcagtgaatgattggcagactagaataagacatcaggaagaagagatataatgaaagtttaataggcagattgcagacccaaacatagctgagtcatcagtgggaatttccattggtttctcagtctcttttaaatattaaattaagcttcactgttaagaggactcagtactgaagatgggagacctagttcttaaagcgaaaatctcatcaagatataagatctgacccttttgtattatatcattttcaattaaggttttaatgccctcttttcataatggaatctctaatttactttaaaaaattgctttcacatgactcattattttacatgaataccagcattggtatgataatagtgtcaaaaataaagcactattcgtgattttttttttctgatgcagggttggaggcttttctaaaaaaaaaatttttatagaagaagacttaaataattacagttgaatttaagaacattatccatatgaattatttctaacaaagaatatccgcatgtgaaaagtggcgggtatcctgtatttctagctacatttactcagtgttttaatgtcagttaaaatgctatcccagtcaaaacagctcctatacatgtaaaattatggttatttctcaaattataccattttaaagtgaaaccacattgaaatgatattattttgatatgccagcagatacatgtagtcacccaaagaagttttatattacaggtgcttgaagtcagaaaaaggagccttttttataatttcataatgagaaaaaaaggaagtcagagaggtacgatttaattcaaatatacatttgtgtattagaaatgattatggagtaaatgccttatcttattattttgattgaatcttctgtaaagaaatatgagaaatactctctatcaaatggagcagtagtcgcgtatctgcctccctcccccacaacatgtgagtaaaaagtttaaaaatatattttaagaatcaaagtttaaaattataaatatgtcaaaaattgtgacagtctgagatcttatatgacttgcaatctaccaagttagcctgccacagtttcatagatgctaacagaagactcaagactcctgggtcagaaacaagagtttattatgcatagcacaggcagcatgagccttatgttttcaccagttccccttgtctccagagcccatgcagataatacaaagacaggcccagatggatcctgctcacagagggcatttagaaagcccccaatcttacactgagactgttagaaaacctgcccaaacactgccccagagggagatattatctctcttatccacagggggaaaaaaaaagcaaaaaactgacctcgcacctgaagaaaggtactactatctcccaagtgtgttggctttacaaacatccttgaaaagagtccaggatgaaagttgtccccagatatgcagaaatgaaatggagaattgcatcccaacaaaatgtagtagtcaatcctcattattcacgattctgcatctgagaattggcttactcactgaaagtaatttgtaacctccaaatcagttcttgcattgttttcatggtcatttgcagaaatgcacagagtggtgaaaatttgagtttgctcgatgcttaagtttccagctgaggtcaaacaaggtgatattctatcatcttgttttagctctcatgcagtaaacaagtatccttttttcagtgtcatgttttttgcattttcgtgctttctttagttggtgactttgctttttaaaatgacactgaacggtgctgaagtgctgtctgatactcctaagtgcaagaaggctgtggtgtgtcttatggagaaaatatgtgtgttcaataagctcattcgcacttgaattatagtgctgttgccatgagcttaatgtttgtgcatccacaatatatattaaataagccttctataaacagaaacatgcataaaacaagtttacgggttaatctgttgatgaaaatgtagtgaccgaagcctcacagaaacctaaccctgaatttcttgtaggaacaatgattgaatatcagtgaattcagtgtttgcagtgattttatggactatcactaccatgaataatgataatcagctgtgtagtcggcacaaatggcagcacccttgcttccactctggctctcttacagtgtcatcaacaaaacaacaagagtggttcttattatataaaccgtaagtgagatcatggctcggttctcctcagagctcttctgtgactttccctctaactcagaatcaaaggcaaagttatcccaatggtcctacagcatgtgggctccccgccttgccagctctttccctgtggctcctgacatcacttcttccattccccccaacccttgctcattctgttccagctacctggcttccctgaggtttatggaacatcccaggcagcttcctgcctcaagaccgccttacttacttctgcctaaaaagctcttggattttttttttccaaatatctaaatggcttactcctgcattgctttcaggtgtttgctaaaatgtcaccgtctcactgcggccgtcactgaccaacctacttaaaggcacacgcccatccctgccaactctggttctcttcatccctctttctgctttgttgttctctatggcaccaccaccacctggcacactataaatattatgtttacctgtgtccttcccataatatgcagaaatattatgcaaatattatgcaaacaatagtctgttttattcactgtggtatgcccagtacctaaaacagtgcctaaaagtttttgaaattttcagtgacttttttttgcaatagagtaagctctatcttgatctgcttctaaagacagcaccagagaacatttctctgaaacataaataaacgtagagacacagctcaaaactcttgatcagactcagtaaagctagaaagctaattggaaaaaggtagcagggtgttttcaagctgtcttgaaaagagatgagtggtgaatctcttcatttttaaattgggagcaatgtttgtagtagcatgagagtttatattaggctatcaaaataaaaaaatgacttaaaccctattaactcagaaaaatgttgtctctgtaatttctttgtctaatagtaccagatcaaactaatccctcatgaaggaagaagagtgcttttccttgagaaaacaaaacaattagattctagctaaactgcccacaaaacacgaaatgtttcatttaactaagtgagaagacatagcttgtttaaatcctaaataaagaagcagtctccattaatggaaggcaagtcccttacaagcatgtttctctctgcacctaaacaggtatcaagcgaactcattgtgcttcctcatattgccacagagagacacagataaatggaacaaatgccaggcaaactttgaaacggtttgatttgatgttaactctaattctgagttttaccatcagtggttctctcatgctatcataacccaaatttctctaggccttgccaattgaggaatgcaaacaaggccatatcatcatcaatgagaacttcaaattcactgcttcatgtcccacagcagaacatagtgcctacagcctcccttcagtgattcatacagttatggaggtattttgagtgctcatgaagagtcctcttaagatttctcatctaataatgtgtcccccaaaaccatttgagagtcacattttggctgcccaggctcaactataacaatgcacagccacaccaacggtgcaaacctttgggagctgaagcagagccagtttccccacagtactcactgtgtgtccaaaatacatatgtatgtattatgtgtgtgtatgtgtgtgtgtctgtgtgtgtttgtgtataaatagaatatgaccccagagtaagagggttactgtaatatgaaggaggtagcggacagtgtaggctctaaggatcaggcagtgcttcatgaaggaaggagcatttacgtaaacctcagtctatgggccagatatacatatcatcagtgttattatggaatttttggctagaaaaacgtttcttccagtttttctgattcctatatttcaagaaggcaatctctaaaactttgagtgtattagtgaattcacatgaaaaacttatcatataaaaagtagttacccagggtatctcagtgagaaaatgtgggagattgctttagtgtatgctatgtgggatcatctttctcatacatcacctggcttaaacattatttttttcaaacgtattcggattttatggaacctggattctagtgctacaaaggacaatataagataagggagaaaatgagtggaatgagttgtggatcaggacttaataatgtatatacagtggtcaaggataaactctctaatatgtgagcagaaacctgaacaggtgaaggagcaagccatgcagatgcctgcaaaagagcatttcacacaaagggaacagcagtgcaaaggccctgaggtagaagcacgatttcatactcaaggaacagtaagcaggcagagagcagagagggagggtcacaggagtggaagtcaaagaggtggcccagggccagatcatttacaactttaatagccagtgccagggctttgctttagagtgagtaggaaggcactacaaagttttgagcagagaaatggtgctatctgaatgaaggtttaaaaggatcacagcagatgctctgttatggtaaactgtagtggacaaagtggaagcagacagtttcatgtgatatatggcaatgacttggaccataagggcagcaatgtgaagtatgtgaagtggtctgattctgaatagctgagacagaatttgctaacatgttggatgtggagtctgaaagagaagagccaagtatgactccaagtttcttggtttgaacaactagaagggtagagctgtcatctaatgagataagaggcctacaggaagaatattttggggtgggtagggacgtgaaaattgggagatcaattctggacgtgggacgtttgaagctgtggagtatacataatttcagctggacctgcctttgctttgccgtttattagctgtgagatcttgggcattaactcagcacttctgagactcaactttcttatctgtattatgaggatgatagaacctaatgtgtaagttagagttgtgagaattcaacaaaagaagaggtataatgtacctaaaacacagattttaagagaaagtaaaatgaaacaaaatcaagtattaagtaagtgattagtaatttgtgtttatcaaaatcatcatgacagtaggtgtggggtttcttataacagtagaagaattacttttaggaaaatttctatgactgtggtttaatgaaatgaattctaattaaacacttaagaaaggggatccccattgcataccatccagtttcaacttgtcttttatttttaattccttttctgggtttactatggtcagtattctctgctcttccataggtatgtcagttgttttctcatcacttggcaagaaagctaaatcttcagtcagtttggtagagatttctgtacaaagcaataaatgcactcttggctttattcctttgcaatttatatagtccctcagatggtcaagttatcaagatattattctgatgtatttgtctcatgttgttctccaaaattactaattcatactctccttccttaaacctcttgtttactgttaaataaagttttgttttatgtggggtagtgtttttacttcattcatcctgcctacattcagctcattttaagatgtgtcttttatatgcatttgtcttccattttctttacaaagctggttcacacaaaacagtcaaaactgcttcacttccagtgtgctccatcacctcaaaatctgctattttgtttgtacacttcgcacctgagttaggtgctgatgatgtgctttaaaagccaattttgactgctctaaatgctataagttgacattcattaagttgcttggatataccaaattttctgtatcttcttagaagtctctcctcttaaatttccggcttcatttgccatgatggttacatttgttctacctaacaccctttgtttgtgttacattctatgttcctgaacagaaaaaccctgacatgtcactgtgtgttttactatttatacttccttcctgaaatatctctttccctcacccatatgaaaccttactcagttttcaagatttggttctaatattacgtcttcctggaagtcacttcattctgcatttattcatccccacttttcttatcagaatcggttgagtagtagagcacttatatgcatatcttcaactgaccacaagcccctgaagggaaggtacaataactggtttaggttttatttcccaaaatgtcttgaatgtaatagatgatcagtaaatgtctattgaaatagtatgcttcttttaaaagtatgaccttttagtttttatctgctatgtcttcattgtcagcactgttctggcataacaatccatgctagttttattgtgctaaacacaattttattaattcaacaaatttgagcaccttatatattatatataagcaccttttattgaatttggtcctgagaatgcagcatatgcataatcccttccctagaggaactcacaaaatgaaagaaaaaactggcaagtaaataatattctatatgataaatgctacggtagtgatatttttcagagaggtatttaagcatctaaagagtttcagaggaagatggggtttggcatgtcattatgttagatttgggcgatttgaagagtgcaataattattataagcacctggaacagtgccttcctgtggaagccattctataaacactgttgaattaattacatggtggcacttagaatgtaggttcagaggacagtaagaggatatagctaaaggtaaggcactttaagtggatcatggtgttgatatggtttttctgctttattgttgacctaagctttcagtcacttatatcctcatttgagaagtctctggatcttacatgaatatgaaaatgaaaaaataagactaagtagcttctcagataattaggatgaattcataacaacagttcccagaatcttccttaagaaagacacaactactttagaaaatgaacctacaacattaatgtaagaaagaaggaaaaaacaaaatctttataaaattctttttaaatattacaacactccttcaaatgattgtcaaatttcaggttggtatcgggtgctctaattttatttgtaatgaaatagaacctttttatttatcagtcagtaattattaattgtacaaacatctattgaaaacatactatgtgatgacttctttactaggatctagagataaaaagacaaataaattggcttttgccttcacttagcatattccaactgattgaaaagagaaataaataagacaattcagtatatcacagttagagttaagtcagaggtgtgcatggatttttgagaacagaaaagaggatctaaactagactgggaaacaaaagggaaggctttttgaaagaaatggtgtgcttaaatggggtgattttaaaggacaaagacagactagcatggcataattactaggtagaagaatcctctaaccaagtacatccaggtatccaatatatctgttagattctctctctctcttttttttttttccaaaaatctgtgctcttcatggccttagtgataaccaggaggtaccacctatggagaagacttatctttactgcctttgaaaaagcataattctaccatgaagtgtcattgatgggcttaaattatcaaaagagaggtctgcagatgggtttcatggagagcagtggcttcagttgtcaagagtcccaggatataccatcctgtctgtcaccaagatgctgaaaatatatcactgttacttccatttgctgaaaatgaaagtagcactctttaccaaagtttaggtgaacatactgattaatattttagccataagatttataaagtaacatccccatataaatattataggagtgtttatcctgtgaaaaagatgagatcaaggaactggatttattaagccacataacgattttttcttttgttcaaattcgccatgtgaaacaagatttaacgtaatgcagtgtaggatcagcatagtgccttgagatggactccaaatatttctaataagaaatttaaaagaagtggcatattatggaactagtatttcttttcaagattatcaaatgtaatgatgtttttcacctttactatatttaagatgtttctgtaaactttgagtgattaaaagactagcatttttctccttatcttcatacaaacctgagacacaatgacttgttatgcattagctatggccaacaatagcttagtaatattttagttttctgttactgtcagataatttttataattttttatatacctaaagcttttcactcaagcattacacatttctctgtctttataaacagagtattttaatcccaaataatcactatgaaaaagcattattttaatgtgctttaagactatgataccatgagagattactgaaatgtatataaccgttttctcctacactcaatgaactttgagttctgttatctgattttcatagttgttctctttttttttgcattcagactgtttgcccttactttttataattcctattgctacctcccctttcaacatttccatctgtaatatgctatttcaaatgcaatttatttcagcaaatatgcattgaggttatacaatgtgttagtcacattgtatatgtgtatatgctagggattcagagataaatgaaacatggtcttagccttcaaagagttgtcaggtgagaaagaagtagagatataaacaagtaattacaatttgtgtgtgctaattgcaattattaggattttattctccggaaaatgtggcttgtgttcctggattttggcaaggtaggatgggccaggacaggacttaaaagggctcagcatcaatggataatggaagaatttaaagcagagagttttgaagtaaatcttaaaggtgcatgggagtgaatttcctgtggagaaagatatgtgctataaaatttaacaaatattttgtaaaaaatgtgtctaaaataagaacaaattactcacagttagactgaagatactatcccagttatgagctttggatagttacttcgtggcatcagttttgaccatttggggttttattttgctaacattatgttttatagtaggtacaaaatagtttggcatgcttagtaagtgatatctcatgagtgaaatgttgatgcatttactatgagaatttgtaataagagactgcattttattatagtacatcaggttttattgacactacctttccactatcagtattttctaatgagaaaataattcaaaaatagtattagacatacaggaagcctctgagttaatgtggggtcatgtttctaaatatactttctatatgagacaatttgtgtttatgatggaattgcatgtctgtaccttataatcatgcatagaaaatatgtccttaggcattaaataatcaacctacaagaaatttctggtggcaaacatatgtgttaccttttcatatttaaaataccattcttagcataatgcacagtacaaaaatatatattggccattttattattattatcatttaaaatgatatgctaccagacttattttggaaccctgctgaaattcctacatgtacagaaaaaaaatttagtgatatactgaagttaactaatgtcagtaaagcgaaaaactaatgaaactcactgtaatatattcagtctttgaactatctgaatttcaatttaacctcaagattagactttgtatgtgtctccccattcccttgcataatattcacgcaacacactccaaacacatatcttttatttcatgtagcaattttcaaagagatggatgggggaactgcacatcagtttctccagacagtatataggtacagtttgaaaaagtcagtcctcaaaatttttctttctactctacattcctctcactgggctccaacccaccctgcaccttctctctcacacatgaatacaagaaaaatcattactacaaaatttgaagatgatctggacctggacgtttttcagagcaccacttgctaatcagcttttgtggctgttttaaaattccaatgctatacccttgaaatacctaacttctaacagtataacttcttgatgaacttcccaggataaattagtggcaaaatgtgaccctagggattatgtatgtgtaggagcatataaagtctacacatagatactagtaaagtatggcaaaaagcataatttttcacttttacagcagttatatcttaaaggattctttctttgcactaggtacagtttagaacaattgtttattggaacgaatgataatatggttttttacatcttttcattcatatctgttcatgtcaaagatcatttctatgcaccctgaaactcaaggtgcagtaagctaaacttaagaaaactgaaatcctgtaataaatttatatctcttgggatataattgcttcctatccaataacaaagacccaagagaaagaagcaaaagtcatatttttttctaatatactgataaagagaatagcaaccatgaccaaatagaaatcatcaccaaagcctattcacatctcatacaagatcttgacattttaacttggatttataagcctagatttagatatacctacatcaatgatttatcaaaacaaaactttgaatgtctcgaagctgaattacttgcctatggaataaatgggctacactgatactttcacacagtgtttagaggggtcctacggtgcatcagtgtctgcccctagaggtaaggggaaggctgactactttgagttctaggcaagtagcctaggcatttcatccccttgtttcttccaaaacaaatctagttgtctttgttagtgacatggttgttttccacatagatttattttaaaaaagaacccactactaatctcatttgaaaatcactgagtccatccagtgggaccatgccacaagagcaaacactgtaaacaaattagcaagaatctgattctttcgggaagaccagactttgatgaaggcagcccagtgtgcgtttgctttatgatcaaacattctatatgtgtacataggactatatcagtatcaggttctgagatgggtcaataagacaggaatagttagtttgggtttgtttctacttttgccatagaaacgtggggagggggaatcaaagtagctaagcaatacaccccaaatttgaaactgtcctattttaatagagaagatcctaagactgctggaaaagggtctgacagaaccagtttcagagtgcctcgtcatgtttcgctgtggcagaaagcactctgagcagagtgacgttctaaaatactatgcactaaagagaagggtttgatgcaaacttttgacctaggcccttggtgtaaatggagggatttcccttaatcatttcagcctgagaaagttaagtaagtgttacccaaaagggttttttccccattttgagcattcaaaagtcttgggacatgagcactgcattgactgtctggtatagaagcctgttgcaaacttgatcagcccctgcccaggtacaatggaagggatcccacactgggagtacctgggtgtgagctctgccactgctttatactaattgtgaggccttagtacatcatttagcccctctacaactcagtttccccgtctatgaaattatggtgataatttctatctacctcacagggatgtttgtcaaaagtcaatgagattagaaacatgaaagttaaatgtaagtagaacaacactatatatattatcacttattaaaatgaaccaggttgggcgcagtggctcacacatgtaatcccaaaactttgggagactgaggtgggtggatcatttgaggtcaggagttcaagactggcctgaccaacatgctgaaaccctgtctctaccaaaaatacaaaaaaaaaaattttgccaggcatggtggcatatgactgtagtcccagatacttggaggctgaggcaggagaattgcctgaacccaggaggcagaggttgcagtgagccaacatcccgccactgcactccagcctgggtgacagagcaagactctgtctcaaaaaataataatgataaaataaaaaaatataataaaccagagcattcttaaacacaagcaatgaaggtatctgttctacatcctgctatttcaagtcccctttctgaccttctttttgctgctcccctcactaccagttgaggagtttatagagtcaaggggatagatccagcaggagcctgtgcccctcttctagatcattccccaggtgtccagaccccataattccctgctcaaactcccctgaccccattttctgggccaatggatcacttgtccccattacattctccaagggggaacccccccaccacagatgtaactccatacatccaagggtggccaagggaatagctgtttgtgggggtgtcgatggagtgtggacatgtacagcatgtcacgtgcatgtgggcaagaacccccatgggcagaaaagagctaaaagtggaaagaaaaggatatcatgcagctacaattcaaaaatgtattttactttaaaatttgatagtttgacttaaatatttagaaacgtggcatgccagcttccatttgtactttcaccctgtgctacacaaatattaactgtttcacatttgccatcattgatcattctgtgcaattataatttattcccacaatttttttctaattttaggactaattgttgttgaatattttaccctagagaggaaaataaacttttgtctgagcaaaatcccaaccatttcttcatgattatgccacctgctttgtttttgcttataccacagccatctaaccaatttgtagatatcctatcttttataccaggacagtgttgcctgatgggcacaatcctcttctcacatcagtttggaaaataaaaacattataatctctttttttcctttggtatccaaagataagccctttaaaaaagttgaatgtaaaaggatgataaggagattacatagtttaagctttatactcaaaatcattttatattgaatctctgtaatgattttgtgtaatatctttaaatagcatagaatactatttatcagcggtagaaccaatttaaattactttcagccctgatgagaaatgggaagagactgaagtacactacacattggcatttgtacagttggcagctgggcaaatagcagcaacatccacctacttatattaattatctaggttattacagtagagattaaacagagcaggtaagtcaggtaattagcttctttataaaaattgagactaccccttttattcttcactgcttccctaaatcaggaagcactttatgtattacaagcatctaaagaaagtggaaaaatctactgtaaacattttatgttttaaaaaaattattttaatttttcatctttgatttaaaagattgtatcaaaactttaaatatcttcccatctcagtgcaaaataatgcaaaaaagacaattattgccatggcctacatttgtacagggcctttttcttccagtattttccttttatatctattttctcatgtttgcatcatgacaatcttacatgttaaaaaatgtaacacaaacatcttacaatcactttttttcacaagacattatttttcttttattcatcatttattgacaattgaaacattccaaatgattctaatgaatgtagacagatctttccttgtcctaatccctaagctgtcctttaaacaagagccagacatacatgaaacaagccattgactttcgattgaaaataaccttagacattctaatcttttattaagcactgtccccaggggttgtaaactcaaatgccttcaaggagtgacagttaacaaaacttatgatgcgcaccataaatcaaacttgatgtgtgatcatacttcacatttgcttggttagttacattgattttcaaactctctgggtagtatgttcctctcagagcaccaactagtgaccccgccctctctagttccctcttttcttcttcacctccttcttcaaccctgctttttttttcagactcatgacttttggctttatcttcttttcttgacccccacattgctcctttgactcatggcatatatggcgtcttctgttttgaagctttggctctatctttcagacagtttgcaagtgccctctggctacatcctgtcattgctgctaggtgttatactctgaagtataaagtcaaaacaaattatatctaccttaactctgggcacttctggtgggtctgccctgtgcctcaggttcctgtccactaatactcgtgagcgtgagataagatcatcattctagttaaaaatccatcactactataagtattcaagttcatttttggttaattatattgaagtgccagtccatgtttgagtgctgtatttttatgtatagctgtcaggtacaatgctgtgcagtctctggaattaatctattattttctttaaaataaataaaaataatgggcactaaatttgtgtttcagacttcaaaccctccttctgtaatcaatgattagtgtgaatgtataagcactcattaacatttcattccctgttttgatttaaattttaactctcccattatgaataataaacagagtgtctgatcacatttgaccttttgaggcataacggtgctttttttttttatttctttaaatatcataaggcccaataggtcacttccctgttaacttttcttacataagaaatttaattattttaagagaaaaatccaaataatatctcagtaatcttttaagaaataaatatattttctttattgccaacagaacatctaaaaagtggacattaaaaaaatgagtttgaaatttgtttgatttttcaactgtacattaagtatatctgctatataatgaaagcttttttcctccccaaagattctcaaaaaatgtgttccagaaatacagataaataagtaaatggatggaagaggggggtatatttctatcaatttatcattatgtttattatttcacataagacttatcaaagatattctttggttatctttgataagtcttgattataagccaattatgaccaaccaaaaatggtcctatatatgtaaagtataactaacaaagtcaaataaatttataattaattcatcagctccttaaaacatctcacaaataacgtgaacctgtcatatattgcgtgtgtgtgtctgtgtgtgcatttctcccttacatctcaaaggtaataaattggttacaaaaagaaatgaagagaaatgaagtctggagtaacttgccaaagaccttgacttaaataactaaaattatatccacattatctaacagttttttttaatagatagactatcacataaaatcatttataacataatagtaacttgtgagtagtagttaaaagtacatgatactttgatagtgcattttctataagtgtttaataagaaaaggtatctggttcttgtaattatattgatagctaagatttattaaacacctactgcatattaaacactcttctaagtgcttatcatgtaggattttgtataattttcacagccatagtctgaaataagtactattgtggaaaggaaactaagagaagttgagtaacttacctgaggtcacacaccaaatgagtcaaggtactgcaggcaagattggcagtggatcccgagctcacacatctaaccactttgctctactatctcttaagagcagtgaaagatttaggagagaaaggggaaaatggcctgtttctctaactttatattatgcattatttacttactaagcttctgttttatttttgatcatagaatatatatgttattttttcaaggttaaattgcaaagtaaaagcattatagtgtaaggaataataatggcttatactttccactccaaagaatttcctaagcagaggttggaaacaattttcacgcgtcactgaaagatagcttccttcaactggataatgttaatgtttattggcacttaatagccttagacaggacagtattttgaaattcaagagtaatttgaggtaaccagaatatgaatacacccgggaagagttgtcatatttcaaaataaagcattcagtatgttgcacaaaacagttcatctgtattgattgccactaatgctagaacagttagatagaccaatggaactttcacacttgtggcatgaaaatagttcttgaagacctgtaactttgaacaaactaatcctctatgttcattatccatttaatgtggagaaatgttttgggtaaattattgttgaaagatttaaaattcttaaatgtatgctaaatggaaatgtgaaaaaatttattagcttcaagaaccaaattaggcctcaaagcaatgatctttctaaaaattctagatcatcctgcataagaagaagatagagtagcatagcttagataatttaatgtgcataaagaagaaagtcctgtgtctttattgatgacactgaaatttgaatgacaaagacatggcaatctggctttacccattttccgtggcttctgctcacacataaatggctgtaacctccacccccttgttatggttacaaattatgggattgtgtaacataatacaatgataacttaagtttagctttttactttgaaaataaaaacaccttcctgtgtccatgtgttctcattgttcaattcccacctatgaatgagaacattgtgcacatataccctaaaacttaaaatataataataatgaaattaaaaaaaaaagatattacaaaaaaaaaaaaaagaaagaaaataaaaacacctgagagtttccgcaagatggctgaataggaacagccccggtctacagctcctagtgtgagcgatgcagaagacgggtgatttctgcatttccatctgaggtaccgggttcatctcactagggagtgccagacagtgggagcaggacagtgggtgcagcgctccatgcacgagccgaagcaggacgaggcattgcctcactcgggaagcgcaaggggtcagggaattccctttcctggtcaaggaaaggggtgacagatggcagctggaaaatcgggtcactcccacccaaatactgcgctttccctacgggcttaggaaatggcccaccaggagattatatcccgcacctggctcggagggtcctatgcccacggaggctcgctgattgctaacacagcagtctgagatcaaactgcaaggtggcagtgaggctgggggaggggcgcccgccattgcccaggctcccttaggtaaacaaagcagctgggaagctcgaactgggtggagcccaccacagctcaaggaggcctgcctgcctctgtaggctccacctctgggggcagggcacacacaaacaaaaagacagcagtaacctctgcagacttaaatgtccctatctgacagctttgaagagagcagtggttctcccagcacgcagctggagatctgagaacgggcagactgcctcctcaagtgggtccctgacccctgacccccgagcagcctaactgggaggcaccccccagtaggggcagactgacacctcgcacggccgggcactcctctgagacaaaacttccagaggaaccatcagacagcagcattcgcagttcatgaaaatccgcggttctgcagacaccgctgctgatacccaggcaaacagggtctggagtggacctctagcaaactccaacagacctgcaacagagggtcctgtctgttagaaggaaaactaacaaacagaaaggacatccacaccaaaaacccatctgtacatcaccagcatcaaagaccaaaagtagataaaaccacaaagatggggaaaaaacaaagcagaaaaactagaaactgtaaaaagcagagcgcctctcctcctccaaaggaatgcagttcctcaccagcaacggaacaaagctggatggagaatgactttgacgagttgagagaaggcttcagacgatcaaactactccgagctacaggaggaaattcaaaccaaaggcaaagaagttgaaaacttggaaaaaatttagacgaatggataactagactaaccaatacagagaagtgcttaaaggagctgatggagccgaaagccaaggctcgagaactgcatgaagaatgtagaagcctcaggagccgacgcgatcaactggaagaaagggtatcagtgatggaagatgaaatgaatgaaatgaagcaagaagggaagtttagagaaaaaagaataaaaagaaatgaacaaagcctccaagaaatatgggagtatgtgaaaagaccaaatctgcatctgattggtgtacctgaaagtgactgggagaatggaaccaagttggaaaacactctgcaggatattatccaggacaacttccccaatctagcaaggcaggccaacattcagattcaggaaatacagagaatgccacaaagctactcctcgagaagagcaactccaagacacataattatcagattcaccaaagttgaactgaaggaaaaaatgttaagggcagccagagagaaaggtccggttacccacaaagggaagcccatcagactaacagcagatctctcagcagaaactctacaagccaaaagagagtgggggccaatattcaacattcttaaagaaaagaattttcaaaccagaatttcatatccagccaaactaagcttcataagtgaaggataaataaaatactttacagacaagcaagtgctgagagattttgtcaccaacaggcctgccctaaaagagctcctgaaggaagcactaaacatggaaaggaacaatcagtaccagccgctgcaaaatcatgccaaaatgtaaagaccatcgagactaggaagaaactgcatcaactaacaagcaaaataaccagctaacatcataatgacaggatcaaattcacacataacaatattaactttaaatgtaaacggactgaatcctccaattaaaagacacagactggcaaattggataaagagtcaagacccatcagtgtgctgtattcaggaaacccatcacacatgcagagacacacataggctcaaaataaaaggatggaggaagatctaccaagcaaatggaaaataaaaaaagtcagggattgcaatcctagtctctgataaaacagactttaaaccaacaaaaatcaaaagagacaaagaaggccattgcataatggtaaagggatcaattcaacaggaagagctaactatcctaaatatataggcacccaatacaggagcacccagattcgtaaagcaagtccttagtgacctacaaagagacttagactcccacccaataataatgggaggctttaacaccccactgtcaacattagacagatcaacgagacagaaagttaacaaggatacccaggaattgaactcagctctgcaccaagcagacctaatagacatctacagaactctccaccccaaatcaacagaatatacatttttttcagcaccacaccacacctattccaaaactgaccacatacttggaagtaaagcactcctcagcaaatgtaaaagaacagaaattataacaaactgtctctcagaccacagtgcaatcaaactagaactcaggattaagaaactcactcaaaaccgctcaactacatggaaactgacagcctgctcctgaatgactactgggtacataacaaaatgaaggcagaaataaagatgttcttggaaaccaacgagaacaaagacacaacataccagaatctctgggacacatttaaagcagtgtgtagagggaaatttatagcactaaatgcccacaagagaaagcaggaaagatccaaaattgacaccctaacatcacaattaaaagaactagaaaagcaagagcaaacacattcaaaagccagaagaaggcaagaaataactaaaatcagagcagaactgaaggaaatagagaccaaaaaaacctttcaaaaaattaatgaatccaggagctggttttttgaaaggatcaacaaaattgatagaccgctagcaagactaataaagaaaaaaagagagaagaatcaaatagatgcaataaaaaatgataaaggggatatcactgccaatcccacaggaatacaaactaccatcagagaatactataaacacctctacacgaataaactagaaaatctagaagaaatggataaattccttgacacatacactctcccaagactaaaccaggaagaagttgaatctctgaatagaccagtaacagaatctgaaattgtggcaataatcaatagcttaccaaccaaaaagagtccaggaccagatggattcacagccgaattctaccagaggtacaaggaggaactggtaccattccttctgaagctattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaagactggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctgtgacaaaccccacagccaatatcatactgaatgggcaaaaactggaagcattccctttgaaaactggcacaagacagggatgccctctctcgccactcctattcaacatagtgttggaagttctggccagggcaattaggcaggagaaggaaatataaggtattcaattaggaaaagaggaagtccaattgtccctgtttgcagatgacatgattgtatatctagaaaaccccattgtctcagcccaaaatctccttaagctgataagcaacttcagcaaagtctcaggatacaaaatcagtgtacaaaaatcacaagcattcttatacaccaataacagacaaacagagcgaaatcatgagtgaactcccattcacaattgcttcaaagagaataaaatacctaggaatccaacttacaagggacgtgaaggacctcttcaagaagaactacaaaccactgctcaaggaaataaaagaggataccaagaaatggaagaacattccatactcatgggtaggaagaatcaatatcgtgaaaatgaccatactacccaaagtaatttagagattcaatgccatcctcatcaagctaccaatgactttcttcacagaattggaaaaaaactactttaaagttcatgtggaaccaaaaaagagcccgcattgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcataagtaataccacacatctacaactatctgatctttgacaaacctgacaaaaacaaccaatggggaaaggattccctatttaataagtggtgctgggaaaactggctagccatatgtagaaagctgaaactggatcccttccttacgtcttatacaaaaattaattcaagttggattaaagacttacatgttagacctaaaaccataaaaaccctagaagaaaacctaggcattaccattcaggacataggcatgggcaaggacttcatgtctaaaacaccaaaagcaatggcaacaaaagccaaaattgacgaatgggatctcattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaataacaaacaaccccatcaacaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtcaactagttcaaccattgtggaagtcagtgtggcgattcctcagggatctagaactggaaataccatttgacccagccatcccattactgggtatatacccaaaggactataaatcatgctgctataaagacacatgcacatgtatgtttattgtggcactattcacaatagcaaagacttggaaccaagccaaatgtccaacaatgatagactggattaagaaaatgtgggacatatacaccatggaatactatgcagccataaaaaatgatgagttcatgtcctttgtagggacatggatgaaattggaaatcatcattctcagtaaactattgcaaagacaaaaaaccaaacaccatatgttctcactcatagatgggaattgcacaatgagaacacatggacacaggaaggggaacatcacactctggggactgttgtggggttgggggaggggggagggatagcattaggagatatacctaatgctaactgatgagttaatgggtggagcacaccagcatggcacatgtatacatatgtaactaacctgcacattgtgcacatgtaccctaaaacttaaagtataataataataaaaaaaaaagaaagaaaagaaaaacacccgtatctgtttcagaagaaaaaaaaaccctaggttaaaaactgagggaaatatgattcaatatatctttcccattaatagggaaaatttaaattgctaacatttttaaggtcatacatttctaacctttttaagatgttacctttggggggaaaaaaagctctctatttgccattctcatcagcatagcctctctccctgggcttctccttggcatttgaattgtccaccatttccacctataggcctgcttctaaactataaccctgctcagatctcaagttacatcacaagagtctgtgttctggaagaataatgcactgaattttaatcatgataattcaggcttagtatctttaaatacaacatagcagatgcaaggttaaatggcagtttcagtctttgactggaattcgccttaagataagaaaagcaagttttagaacatgatcctatgagcctaggaagacagacttagccaaaatattcctatactctgcttactgtaaatgcatgtgattttggttctttcttgaaattggtgttctggtatttgcttaagagattctgagtcgtaaagtgaggagttattttaggagaaaatttttattttgtttagctaaacaattgacagcattactgcccttttcctaactactgaaacttggcaattagcattccagtgttttatgatttataaataatagttttgttacagttctcttcattaaatatgccaagatacatgtttttgtacttatgaatttttgtgtagggaaaatcatttattttatttaaaagtataagctatccacaatctctctgtgtttcaggaggttacaacacataggattgtcccatattattataaaaccaacacaattgtggtgtattaactgttaaagtaaaaattactcaatgacactttttaaagcatgataaggacgactttattcaggaacattgcaaaaggtatagggaccactgcaatgggattttgcagtagaggagagacataaggtaaggttattttcaattgaaattctatggcttgtttatcctatagcattaagagaaaaggaagatataaaattatatatggaattatagttatctatacacacctattcatacacactccagaataaaataaattcaaatgttattagttatctttggataatagcatattagattattgtttttgtctttctgacttttctgtattttccaaatttgtagtagtaaatgtaatgtttagttagatttttggaggatgttttctttatccagaatcagaaattctgaatttcagtattttaaatgaaatccttgtgttctgcttttgaagattacattattaatcacttaaaagatcttagtttgaagagaaaaatcagaatatgcttaattgacataatatattgatgctgaaggactgtgttttcttcatgttgaaaaagtgttctttttgttaccattgactacaaatgcttgagtctcagtatttctatgagataattttgttttgagtttcttttggggtgaaacaaagagaatgctaaattaatgagtttgactcaggtgttctcaaggccagttcattgacaggtgggcaagaaggcatttatagccaagaagcagagtggggctcaatggatgactaagaaacatcgagggtacaggggatgctggctaaaccagccttacaggattcttgccacaaacaggccagggtgatcagatatcacgtggggagtggtagaggatgaggaacacagtatctattgtatagggggagggttcttgctaaactgacttagcacagttcttcccaaaattggattttacatgaagtacacaaatggggctctgtgaagactcgggaccatgactaaagtttggtcaagcaaaactctttatcataacatatttagaaatagatttaaaatctgtaggatatgatatgaaataggtgagtgggggtggtaaaaggctctcttgttcaaggggtaaataaccattgctgaaaatggcaaatctgtgggagtatcttccatattagtccaggctatttgcaaacagaataacaaataacagtttatggcttgataaaaaggaaaaaaaggcaaaatgcctctcctggcttatgactataaggactctgcccaaataatccaatctcattcacacactttatcatgtaaagaagaaaagttagaaattgttaagtactggtgtctgtaccaagtagtgagtgaatgctttgtatccctgttctgaggacaatctcaaaaccttaccgatttttactcccttgctttcactagcttgttctttgatcttgggacttgtcttatcaaaatcatgtgctgttacctgtctcttcccttctagctcagacgtcacatcctcaaagaggtgttccttgactcctggaactgagccaggttcattgccaactctttgaatttccccaaagtagatctcctctcattttaacgtcacaactaaaacaagtgttactatttttaactcttggtaatttccataggagtagagatcagatctatcttgttcaccatcatagtttaatgtctgacctatagtaggtgctcactaaatgacaccagtagttagttagcaatggtgatattagcagtccaaactctgcctggataatctcatctcccttcatggatttagattatcacctatatattaggcacttccaattctctgcttcccatcaacttttctctaccaagttttagacacttatatccatgtgataagggagcagactctagaaccagactacttgggtttctattcttgactctgcccctatttccattcattacattctgtatacaaattctattcagagaagtcaaatcactttgaacaaattgtccttaatttctgtatgttctcagcctccttttctctaaaacacaggggagagaggctgtgagatacagtgtctgacataagttagtgttcaataaatgctagctcttgccattagtaccaccactactactgctgctgctgctgttgcagatgcagttattattctattattattattctcagctatttcaccctatttctaatagaaactatctaaaaatgaactctctgtctctccattgccaaaactatctctacgtctcgtattctctttcttagttcaccgaattcatcttatcaccatccacccaattacctagcagatgcctttgagtcacactcaccttctctcctgcccccagcttccactctgtaccatccagtgaatccctaaaccctgctcatgaggtcttatcaatatctcatacgtatctccttctctctatccccatggctctttttcaggtcccatcaccactagcttctttaccagtcttactgctttcagtctcctacctctgcagtccaactgttccctcagcaaatgttcatcagctactatgtgccagatattgcttacaggcttaagatatagaagtaaacagacgaatagaaaaaaaaaaatccccaccttcatggaacttgcatttcagtggtaaattatataacattaaaagtcagcaagtcccataaaaaaatacaaggtagaaagttgtggattggggtgggatgtttgcaattttaaaacggacagttaggacagatctttttgataaagtggcatatgactgaaaatgaagaaagtatggggatgagccttggagatatccgggagaagtgtgtttcagaaagagagctcacctagtgaggtgggaggacacctagttgctgaagaaatagtaaaaaggccagtgcattttgagtagaggccaaggaaggaaagaggtagaggatgaggtaagagtggcaattatgggccagatacatgaagctctggaggccactataaggatactggttttactctgagtgaaacagaagctattgtagcaatttgagcacagaagagacatgatctgactgctgcactgaaaaccgcctgaaagtgggaaagatagaagctgggagaacagttaggaggctactatggaaatccagatgatagatgctgttatcttggacatgagtgttaccagtggagacagtgagaagtgttcagagtctggatatatttgaaaattgatagctgatggattggaagtggaatctgagagagagaggtttataaaataagacaaaaataaaggatgtctctcaaatgtttggcctttgcaccagaaagatggagtaccatcagtagatatggaaaattgcagaaatcctaggttgcaatgggggtggaagggaaattattggtagttcagtttggggcatattaagtttgagatgtctattggacatcccagtgggagatcttagccagtttattttataagcctggagttctggggagaggtcctggctagaaatataaatgtaggagttgtcagcagaagagaagaaggctgaaggctgagctttaaggcattcacatgttaagaggtgagatcaaaaggcagtacaaacaaagaacaccaaaaagtaacagccagggaagcagaaggaaaacagtggtatagcacccagagggcacttgaagaaagaaattcaaggaaggattgatttaacaaataagatttagaattgaccactggattcataatgaggagagaagtttggggagaatagtgaggataaaaatagtgaggataaaaatccaattagtctgattaaaatgagtttaggagaattgtagaagagaaaatggaactaataagtacagacagctttttcaagtatttctgttataaaagaataaagaaatggggtggtaattgaaaggagaactggaatcaaagctaagttttaagattataaaagtatattatgtatgaattctaatggaaatgatctagtagagaggcaaagacggatataggagaaaaataatcagccaaggagaaaagtccttcagaatgacatgaggaattgtcccttgatgggaggactgacactttctccattataaaatgagggaagaagagccacctatgcaggtgcaactgggttggatggcaggaagataaagtagttcacatctgatagtttctgtttatcagtggaatataaagtgagatcaacagctgagaatgaggggatagaggcagtctcacaagtttgattatgaaattgctgtctcagaaaataaaaacaaggctactagaaaaacagtatttttttttctttctctgtgaggttacagtgtaaatctccaaatctgatagaaagatgaggcactcatcttcaggtgtttaccacctgtacacctgaacattttcttctacttgttcctgttatagcctcactgctacttgatgcttgctagaattaattaacaatgctatattcttggtatctaaaaggcattttatatatgttatataactggatctttataataaccttgaaaggtagagtattttgtccttatttttcaaaaggtaaaaccattttggagaggtcggataacttgcccaaaagcataagagtaataattcgcaatatctggatttcaaccctgatctgtgtgattcaaagtgttatttctatgctttgtaaatatacctctacatagaaagacattatatttcttcctttaaggatgaaaggcaagtacaaaatatttgcatctatggatgtctagcataatgcctggaaaagagtggccctcttataagtacttgtcaaaagacagaatgttttttatttaaccatcacaataacattatactgtccatttacacagatgagaactaaggctaaataactcactcatgatcttatagcaagttagaataagtgaccaatttgtaacactaactcagatcatctaactcctaagttctcattacttgttacaggcaaaattgtgtccctacaaaattcgtatattgaagtcctgagccttagtacttcagaatatgactgtatttaaagacggggtttttaaagaggtaattaagtgaaagtgaggtccataggatgacccttaaaaaagatgactgttgtccttacatgaagatgaaattagtacacaaacacacgcagagagaagacgacgtgaagacaatggggaggaggtgaccatctaccaaggaaggagagaggtttcaggagaaaccaaccctgctgacaccttgatctcagtcttctagcctccaaaactgtaagaaagttaatttctgtggtttaagccacccagtctgtggtactttgttatggcagtcctaacaaactaatacaacatctctcccactattgtagaaacaaagcatttcacttcttccatgggtgtcaatatgttgaattactaactcaatatgttgaactatatggccttctgagaaataattcagttgtgccaaagtccccagcaatcataatcacttaataaatagttttggataaataaatcattaacaaataaatttgcataacaaagataagcctctaattgctccagatcagacttccttgaactggagaaatgagtgactctgcccatcaatgaactgaccttgagaacacctgagtcaaattcattaatttagcattttctctttgttccatcccaaaagaaactcaaaaaaaaattaccctatgtaaatactgagactcaagcattggtaacaaaaagggcactttacaaacatgaagaaaacatagtcttttggcatcattacattatgtcagtgaaggatattctgatttttctcttcaaactaagatattttaaatgattaataatgtaatcttcaaagcagaacacttggatttcatttaaaatattcaaattcagaattcctgattctggataaagaaagcatcctccaaaaatctaactaaacattacatttactactacaaatttggaaaatacagaaaagtcagagagacaaaaacaatcatctaatatcctatcacccaaagataactaataacatttgaatttattttattctggaatgtgtattaataggagtgtatacataactataattccatgtataattttatatcttccttttaatgctataggataaacttatttgcaaatcttttaaaatctgtatacaatttgcacagtagctacaccaaactttatgtaaacattctttttttggctttgataaaaataattgatctcatcacatgatcctatatgtgaaacaaccttgtgggggtacatacatataaaatatgctttcttcaaacaaatgctaggctataaaaaacgcacaataagataacttctgaggcaggtgtggaggaaggggcttctgagaagaagtactgtcactctctactgcatgtacttctgtgttatttaaggagcattcattatttttgtaatttaaataatttaaaataacactgcagtgaacatatttgtgtataaaactcttcctaaatttcaaattatggtcttggtataaattcccagaaatgtattattaaatcagagggtctgaacattttgaagccttttgataaaaactggcaaattgctttcctaatgagttgtcatgagtatattcttgaggaaaatagtaaacaattgaaccagaaagaaatatttctcatcacaaatttaaatgagcttggctcaccacagttcaattctaaatacatacccttaccccttttcactattttctctcactgagaaagctgaactagataatcatttcaatataatgtacatatacatagtgcattatactggaatgattatctggtttgaactttgaactagataatcattccaatataatgaaatgaaaggcttattttatatataatatgttgttttatatataatatgttataacatttttatgtaatattataacactttatgttatgtagctttatatataatagtttattttatatatattataacatacataatatatataaataagtctttcattttaatatcactaaaaaagcatacttataaaatattatatatgtatttagtctgcttgacttttaataaacacttgaaagtctttttctgattataaaaaactgtgcaatagcttttaatatcaggttattttattgatttaaaatgtgaaatacaaatagatgtcatctttgttacaaaatatctatttccatagttaatttgattactttaaaattctaaaataaacttaatgatgatctttggatgtttcaaatgatagattgattagaacaaattttattcagagcatgaaataattaggttggtttcctattttcttgaaagataattatcagattattcaaagcgttttatggatgtgttatttttgctttaatgtggtcaataggtctagacacagaagttaaaaaacagcacaaaaagttcaaatagttggttgtattttaagcataaaaccaaggagagtagcaaggtatcatgaaaagtgtccagggttttgttatgggcagacctgagttcaaatctcaactttgctgtttattagctttgtgacctaaaagttattagaagttatttaactttgcttagttttagtatttttcatttatagaatagaagaggaaaacaactgcaatggcttttaacactgtaacttaattgatgcttaataaatggtagctatttttatcatgctgaagacaagaaagatgtgtgctatttcacattttttaaatagaaaataaattatagtatctattacctgaattctatagctatgctcacatactagagactattttatttccatctgcacataagaatttacatatatatagatattttctcattttcattctctgagatctgacatataattttatatactaatttcaaatataagtatatttaaatataaagtttttaagtaacatgtaaacagtgtgtgtgtgtatgtatgtgtgattataatagtcctaaccatattcattcattcaacaaatattcattgaacacttttacatatgctcagtattgttctaggaatcatggaaatcaagaagtcaaaaaagtcaaaaaaagtgacaacaattcttacctacatagaacatgtattcaaatgcggggcggggaagcagtgaaaaggcaaataagtaaaaaatatagcacatattaaaaagtgatagctgctaaggagaaaaatggtcaagaaagtgagataaaaattgggggggttgcaaatttagaatagagtttagaaaagaaggccttactgatatgccatttgaataataacctgaagaaagtgaggaagccagccacatggatatgaagtaaaagctttccaggcagagcaaacagcaagtgcaaaagtactgaggtggggacatgcctggaaaagccctataaatgccctcatgggggtattatgaggattaaatgaatttagcacatgtaaaacaccaagaatgtatctgctacatagaaagagctccataaattttagttattatttgcagttcttagcattagtcattttatttaaaaatcattaagtaatatttttatatttgtttcaaaattttcagtttctatccaggtatttggaattatgtatacttagcctcatatcatttaggccattgtgtaaataatttctagttttaatcatatgtaatataatgacatattctaaggtaagacaggttctatccctcctttcctactacatttaaagttcttgatttctcctgtatctagcacagtaatgacgtacactttatacatgtttataaagttttcttcattgactgaaggaatgaacatgctattttttggtaactacttacagtttttgcagattgtcctcattcactacacgacagtttaactgtgttttctcatgcagattataagttggaaagctctcattagctcattcattaatttttatgattgcctacaagtatcattatttagtgcaatataaatatggtgaaaagatgctattcatgtagggagagctgttataaatcaggaagcttgttagtgattgccagttgaactaagatctgctatgttttactacatttcagaaaataaatccatctggccttgagttttactatttcttttatctatttgctaaaggttgattttgcattaacaagaaattataaaagtaaagacttgaatatgtctaacattttgaatcagcttatttatattagcttccagaagcaaagggtaatactcataaggtcaagactagtgttgcatttagaaactgtataagtcacagtattatctgggtgaagtacaatgaacatttgtttgacaactttgacatctgcttcgccgtactagaaactcttaatactggaatccgcaagcacaaatatacatctgtttgactcaaatgaatattagttgaagaataatgacctgaaaactagatatcccctgagggtagttttataaaattaccaagctgttttgttttctatttaaagtgtgtttgacatcagaaaagactacattttatatagcagaaatatgagaaattagtctaagtagtttttaggagaaaatatgcattcttaatgttactgttctgagcatggttgagtggtagcatgtaacttttctgtacctaaaatttcacagtaaaaaattgaagtgctgtggtaaattattattaatactgtattgttctatgaaacaaactaagagatttaattttcgccattagtcgaggaccacagtaatttcattgtgtgagaacacaataaaaccaccacagcaccagtaatttgggaccaaaaaatctgaaaaaatatatattatggaaataattatttactgtaaagcaaaacttcttaaataagtatgttgaggagaaaactactataaatcagactttaagagacaataagtcccagaggacccaagaaatataaatcaagacaggaaatgtgattgtaaaacaaagagcaaagaactgtaaatcaaggctggatattccctaagagagacacatgaagcactggaaggattttagtcaaaaggtaggagagtttgtaccatgacggaaaagaatagggctaaaatttaaatatcagatagggaagaaactgtttataagacgtgtggtttgaactcagtaatcactacacgtttctcatcttcatattcagcccattgtcctccgtctcaattgcactttcatttctgtgatcctgctctcccaaacactgctatggctcctccccacttaactctgccctattgcctggccatgtacccaaccaacctcctcactgtgtcttccgcaaagcccccagaacctactactttgttattatcaaggtctcatttagccttactgtttccattcagtaggtcttccacatcctcatgttgatttacagcttacttgctacgcatgacacctcttgctttggctactgtcatgtataggcctctgggtcttgcgatccatgtatgatgcagtttcaatcctctaccactgatgtctctttccattgcattgacttatcacttctgttttaacactttttgaaatccatgattttaaaatacaaacatcttgccacgcctcccagtccttatcactttacaaacattcctccatattctaaagttcatggttgtattatggaatcaaaatttttctttctcctcatccattttcttacagggcatcaacgtcgaccacccgtttaactgtcttcagagttacttcacttatcatatttgatgaacttgcttttcatttgacctcaggcactcacacacacatgacagtattgtgaatttataattacccggaaatgctcaccccgaagatcttaaactccatatatttgtatcaaagaaatgttcagaatggtggccggggcggtggctcacgcttgtaatcctagcactttgggaggccgagacgggcggattgcctgagctcaggagttcgagaccagcctgggcaacacagtgaaaccccgtctctactaaaatatgaaaattagcccggcatggtggcgggcgccattagtcccagctacctaggaggctgaggcaggagaactgcttgaacccgggaggcggaagtcgcagtgagccgagatcgagccactgcactccagcctgggcaacagactgagactccgtctcggaaaaaaaaaaaaaaaaatggttactgagcgccatggaagggcactggaggctggaaagactttgtcgtatttttcatagataagacttttagcctcaacctcgtgtattttttaattcatccagaatttacctaatactcatttattgtaggactgggctataatggcacaatcgaaatgcattaaatcaaattgtaagaagagtaatttatgttaagacgtgtagaaccaaaagactagaatgcctatgtctatttgtcagtgcacgtttcttctgtacacataaaataattactgcaagtttgctttagtaaacaccagaggaatcatcaaaaggaaatgaacaataatgaataccataagtgaattaggatagcttggtacacccatctcctgccatgctctatggtcaggatgatgcctgtgttagacggtgctgaaaaatcaccaacaccttgtcattgtttggctctattttctctatgtgtgtatattagtccttcaacagacagttactagagaaagggatcaaactagttgattaggagacagccagagagcatgggactagaagagtgtccactatgccattttcttagccatgtggcttctacaagtcacttagcctctctaagccgctcaacttcttaaatgtgaaaagacaatgctatcttcctcttattagctatgtgaccacttaatgagataatgtatttgaaaatgctctgtaatttgcaaaactttataaaatggatatatgcatatctgttttaacaaacatgccaagccaagcaacatactgagattccttggtaaaaccacactataacttcacaaagaacgtatttacacactgcttaagatggatttcttatatgtaaataaccataatcattccatattaaagcttatgaaattctatttccaaaggtaacatattccacatgtttttcccagctgatgaagtataacctaagatctatatactgaccatgttccacccttctacatcatccgttctttgcctcagctggctgatctttgtcatcttccacacttgaccttcttgatttcttccctttacttagctggcttctctctcaaactgtctgcttccacatcagctgtcagcatttcctcactttgcattcagtttcttccactgccgataatcaactgctcaatttaacacttttaaaacttatctctgcaaaaataagaataacctcctaattatctcactcaatactctctttccagcactcaggctataagacgttgctgcaggatttgatacttcttaaaacctctcctcccttggtgtttacaacaatgaagaaaactgagttgacattcacatagaaaaatgaaagaaactaaaatctttttttgtaattatactttgagttttagggtacatgtgcacaacctgcaggttagttacatatgtattgttttaaagcattagcgaaaactctcaaataattgccaaatttcaggtccacttttcacctcaaatttgaaactagaagtgcaatactctgccataaccactgtcacaattctcaataacttccaacatcctgctcaaatatcagtttgagcttttcctgcccttttaatcactccctcctctataatcccaaattttggcttgtaatacagcatatatcagacccagaattgtagtattttacgcgtattaatctacctttacaggcttctacagagtccatgcaaacatgcaattcgttccacattatagatattcaacaatggatttttgaagaaaaaactgatgtcataatgcattaacccactctatgttattttcctgaaacatgctattatgcaaaaaatactaaaattattgtaaaatcaaagacatgtatcttaagattattcaatggttttacaaatattaggcaattcaaatttggatatttgataaacactgggtttctggaatttagagacaaggattttaatgtgactgttttaatgaagcaacacaagtgctaatatttttatttatttcacaactgaattgaagtaaataattatttccatcagtaatgggaaataattcttttctgaaaagaagtagactagtttgtgggctcttagaatccttcacacactatggttgaagttgattggcttatcattccaattcttgtgaacaagtgacagagagtttgtgggctacacatcaagtttaagaactcaggttataatctagttccaaaaggcagacatagcagatgacggtcactttcacttgagactccaggaatttggtctatttagttcattttgtatatatgtgcttttgttggaagccaaggtggatttgttccatgccaaaaatcaattatcatccatattttaatttactgtccagaagaagatgcagtgccagatgctaccgaatattagtcactttcttatttcaaaatgaaagacaggggagggggaaagatgttggtcaaagaatacaaaatttcaaaatttcaattagataagtggaataagttcaggagacctattttataacaaggtgactatagttaataacaatacattatatctttaaaatttgctaaaagaatagatttgaaatattctcaccacagaaaagatatgtgagataatgcatatgataactggctcaatttagtcattccacaatgtgtgtatatatatatttcaaaacaatacgttgtacacgatacaattttgtccatttttttaaaaaagaaaaattttaacacctttcttctattttctatttttaaaattactggattctgcttatatttgatctatgcttactataaaagtttacgggatatttttggtaactgcactttcaaaactcttaattataactcttgtacatatgctgataagagtaattagtcaaatgttttcaggttcacttttcaactctgtcaaacacttttataagctatcatttggatcattttttctctcctccttcaaaaaattatagaaatcgctgtgaattccaaatgcgtgtctgttttattctgttaaatcagatacttatactgacaacctatcaatacactaaattagtacatgtagctaacaagcatgtacaagtttaactgctgtataacaacatttaacagatcaacaaacacaacagcttgtctctgcagggtttaataaaccatatttatccacagcatctgagaaaaacagaagagactctgatatatgttatgttctttttataagtacatgaaaataaatatgtaaaagtaaatgtggtttctatttctattcgtgagagtagaatgtactaactgaggtcataacttgaactgaggtttcattaagggggaaagcactttgtcttttatgttctaaaatagacttcttgataaagaaaaattatgcttaaagattaattaataactggctggcattataaagtgttgcaatgttaaattataataaatattgattttaggaataagttttgaatattttatttttacattttctctgtaaatttgtgttagtccatttaacttcaaaagtattcttcaccacattatttaaggatcacacttaataattttccactaaaagaatcctgtttaacagaagtaatatgatgtgataggttaaaagcaaatattttgatattaggcaagcctgggtttaagccccagttcttccacttgttaattaagtggccttgagataattcctctgtcttccttaggcttaattccctaacttgcaaattggtgaccatgacagtttctgttttcaatggctgttatgaaaattacatgagaaagtaggtaaagtgctaagtagggtgcccatcctataacgtcctataattagcttcaactcttacacctcctcaacatctgttgctgttataattgttatttattactattgtaacaccaatgaagaaatactgttattgcaaaaagcatttgagaaattgtgaagaaaattaccaattttttaaaaggcaagttgaggtgaaagaagaagaagctaaagcatttggaatgagttcagtaagtttggtgaagtaaagacaattgaacagatacaattagaccatgtcaaaattgttaacattaatgtaaccccaattaacctttttaaaaatataaatagccataaaagttaattaaggtatttactctctttaaggagggagaagtacaggtgaggacgtattaagacactgaaagggtagaaaggatacaggtgctgagcagttgttatgcaagaactatgctggatgtactttcctcagaacacttccataagatattaatatctatattttgcaaataaagaatctgaggttcaaaatagccaagtagtttgtccaaaggtcacatagctagctaattgaagaagctggaattaaaacccaggtttttctaagccaaaagccctttatagttctgtcttcagttgtgtgagattatgaatccaaaggtggaaccctgagtatgaaagggagagtcctgaaataggaaaagttaaagaactgaagaaggcttttatgttttactcagatttttctctttaaaattggttataagttatgacataaagtttaaaatattagatgatattccaactttctctgttttgatgttataaaaccttgtgaactgggactccaaaattattgacataagctgggaatttattctaaactgtgacatatttgctctaaactagacttctaaccaactgaaattcaatgacttctgaaatgtgggttctcattcaactagacaaaatgtgtcagccagaaatgtatgacacagtggaggccagaggtttttacagcagcaagtccctaaaaaaacaacaggatcaaatatgctatttttaaaaaattacccaaagatagtttaaggtctgtgctcttagtataattcccttttgtctcactttacattgggatactttcaaatctcctgctaagtggattgacattacaaatgactctaatacagagcaggtttttcctgaactttcctagacagtcaagtggagagatttctaaatataaaccatcttattcatggtttcattgctgtatataaataaaacctgtcccaaccctgtatgaatttttaaataattttcattaataatctcttgggcagcttcagtctcactgtgaaggattcactcttgaacatttcgattgactcaattaattgtcaatcttatttagaagttctaaataagagagatagctattataatttgtgaatgatgcagctagagttgcaaagagtagctcattccatacttcatcactcatttttcagggtatattaacaatgtctttacaaaggtttgattatatttctaaaatgaggtaactctagaaagaaaatatttttgaagctgttcctctctctttttctcactacaagctctgtcccctaaggcaattttatctgagggttcagcacatcatctaaggatataaagtagtcttgctgcttaagcaaatgaggcattaaggctgttttgtattcctgtgggctatcactgtctgtactgacaatgcagtggtgcctgctgcttgagataggggtaggaagggtggtttggaaggggattgcacgtgtgtgccataatgaatctgttttatctttgaacaattccatatgctcttgtgaagctatcaattctttcttttcctttttttttctccttttaatgccaagataaattgatcctagattgctgctccaaatgctgacaccactgaatatgaaggtgtcattgtaaaatgaaccatagcaaattcttaataagcaagcttcacaaagagttatagtttttgacattcagatatagacttatccccagtgaaggaagctttgttcagcccatgcatgctaagaggaataaaaaataaaaagtaatttgattggtattaaatatgttttattccttcctatattgagcaatcatatcacatgacttgtccacttccatcttacaggaaaattggaaaaggaatgatttcaaatcaagaactttatttctaaaaaagttggaacgagtttagagctaacgcttccagtgctatctggaggagatttaaaatctgacttccttgaaaacttcaaaatcagttgtgtctgagaaaaacaaattagtaaattctatagaacatatgctataaaaacaattactaaagttttctaagctgattatttcaggctaatttctcttctaaaaattagtatatcctagggagcctactttctaaattaatgggagcaaatgcttagaaaacacttttatacttgataactcagtttggaaaaaaagaatatgggaattagctctatgatgattattacaatttacattatcttgaacagagaagaaacagaccattttgataagttcaagaacattaacttttttttctctttacaagtcctgcataaaaactcctcaatggatgttgctttaaaaatatataaaaggcaggtgtggtggcatatatctgtagtcccagatacttgggaggctgaggtgggagaattccttgagctcaggagttcaagtctatcctaagcaaaatagtaaaaccccatctctaaaaatacatatatattttttaacatacagatatgctacaaatttaagacagtttattaatttatatgtacaaaagcaacctacatatttaagataatataatcagtaattataatataatataatcagtctgatatgaagttttgtcttatatttccagctgtgagcaactttaaaaggaattcattaactaactttattacagtatttccagaaaatagttattctgtgccacattggtttggtgatgcttgattagacttttattatgaaatcgactcttgtgtctccaaataataactgaaaatgcaaacatttcaaaaagttttaaccctagatatattctcagtataattcaacctgttatatataaattggctttttgtaaatagattccatacaccaagaatgtctagatttcaatgcattctgcattaagtccttctgtaaaacaaataattgttttgcttattaatcataactttggatatctgtttgcaaattggcatcatatttgctcacagttctgcaattcgtctttttctctaaacattgtgtttttgaaatttatccatgtttatatacaggtagctctagttcattcactttaaatgcttcacagtattccatcgtaggaatgcattaagatgtgcttattattttattcatgggtatttgtattgctttcatctatttgctgttaccataatgctaaaaaaaattattgtacatatctcctttggcatgtatgcaagagtttatctgagagaatatacctgaattggaaacacggaatttatggcacaccttcaacattaatggcaaatagcttctgaaagtgtttgtatcaatagatactacctcagcaatttctggaagtttcccctgctcattcatttgttcatttaataaatatttattgcacattcatgtgacagactgtgttctagaaggggatgtatagcagtaaaccaagtttataaaactctctgtctaaatgcagtttgcattctaatgtggggagacagaaaataaatataaatacataatatctcaattgggagaagtactatggataaaaatgaagcaaggagaggaataaagagtgctagaataggagatgcaattttaaatacagagatcaaggaaaactgtactaggaggtgatatttgagcaaataactgaaaggggtgaaggaaaaaagctatacattttcactcttacttgatattatcacactggttaacttgtgttagataaatgaaggtaaaaatttgtctcattaggatttttaatttttttctgacatcaagcatgtattcatgttaatttaccgtttgtgttgtccctattgtaaattgctagctaatattttaactcatttttctaaagtgttactttcctaattcttattgaataggagagatccattattaaattttgggggtatatagtaggtgagtatatttataaggtacgtgagatgttttgttacaggcatccaaagtgtaataatcacatcagggcaaatgaagtatctatcacctcaagcatctattatttctttgtattataaccattccaattatactctttgagttatttttaatgtataataagttatcattgactgtagtcaccctgttgtggtagcaaatactagatcgtatttatttttttttatatgtactttaagttttagagtgcatgtgcacaacgtgcaggttagttacatacgtaaacatgtgccatgttggtgtgctgcacccagtaactcgtcatttaacattaggtatatctcctaatgctatccctcccccctccccccaccccacaacagtccccagtgtgtgatgttccccttcctgtgtccatgtgttctcattgttcaattcccacctatgagtgagaacatgcagtgtttggttttttgtccttgagatagtttgctgagaatgatggtttccaccttcatccatgtccctacaaaggacatgagctcatccttatttatggctgcatagtattccatggtgtatatgtcccacattttcttaatccagtctatcattgttggacatttggcttggttccaagtctttcctattgtgaatagtgccgtgataaacatacgtgtgcatgtgtctttatagcagcatgatttataatcctttgggtatatacccagtaatgggatggctgggtcaaatggtatttccagttctagatccctgaggaatcgccacactgacttccacaatggttgaactagttggcagtcccaccaacagtgtaaaagtgttcctatttctccacatcctctccagcacctgttgtttcctgactttttaatgatggccattctaattggtgtgagatggtatctcattgtggttttgatttgcatttctctgatggccagtgatgatgagcattttttcatgtgtcttttggctgcataaatgtcttcttttaagaagtgtctgttcatatccttcacccactttttgatggggttgtttgtttttttcttgtaaatttgtttgagttcattgtagagtcttgatattagccgtttgtcagatgagtaggttgcaaaaattttctcccattctgtaggttgcctgttcactctgatggtagtttcttttgctgtgcagaagctctttagtttaatgagatcccatttgtcaattttggcttttgttgccattgcttttggtgttttatctttctaactatatttttgaactcattaattatccccacttcccttcttcccaccactaccctccccagcctctggtaaccatcatcttgctctttatgagttcaatcgttttcatttttagctcccactagtaagtgagaacatgtgaagtttctctttctgtgcctggatttttttcacctaacataatgaccttcagttccatccatgttgtttcaaatgacaggatctcaatttttatggtcaaatagtactccattgtgtatatgtaacacattttctttatcaattaatctgtcgacggacacttaggttgcttccaaatcttcactattgtggctagtgctgcaatatacataggagtgcagacacctttttgatatactgttttcctctcctttgagtatatacctaggagtggggtggctggatcacatggtaactctatttttagtttttaaggagcctctatactagtctccataatggctttactaatttacattcccgctaacagtgtacaaagattccttttgctccacatccttaccagcattggttatagcctatcttttggataaaagccattttaactgggggtgcaacggtatctcattggagttttaatttacagttctctgatgatcaatgatgttgagcacctttcacatacctgtttaccattcatttgtatgtcttattttgagaaatgtctattcagatcttttgcctagtttttgttttgttgttgttgttgttttgtttcttttttctttttttttttcttcttcctgaaacagagtctcgctgtgtcgctcaggttggagtgcagtggcttgatgtcagctcactgcaacttccgcctcccaggttcaagcagttctccctgcctcagcctccctagcagctgggattacaggcacccaccaccatgcccagctaatttttgtattgcccagtttttaaatctgattaatcgatattttcctatagagttgtttgagctccctatatattctggttattaatcccttgtcagatggatagtttgcaaatatttttccccattttgtgggttatttcttcactttgttgattgtttactttgccatgcagaaactttttaacttgatgcaatcccttttgttcatttttgcttggttgcctgtgcttttgaggtattattcataaaatctttgtgcagaccaatgttatagagtttttccagtgttttcttttaggagtttcatagtggaggtcttatatttaagtctctaatctattttgattcgaattttgcatatggtcagagataggggtctagtttcatttttctgcatatggatatccagttttcccagcaccatttattgaagagactgtcctttcctcagtgtatgttcttggcacctaagttggaagtgagctcactgtggatgtatacatttattcctgggttctctattctgtaccattagtctatgtgtctgtttttatgccagtaccgtgttgttttgatcactatagctctgtagtataattggaagtcagttaatgagatttctctagttttgttcattttgcaccagatgactttagctattctaggtcttttgtggttccgcataaattttaacattgttttttctatttctgtgaagaatatcattggcattttgatagggattgcattgaatttatagattgctttggatataattgacattttaacaatattgatacttccaattcatgaacatgaaatgtctttccatttttttacatcctcttcaatttccttatttgtgtactattttttatgtcctcttcaatttccttcatcactgttttatagttgttttacagatctttcacttctttgattgagtttattcctagatattgcatcttatgtgtacttattgtaaacaggattatgttcttgattgctttttcagattgttcactgttggcatatagaaatgctactgatttttgtatgttgattttgtatcctgcaactttactaaatttgtgtatcacctctaatagttttttgtggagtctaggtttttccaaatataagaccatatcatctgtaaaaaaaggataatttgatttcttcctttgcaatttggatgccctgtatttctttctgttgcctgattgctctagcaaggacttccagtactctgttgagtaacagtggtgaaagcaggcatccttgccttgatctagatcttagaggaaagactttcagttttcccattcagtataatattagctgtaggtttgtcatatatagcttttattgtattgaggcatgttctttctatactcagttttgtgggagttttattatgaaggaatattggtcaaatgcctttttatcatcaattgaaatatcatatgatttttctccttcgttctgttaatatgatgtatcacattgattggtttatgtgtgttgatctatccttgcatcgccggaatatatcccacttggtcatgatgaatcatctttttaatgtgttgttgaactcagtttgctggtgtattgttaaggattttgcatcagcattcatcagggatattggccagtagttttccctttttgttgtgtctttgtctagcttagtttcagggtaatactggtctcatagaataagttgggatgtattctctcctactctattttttggagtactttgagaaaaattggtattagtatttctttaagtgtttgataaaattcagctgtgaagtcatcaggttctaggcttttctttgctggaagactttattacagctttgaactaagtacttgttattgatctattcaggttttgaatttctccctgcttcaaccttggtaggttatatgtatctagaaatttatctatttcttccagattttccaatttgttggcatatagttgctcatagtagtctctaataatcttttgaatttctacaatatcagttgcaacatctttttcacctctgattttatttatttggctcttctctcttttttcttagtttgtctggctaaaagttttttgattttatcttttcaagaaattatctttttcttttattgatcttttgtattttttgttccaatttcatgtgtttttactctgatctttattatttctttcctcttactaactttgggtttggtttgttctttcttttctagttctttaaggtatatcattaggttatttatttgaagtttatatacttttttatttaggtgcttattgctgtaaatcttcctcttagtattacttttgctgtattccaaaggttttggtatgttttgtttccattttcatttgtttcaagacatttttaaatttccttcttaatgtcttcattgaccccactgatcattcaggagcatattgtttaatttccatatgtttgtataattttcaaaatttcttttgttattgatttctagtttgattctatccttgtcagaaaagatacttgatatgatttcaattattttaattttttaagacttgttttgtagcctaacttatggtctactgaatgaaccatgtactgaagagaagaatgtatattctttagccattggatgaaatgttctttgaatatctcttatgtccatttggtcatagtgcagactagtgtgaaacactagtccagtgtttctttgttgattttctatctgaataatctttccagtgctgtaagtgggctgttgaagtctccagctattattgtatcaggggtttatgtctctctttagctctaataatatttgctttatttacctgtatgctccagtgttaggtactgaattaacccctttatcattgtataatgaccttctttatctcttttcttagggtttgtcttgaaatttattttgtctgataaaaatatagctacttcttatcttttccgattcccatctgcatggagtatatttttcgatctttttatttgcagtctatgtatctctataggcgaagtgtgtttcttgtacatgagagattgttgaatgttgtttttttaatctatttatccacgctatgtctttttattggaaagtttagtccatttacattcaatgttattattgacaagtaaggacttactactgccaatttattatctgttttcagattgttttgtggtcttcccttctttcctttctttcctttctttccttcttccttccttctttcctgtcttctttttgaggaaatgatttttctttgatggcatattttaatttcttgctttttattttttctgtatctgttacagagtttttgatttaaggttatcatgaggtttgcaaataacatcttataacccattattttaaactgatgataacactgattgcaaaaacaaacaagcaaagaagaaactaatgaaaactacactttaacttcatcccttcttttaagctttcagtagtttccatttatatcttactgttttaagtcttgaaaagttgttgtagttgttatgtttgacagattcatctttcatctttctactcaagatacaaatagtttgtacaccacaaatacagtgttataatattctgtgtttgtgtacttgctattactagggagttttgtacattcagatgatttattattgcttgtttacttccttttctttcagattgtaaaacaccctttagcatctcttgtaggacaggtctggtgctgtcaaaattccttggcttttatttctcatggaaagtatttctcctttgtgtctgaaggatatttttatgggatataccattctaggataaaaggcttttttccttagcactttaaatatgtcatgccactctctcttggcttgtaagttttccactgtgaaaccagatgtattggaggtcatttgtatgttatttattccttttctcttgcggcttttagaatcctttctttatccttgacctttgggagtttgattattaaatgccttgaggtagtattctttgggttaaatctgtttgatgttctataatcttcttgcacttgaatattgatatcttcctctaggtttggaaagatctgcgttattgtccctttgaataaactttctaccctagtcttactccgtgtctcctctttaaggccaataacttagatttgcccctttaaggctattttctgtatctcttaggtgtgcttcattcttttttcttttatctcttctgactgtatgtttaaatagtctatcttcaagctcattcattcttttttcttcttgatcaattctactgttaagagactgatgtgtgtcagtatgtcagttgcattttttagcaccagaattcattaatttttgttaattattttaatctctttgttaaatttatctgatagaattctgaatttttttctctgttatcttgaatttcattgaacttccttaaaacagccattttgaattctctgtctgaaaagtcacaaagctctgtcactccaggattggtcactggtgccttttagtctgtttggtgaggtcatgttttcctggatggtcttaatacttgtggatgtttgtcaatgtttaggcattgaacagttaggtacttattgtagtcttcatgatctgggcttgtttgtacccctctttcctggaaaagttttccaagtattcaaaggaattgaatgttgtgatttaaatcttcggtcaatgcagccatatatacattagggggcaccccaagcccagtaatgctgtgaccttgcagcctgttagaggtactgccctggtggccttgggtaagatccaggaaatttccttgtattacaagacagagactcttgttctcttcctttacttttcgctaaacgaatggagtatctctttctacggtgagctgcttgatgttgagggacgagtgacacagcactgctgtagccaccatcactgggactgtgctgagccagacctaaagccagcatagtactgggtcttgcccaaggcctgtaacaactattatctggctacaactaatgtttattcaaggcccaagggctctttggtcaacaggtggtaagtacagccaggcttgtatcttttccttcaggacagcaaattcctttctggcccagggtgggtcttgaagtgctgtctgggagccaggacctggagttgagaactttagaaatctatttggtgctttattttactgtggctgagctggtacccaagttgcaaggcaaagtcctttttactcttccgtctcctttcctcaagcaaaaagaatctctccccatggccaccactgccccaggcccatggtgagtactgcctggctaccactgatgtttattcaaggcctaagggctcttcagtcagctggtgttgaatcttgccaggactgaatctcccccttcagagaagcaggttcccttctcacccagggcagctgtagaaatgctgtccaggagctaaggcctggaatcagggatttagtgctttaatttactgtgtctgagatggtgcccaagttgcaagacaaagtcctttatactccttcttccttttttgtcaagtagaaggagtctattttcatggctttcccacctgggaatgcactgggtcagacctaaagccagcacggtactgggtattgcccaacacctgtgccaagtactgcctggctactgctgatgtttattcaaagtccaagggctttttagtcagcaagtgatgaatccttccaggaggaaatccttctcctaaaggcagagggttcccttctggctcagggtatgtctagaaatgttgtctgggagctagggtctggaatagggacttcaagactccgtttatgctgtattttactgagattgagctggtatccaagttgcaagacaaagtccttgcccaggaattgctgttcttttggcttagactgcctttcaagcttatttagaaccccagagcacttcagcccacggtggtggggcttgataaaactcaagttctgaccagtgggatggatgattcccctctggctagggatggtctaaatgctacctctgtgtgcgccagctgaattctgccccatattgctctccaccatgacagggtagcactgagttccagtgcaaagtcccacaatcagtgctgtttccatcctgcaagcacacattctccatctgcaccacatggctgctgctggggcatgggcgggtggtggtgtagacaattcaagactgtctttcctaccctcctcagtgcctctttcctcgatacaatgttaaaatcaggtactctaagtgctcacctgatgttttaatcttatgaagctgttttcttgtgtggatagttgtaccgtttggtattcctatggtggggacagttgctggaaggttctattcagccatcttgctctgcctgtgctctgagagcttttcagtttttttgttgttgttgttgttttaatacattagggataagattcctttgttgttttcatgtgttacaaatatcttccaccatttttggcttaactttttacatatttacaatattttttcacacagagaagttcaaattttattattacttttattgaatttgccaatcttttcataatggtttatatttctttcttatttaagaaatcaatccctatcttatatatttttctccaaatattcttatttctgttctttttcacattttatctttaatctacttggaatctatcttttagtgtgctgtgaaatagtgatgcaattataagattttcttccatgtagataacaaattacactatcatcatagttgtatttttaatgtacagattgtatctctgcttaaatgtaatttgcagaaagaatgtcttaaccattcccattgagttatatcccacttttatatgtgctataatgttttataattctccttcttaaaaatcaaaataattttaaataattgattattcatgtaattatttattaatttctggtttcaccccttctcctccccaaaattataaatttcatgaggacataaaccatctctcacttaaatctataaccttggtcctgacgtggtacgtaattcagaataaatgcctgtgaaagtattcaactgatacataaataaattattttatttccataatgtgtgagatgaaaatacattgatttatgatgccttgagtttttaacaaggctgaaaataaccttaaattttccacgatttatgtgatactgagtaaacgctactgcttgaactcttattataagttttttatttgtttctaaaaggcttccacttacacagctggcttcttccatccaatttgtaagggtataagagatacaataggtatccagtatgcaagtcagtaagacatgtaaaatctgtgacatcgcatcctacctcccacctggccaatttatctacaattacatagaactgtatatgagccattttcctgaatataagagttttttgttatgttttgtttttaccttttgggttcttgaaatgagttcaacttattaaaatttgggaaattctttccaaataatttagatgttagacaatgaatttctaatgattctcaaggtattacttctttaaagttggaacagaatgtgtaataatcttttctttttcagtaaataatataagttcattttacaaccagttgctcacctctagcctagagtaccttcaatgtttccagaattctgggctgtcagtttttgacattttaaagtcttatcctgacagtttgtttgttgttgttgttcattttctgccttttaaaaaaatagttggggagttcaggtggacttcataactttgacagagatcttaaatgtggaatttatttatttatttatttatttatttatgcattcaaatatttaatgagtgcttactatttcccattgattattctaagtggagaagatacaatggtgaaaaagacatgcaaaattcctgcactgattgcgcttatattgttctagggaggtacattacaaaaaaaaaagattatataatgttaggttgtaagaaaaatagattattgggatagagagtgacaagcagggtgcttttttagatagggttaccaaggaaaagaataaataaaccctaaaacaagagttttactttacaatcctcaagagcaaatctggtgaatgtcctaatttactagtatcaaactttttcactcaaaactccagcttaactaattcacacctgttctttcccaaaactcttcatatgtttccattttctccatccatatatttgtaaaagttaatactgcatcctcaatctatgttggtattcatatgctttttcttatactttgccatcttttcatttttttttattgtaagttcaggggtatatgtgcaggatgtgcaggtttgttacgtaggtaaacatgtgccatggtggtttgctacacagatcatcccatcacctaggtattaagcctagcatccattagctattcttcctgatgctctccttcctcccccacccccaacaggccccagtgtgtgttgttcccctccctgtgtccgtgcgttctcattgttcggttcccacatgtaagtgagaacatgtggtgtttggttttcttttcctgtgttagtttgctgaggataatgtcccccaggtccattcatgttcctgcaaagaccataattctcattcctttttatggctgcatagtattccatggtttatatgggccacattttctttatccagtctatcatcgatggacatttaggttgactccatgtctttgctattgtgaataatgctgcaacaaacatatgtatgcatgtatcttcataacagaatgacttatattcctttgggtatatacccagcagtgagattgctgggtcaaatggtatttctgccgctaggtctttaaggaattgccacactgtcttccacaatggttgaactaatttacactcccaccaacatttccttttgctccacaacctcaccagcatctgttgttttttgactttttaataatagccattctgactggtgtgagttggtatctcattgtggttttgatttgcatttctctaatgaacagtgatgttgagctttttttcatatgattgttggccacatgtatgtcttcttttgaaaagtgtctgtcatgtcctttgcccactttttaatggagttgttggtatttctcttataaatgtgtttaagttccttgtagactctggatattagacctttgtccaatggatagattgcaaaaattttctcccattctctagattgtctgttcactctgaggataatttcttttgctgtgcagaagcccttcagtttaattagatcccatttgtcaatttttgcttttgtttcagttgctttaggtgtcttcctcatgaaatcatttcccatgcctatgtcctgaatggtattgcctagattttcttctagagtttttatagttttgggttttacatttaaatttttaatccatcttgagttgatttttgtatatggtgtaaggaaggggtccagtttcaattttctgcctatggctaaccagttcttccagcagcatttattaaatagggaatcctttccccattgcctgtttttgccaggtttgttgaagatcagatggttgtaggagtgcagtcttacctctgcattctctattttgttccatcggtctatgtgtcttttcttgtaccagtaccatgctattttggttactgtagctttatactataatttgaagtccagtaacatgatgcctccagctttgttctttttgcttaggattgtcttgactgttcaaactcttttgtcgttccatatgaattttcaaataggtttttctaattctgtgaagaatgtcaatggtagtttaatgagaatagcatcaaatctaaaaattgctttgggcagtgtggccattttcacaatattgattcttcctatccataagcatggaatgtttttctatttgtttgtatcatctctgatttctttgagtagtggcttgtagttctccttgtagagatctttcacttcactagttagcaatattcctagatattgtattctttttgtggcagttgtgaatgggagttcattcatgatttggctctcaacttgcctgttgctggcgtataggaatgctagtgatttttgcacattgattttgtatcctgagactgctgaagttgtatatcagctggagaaacttttgagctgagacagtggggttttctagatatagaatcatgtcatcttcaaacaaagctagcttgacttcctctcttcctatttgagtatctttatttctttctcttgcctaattgccctggccagaacttccaataccacattgaataggagaggtgagagagggtatccttgtcttgtgccagttatcaaggggaatgcttccagcttttgcccattcagtatcatattgatactttgccatcttttcaaccttcttatttcctagatatgtgcccacttatatgctgcatataattctgcttacctggaaccatttaagtatgcatgtacttgggtatataagagtaaatatgtgtatataaacctgtaggcagcacagtcagaactgtgtttacatatgcacatacacacatgaattaaggataaaagatatagaaaagatgagggaaacaactatcctgagcattgctagatatttccaaaataattacgtattaaaattgaattatcattgcagagccaaaacacagcagggggcagagttcagaaatgttcctctaggtcagctgtgccagttctgtaatctgtgagcaaattactcaaaatatagcagggacataattaaatatttcaacactattgtcaacagaatatattaagcacttaactccttaaaaagacaataattgtaatagtggaatccactttatactagtcatactcaattcagcttttaaatgttatctatttaaaatggacagttattacttacaatatatatgtaagtataaatatatttaatatgtatgtaaatatatgtgctatatatacatttataatgaaagtatacatatgatataccttttaaaatcaatacatacttaaatattaagttagctctccctccttcactaatactagtcattctagcatgccttatatctactcaatttcttttcaatttcaacatgaatttaaaagttattgcttaaatctaaggaatttaatatacacaacagaactttataaatgtattcaaagaaagggtctctagatcaatgcaaatttttttctttagatcattactaaaaacgcatagtcagggtcaaaatagagctggaattctttttacctatatttaaaaagtatgcagtgaaaagtattcaggctcaactagataaagaagctttacagagtgctttatcagcttcaataattaaaagatttcctgctaactattcaataagagtcttctttatagctctgctttgcagtcagttctttccatcacttcctttgaaaagtctaattaaagtggaaggctttatttctattcattccgtgtttgccatattggacatagatactaaaataactaattaaagactatattggctctttttaaattcttgtcctgttggaactttatggggtatgggagtggaaggagaagtattttctcagttttagtttttaaagttggttttttattgtcactctctcaatattaattatcttttgggttaatggaagtaatatggataactttctccctgatgcctgtattgatgctgtaataggtgttttttttttagagtaactgactagtgaagaattgaaactaaacacttcagagcccttatattccccttgttgtattactggagcattacttaagcactgctaactatcttttaaaaatatatttgctgtagtgttcaaagaaacttgcatggaaaaaaagccattttctacttcccagaaacagatgttttcttttttgtgtgtattttcgtctatatttataaccatacgtttaagatcataataattatatgctgtatatggcttacaaggtttttcttttccttattctaattataaactctagccagtaagtgtctccataaaggtgatacgccttttatagaatcaagtgctaagataaagaatcttaaaagcttattttttactgttagaatataggcagttgaagggttaaaacaagtcaaccataattcaatgagaacattctggcccttactacttactatcttgagagagttataatagagtaagaaacatatttatgcaagtgagtgtaatacaggaaagaatatgatgttgttaagatgtagtacaaagtgggctgggtgcggtgacttacgcctgtaatcccagcactttgggaggccgaggcaggcggatcacgaggtcaggagatcgagaccatcctggctaacacagtgaaacctggtctctactaaaaatacaaaaaaaagtagtacaaagtattttagaggcacagtgctttgtagttgatcaatgaaatacttacagaagatttcaaaataagatacatatggatgtgtacttgtatatatacccctatatgcatttccaggaaaatggaatcataaagatttggatacaaaaaaattattttcatttatgtttggacatgaggaaggaagagacatactctagaattctatcagaagattgacattgcttgagcaactgctcagtcatacctctgagaatagtcattttaaataaaatgacaacttttaagaaatactccatattcaggcaaagttccaatgacgtaatggtcagaaatcttaagttgatgcattttagaaaaagccaaggataccttctttgaagatatagtttgctttaattttattttaagttccatgaaggtaggaattttttcttttttgtttgatgattcatccaaagcacctaaaacaatagcttttacacagtagctactcagtaaatacttattgaacaaatgttgaatgaaactcttggcacatattttggtttcaatccattcctgatggccagacaactgggcagaatcatggactgaattctttaaaaaaaaaatccgtaggaatcaatgcagtacagaggataaaacacaaaactgaaagtcaagacatttgagttccgctgataataactagttgtaagatgatggtcaaatcatttaatcttccatccaagaacattctttctcttctcaaattctatgagtcaattttcagccccacttataactcttaaaatttcatagaaggttatccaagcttttcatgcatcaaattgtccttgtgataaagataaatcatagctgatgatggatgattaaataaggaaatataaaaattctttgaaagcttttggatgataatatttatatattatacgaaatataaatgttatatatattaagtatatctatgtgaagaaaatgtgacaattccattcagttatgtaataacattttaactttgataatatattacaaatatttcagattaacataaacacttaaaagagaaaaaacacttaagatttattttcttccctatagatctagctatctatatatattaagttgaatctaactcaattttacaagtttgacaagataaacagaagaatctgatacaaacttatgtagattaagcaactgcaaatttgtgaaaagttattttttctaatcttgggttagaataaaaccagaagacaatggtagattttatttcaatccaagggacttttttttttaaggagaaaactgctaaatgctccaaaggctcatctttttatagataaagtgattttttttcttgcccacatcatagcttttatggtattttggattttcattttcaattcacagaagggctacttccgctcacaaggcagtgttacacattttcaaacaatgaaaaattacaaggcatcaatcagatccatagggaaattgagtttctatgatgaaatctatagttttactacacacttaataaatacttaatactaatgatgatctcatacccactcatcactggacctaaatgtttgctgcaatatcctccacatgattccaatagtctgagcaagactcacaaaagccaggtcactaagcaaatacacagtgcagtatggcatgggcagttagttccagcagatagaacaagcatcttttcctggacatttcctgtgcagtctgattgactccctgatgtttcccattcactccaagctgctttttccctcctccattcaaaattgcagaattctctccctggtctcaagctgctgtctctattcttaaactatatgctcaacttcctaccaccccaccttattttttgatgaagtctgtttcatcatagaatccttaaataacaaatctcatagaaaagagtctactctgctcctgtgtataacattagattttaatgatatgaaagaacaaagtccaatagttggtttggagagtgagagcccccaaaaaaaatgactacaagaagagaacaaatgagtacatattaagaaatttccattgcaggccattcattcctgatagttgtagctctctatctcattttaaatgataggcagcctcaatcaacttttgatgcaatattaaaaagaataggaaacaatgattatgtagcaaccaaggtcttagatggtccagaaaccttatattaatctcttcccctaccaaaatttgaggccaaacatgctaaagcatgtagagtttgctcatttaattttacctcctttcattttctcttttcattctttgaataaaatgacaatatttcacgaaacagtcaggaagtaaatacagaataatagaaaagaaaatggtcacagacacctgctgggcattttctatacaccaggtactgtactgagaattttgcacatattggaatgatgcatctgtatgcttcacaaactgatatcattaaatggaccctgcttgcaagaagcaaactccaaacaccttctttcaggttattggttagtcatataagaatcagcaaacatgaactttcttttttccatcaagtcaaaagggcaaaaggaggaaagtttaatcactacatagtaatctcataaaatgtagagttctgcgtaaacataagtcacctaaaaaatctctatgatgggactaatagataccttcaatgggtttataaacctccagtgctttgtgttacagagcatagcaagaacaacatattcgttgttgttgttgttgctgctgctgctgttttctcctcccagtgaacagtttggctgtgcaatttataggatgaacacaagatatgtttgcatcctgagatttgccagtaaaacattctcaagtcctttattaatccccatttttaaaaattcagatcattctaattatactccatcactcaacgaagttttacaggaaatcaaagaatttgttttcaatgactgaggacaattaaacttggttgagtctgaaactttgtgatgtgtatttcaaaggtctttctcaataaatttttaggttgtggtgtatttatcagcctaacaaaaggattaatatagctcctaaaaagggataaaatattaaatagtcaaaaagggatcgaatattaaaaaatgtaagttaggtaatggatggatcaaagtgtcaataaaattgaagacattcttagcaacttaaatactttgaattgggtggttagaatttgttcaccaggctaactatgtgtgcaggaagaatttttatatttcaggaatgtctaggttaacaaaagctaaatattcagatgtaataaaggaaatagtttttagtcctggtgtctaaagtgaaaaagcattaattcaaatcccaactccaccactgatgagctgttgatcttatcaaaccttttaggcctcagcttctttttctgtcaaattgttataataatggtatctactctctgtgattggtgtgagtattggaaataatgtatataagatacttagcatagtgtctgtcaagtcataaaaatgcaataaaagttagttgctgttgtaactgtatacttttagcatgtttgtctttaaaagacctataatttatttatttaattgctaaaatttgtctccatttttcttgttcagagattgttttatttaatcttcataataacaggattaagtgagaagagtaaattctctaatttctaattctatagttgaagaaacttgaaatcaagaaaaagaggagaaaataatttcttttttcttttttttttttttttgagacggaatcttgctctgccgcccaggctggagtgcaatggcatgatctcagctcactgcaacctccacttcccaggttcaagctattctcctttctcagtctcccaagcagctgggattacaggcatccaccaccacgccgggctaatattttgtatttttagtagagatggggtttcaccatgttggccaggctggtttcaaactcctgaaagtgatctacctgcctcagcctaccaaagtgctaggattacaggcatgagccaccacgcccggccaataagttgttaatattatactaagtactagttatttatttactatatactttataccttatcacatttaaccccaccccaaggttatatgctagttattactcatgaattacagatgagagaatcaaggaaattattcagaatcatatcactagtgagttacggaccaggaactttaacacaaatttctaaactcagaaacatattctatgttatttctaataaatatggccttatcactaatcaacacatcagtgtcacttcaaacacatatctagaatcaagttcatactcttcacaccttctaatctttgtgtccccccaaaaaagaaactatctcctagattcttcatctatattaatggttttacaatccacccaatcactcaaactgaaaactgccagttggccttggcctcccactttctcaccacccatatttatggatcacttcctgagagttctctctggacggacttgcagctctgtctcctgctctccatctccactgttataacctaaggtactcatcatctctgcctcatattttatcatacactagttccttattctggagaattgaatacctttacaaacaaagcagccatacctatctttctaatgcatagatctatttgtttcccctactaaaaagttttcaatgtctcttcattgccttcagagaaaattctaaacttcttccaaacagatactgaaaaccatgtaaccaccccaggttatcccactccaacttctctgtgttctgggtacagtggtaagtggtgtttcttaaacatatttacatctacttactgtttttatgattttctctttgtctgatatgactttcatcaattggatagggtaagcttcaacacattattcaaagaccaagccatcctccacttagcccctaccagaatgaatcatgtgtttttccatagtgttttatacctgttgctgatagaacttcattcatcctatgctattacggtcagtcattaccatgtgagtaactcttgagcaggggccatcatttaagaatattagtattaccaaaatatcacatgggaaatacttaataatttttgagaaataaatgaataaattacatattaaatacataaatggtgaaaccaagaattatattgcaaatattaaacagctgcattttacagacacaggcaaatcagaatgaaagcacagatcaataaaaatgggcccagaccaggagattagggtatggaccaatcagaattgatgttagctacacacaaccagcttggactgaccatagtgaccatatacttgcaccaggtgcagctcatgtcacttaattctatgcaatataattttttcaatggcttttatgaacttttaattctatttaagataatttttcaatggcttttatgaacttactatttcccccaggggatataaagataccatcaatatgtataatttgagtaaattcagtagtttgactaatggatcgatgtaatagcaaataatttattacctgccctctgtgcatcaatctcactttgaggtaaccaagccttcttagttgagtaagacataaaccctgtcttctgggaatcatatattacagaatcttctcgatttttattctattatttagtaaaataacaaactggtaaccaattaaaggcagactacattcttcacaatatctgatttgatttgtttctttaaagggagagtccattctaacgaacatactatcaccacttccaaggctctctgtcaacatacaaacattctttccattagaatgatcctccttgacgagggtggtttcaggcaataaaatgagttactgttgaaatgtgaatgatgaagacattaaacatatttaaaagacacgaaatgagtcctacagaagtttggctaccatccagattcactttttcctcaaacttctgtaatattcaaaaaggacaaatactcctgattttaaacccaccatgctatttccagggagccatgactgctaggtaaaatgttcaagcgcatgcgggattgtcatcttcctgaggtggagtagagacaatccttgcaatgggaaggaagatagactaggcagccaacctcctttacagagctaaggtcataatttcatggcctataattttatgttgcatcgtatcttcataggtagttacttattatgcttttaacttaaatatgtgtcacacatattcttttgtaggtatgtaatattttattaattttttaaaaaatatgcagctaactcgtggaatatactattaggaagtcataaaaacattaccaaattacatgtaatttctcttctctatgtccttcattgggttacctgttgatcctttaatcaaagccttgtaattacgaaaagagacgctacatgagtgcccatatgaaggtgattaaagggagaaaataagagaccgagagaggaatgagtggggagagaagaggagggacagttgatggtgtcccctactagttgtccagtaggggagagagaggtcctcactgcaccatgttccagagcttatttttgttgttgttgttttgagacaaagtctcactctgtcgcccaagctggagtgcagcggcatgatctcagctcactgcaacctccacctcctgggttcaagggattctcctgcctcagcctcccgagtagctgggattataggtgtgcaccaccatgcccagctaatttttgtattttttttagtagagatgagttttatttttaattttattattattatactttaagttttagggtacatgtgcacaatgtgcaggtttgttacatatgtatacatgtgccatgttggtgtgctgcacccattaactcatcatttacattaggtatatctcctaatgctatcactcacccctccccccaccaaacaacagtccctggtgtgtgatgttccccttcctgtgtccatgtgttctcattgttcaattcccacctgtgagtgagaacatgcggtgtttggttttctgtccttgcgatagtttgctgagaatgatggtttccagtttcatccatgtcccttcaaagaacatgaactcatcattttttatggctgcatagtattccatggtgtatatgtgccacattttcttaatccagtccatccttgttggacatttgggttggttccaagtctttgctattgtgaacagtgccgcaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctttgttccctgactttttaatgatcaccattctaactggtgtgagatggtatctcattgtggttttgatttgcatttctctgatggccagtgatgatgagcattttttcatgtgtcttttgactgcataaatgtcttcttttgagaagtgtctgttcatgtccttcgcccacttgttgatggggttgtttgtttttttcttgtaaatttgtttgagttcattgtagattctggatattagccctttgtcagatgattaggttgcaaaaattttctcccattctgtaggttgcctgttcactctgatggtagtttcttttgctgtgcagaagctctttagtttaattagatcccatttgtcaatctttggctttggttgccattgcttttggtgttttagatatgaagtccttgcccatgcctatgtcctgaatggtattgcctaggttttcttctagggtttttatggttttaggtctaacatgtaagtctttaatccaacctgaattaatttttgtataaggtgtaaggaagggatacagttttaactttctacatatggctagccagttttcccagcaccatttattaaatagggcatccttcccccattggttgtttttgtcaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcaggctcttttttggttccatgtgaaccttaaagtagttttttccaattctgtgtagaaagtcattggtagcttgatggggatagcattgaatctataaattaccttgggcagtatggccattttcacgatattgattcttcctacccatgagcatggaatgttcttccatttgtttgtatcctcttttatctcattgagcagtggtttgtagttctccttgaagaggtccttcacatctcttgtaagttgaattcctaggtattttattctctttgaagcaattgtgaatgggagttcactcatgatttggctctctgtttgtctgttattggtgtataagaatgcttgtgatttttgtacattgattttgtatcctgagactttgctgaaattgcttatcagcttaaggagattttgggctgagacgatggggttctctagatatacaatcatgtcatctgcaaacagggacaatttgacttcctcttttcctaagtgaataccccttatttccttctcctgcctgattgccctggccagaacttccaacactatgttgaataggagtggcgagagagggcatccctgacttgtgccagttttcaaaggtaacgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattaagataatcatgtggtttttgtttttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcaatgttcatcgaggatattggtctaaaattctcttttttggttgtgtctctgccaggctttggtatcaggatgatgctggcctcataaaatgagttacggaggattccctctttttctattgattggaatagtttcagaaggagtggtaccagttcctccttgtacttctggtagaattcggctgtgaatccatctggtcctggactttttttggttggaaagctattgattattgcctcgatttcagatcctgttactggtctattcagagattcaacttcttcctggtttagtcttgggagagtgtatgtgttgaggaatttatccatttcttctagattttctagtttattcacatagaggtgtttgtagtattctctgatggtagtttgtatttctggggatcggtgatgatatcccctttatcattttttattgcatctatttgattcttctctcttttcttctttattagtcttgctagcagtctatcaattttgttgatcctttcaaaaaaccagcttctggattcattaattttttgaagggttttttgtgtctctatgtccttcagttctgctctgatcttagttatttcttgccttctgctagcttttgaatgtgttttctcttgcttttctagttcttttaattgtgatgttagggtgtcaattttagatctttcctgctttctcttgtgggcatttagtgctataaatttccctctacacactgctttaaatgtgtcccagagattctggtatgtggtgtctttgttctcgttggtttccaagaacatctttatttctgccttcgtttcattatgtacccagtagtcattcagaagcaggttgttcagtttccatgtacttgagcaattttgagtgagtttcttaatcctgagttctagtttgattgctctgtggtctgagagacagtttgttataatttctgttcttttatatttgctgaggagtgctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtcttgtttttctgtctaatgttgacagtggggtgttaaagtctcccattattattgtgttggagtctaagtctctttgtaggtcactaaggacttgctttatgaatctgggtgctcgtgtattgggtgcatatatatttaggataggtagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttgctgaatacaacacactgatgggtattgactctttttccagtttgccagtctgtgtcttttaattggagcatttagcccatttacattcaaagttaatatcattatgtgtgaatttgatcctaacattatgatgtcagctggttattttgctcgttagttgatgcagtttcttccaggcctgagatgaggtttaactatgttggtcaggctgatcttgaactcctgacctcatgatccgcccaccttggcctcccaaagtgctgggattattcatgtgagccaccatgcccggcccgttccagagtttttaataagaatatctgggagctaaagaagagtgcatttagtcagcaagccacttatggatccgctgaataaaatatcaagttctagtaaatttcaatctacagacaggagatccaggatgagacaagactgaaaaacctctaaattcagattacagtttagaaaagaaataaaatctctggatttccaggtattactggaataacaccacctctatactccaacagtgtcgtatgtcttcttcaatactatttctgctacctgtgacactctttcttcctcccctcccctttcttgctaactctgctaataccacttcctcagataatacagataatcattttctttttttttttgagatggagtctcactttgttgcacaggctggagtgcagtggcacgatcttggctcactgcaatctccacctcctaggttcaagcgattctcctccctcagcctcccgagtagctaggattacaggtgcccaccaccacacccagctaatttttatatttttagtagagatggagtttataggcatgagccaccatgcccggcacagagaatcattttctgaaacaccaaagctaagttaggagcttcttttgtacttactgcgtaacactctgcactttgatttatggcacccaatgcatgtataattaaatggttcagcttcagcatctatctctgaaattgtggacatgcaatttccaggacagcagagagactgtgctttcttttcatccctgtgtctctagggcctaatacagagcctggcacattaggcaatactcaataaatatattaagtatatgaatgatgaatgagtgaatgaatgaatgcatgaatacataaataagttgcctctggaccatccaagcagatatatttagtagaccactggaattatcattctgagtgcgaaagagagattagggatggcaataaagattgaagagtcatcaggttacaagtggtagtgaaattcataggagagaataaatctcttaggaagagtaaaattgcagaagactgaagacaaacaagggatgtagatctcatggaaacaattcagaaaacttcctcagaaaatatgagtgcagcctagatagtagttaagaactcagattgttttagtcacactgacttttaatcccatctccaggtcatatggtgtgaactaggtaagtgtggagctcagctgtgctggagacagctaagctgccaggtctcagagcagctgattaaaacaacaagccaaaaaataaaagcgacaatcaagcctttaatctcttcctgcagtagtgtaatcaacaggctgaactggagagccaagagagcattggctccccccaatcccattgcacttgcccatggaagatcacattggtcaagatgaggtagatcagcacagatattggggtcatcttattgctgagggagccccaaacaaaaggcttaagcagggcagggggttgacaagaaaacaacggaaaagagccaggagtggaaaagtactgagtactgagtcagagtagggacaaatgtcaagtttttccctttcttccctgtaaggtggtttcagcagaggcacctgaaggtggcccctgccaaaggctccaaacaaagagagctctgaatgatggcactgggggtaggaatgcaaatatgcataaactatggtctgccagggaggcctgaggccttgactgcaactccctttagaaactgtgccgcgctggctgcacaccaagcccggcgtggggagggcagtttccccgtgacacctgctgggcaaagctttcgtcactgactatagttggccctgaaaatcactcacaggtttttggccaggaagcagactgctcagtaagttacttgaactctctaaatctcaatgtcctgatctatgcctacctcgtgatttgtaaaaaaactttgctaaattcttggcatatatgcagtgctccataaatgagaacccacaggagcaggttgaggcgcaggggcaccactgagactaagagaacagaggccaagaaggtcatgactgaaaatcatctgttgcagtcgacaactgagttgttagtgaccttgggagagtagattcagtggagcaaagacaatgaaaattagagcgcaataggttatcagcaaatggaaggcaagggagagcggacaggaatcatccactagtctatgaagatgttggtgacaatgagaacgtgtgtgcagctgatgaagatacatgagactgtacagctgtcatctgatttgtaaggaatttgtcccctgaatgcccttaaaccacaataaaatcattagtatggttttaaaagctaactgagtacattgttttagagaagatggagactacagcaaggcagggaagagaaaaagccccaggacctggggtgaagccttctaagcagagtcagtgacagctgagtcacgcagaggactctgatgtcaccacagagcttgtggtatgcagactcattccagatgggcaggctttccttcaggatccctcacttatctcttctcctctctaaaagactagacactttccaccactactagccctctttctgtacatctgtcagcttttatccccagaaagcctgggccttgacagtcctcatccctgttgctctctgtttctgtaagccaagttttgcttctgttcagcagactgagaaacatcacagacccgtcttcgcacagaatccagcaaggataggatctcttctcctgactcaaccagaaataaatttacataatttattacacattaatatttttgaaactaaggacagaccgtggttcctctgtaaagactgaagcatcaagaaaaatcagcagctattctaaagaggcaaaaacataaaacccccatcagaatcccattacagtactgagaccataggagaaagctaacatgcatatcatagattttccatggaggatgtgaatccatagcatagtgaggcctatgtaagaggatttattatactttttatgtgacaataatatttccagggctttcaggtacacctagtacaaaggcttttcctagtactaaaatgccacaagagacacatgaagctcagtaactctttaagttgtagcttaaatcacccagatttttgcatttgaaagaaagcatagaatgcatgcacaatcaatgtaaagtattacataaaataatttaatcatatacaactcagcaggtttatgcctgctgccatttctctcctgtttctttagtagactatcattttctgcctctgctgtttacaggaatatattttatttcaaaagcaagatttttcttggcactcaactcatccatgactttattgttgaattttttttaatgttataactcaactctttgtgtggttaaaatggctgaggctcttttatgttgttcttatgttttcttcccccatcaagcattctgaccgctgctgtcaaaatctgataataaatgaagatttctcccacagtggacctcttataaccatggcaactccatcagcagctaatggtcacattacaaaaatgcttttgaaaaaggcagcttctcacattgctttagtacaaatgtcctttccttaccttctctccataataattctaagaaaacaacacatcccaagcaaacatttgctttgttgtgcatatgtggggtcactttaaaaaataaaaaaaaaaaaagaagagaaactacaaataataaaagagaaagattatttgaaagcatggcactaaagtaggaaatgatactgatggcttagcagcattaacaacatatttgtattgtttttacaactgaagtcaatgcagctattgcttcttaagaatttgataatttttattgctgttacttcaccctaccatcaaattagggaggctttctaaaatgcttattttaggtttcatatgaattgtctctgagcaattggtcacttgtgggaaatgcagctatatgtacacactgatatatcttcttttctgtctgagactttcatgtgcttttatatatccttgaaaaaaccccataggagaattagcatatggacttttcagcctgcctcacacaggttcacaacagaaattcctgtctgagctctgctcttagacactcaaaagtgctctggcttccttatttacaaagtagatcaaaactagtttctaacatagaaattttctccaagtgcctgcttctgaaatggcctgcctgttaaaacaaaggaggatgttttccacattaacttcttgttaaaatgatgtatctgtctgaatggaaataataggcattcagatagagttctctatctccatccatatgtcactctgtctgtctacctacctacctgtctataaatacctacccaaggaaagagacttcctcaaatcccaaacatttcagtgcttgagttttgttttgttttgttttcccccaatttgctttcaaatatcaatcgtgatcaaaaagtaaccacagattagaactcagtgtcagatttccaaatctgcaggatctgttgatgctaatgacactaatattaggtacatttcataaatgtaaataattctctccctctaaggttttcagaactaaatggtctatgtaggacagacctaagagtaggaatgccccaggccacagagcaagcagcaaagctattttattaaccttaattacaatttgatttttaccttgcccaaaacctgcttttttaaaactcttcttaaatgtatcctttctctataaaggtcctttaatcatggtggataggctttatagttaagacctccttagatttgcattgaaactctgcttctttctgctggtaaactgggcaagttactcaaactcacttaatgtcaaagcatttatttgtaaaaccagaatgataaaagttctccctcagaggatagctgagaacaatagttggcttaatacatatgaaaacacccagctctgtaattagaagaaactaaattctccaggaatattttccccccattttttcttccccatcattcctaattctcactctctccttttccttagaataagtagtcatgagattaggctcatctttctgatttgctcatccattttataagtcatttttataagagcgtaaaattatttgcaatctggtaagataaaacaagttgaactgttgactgcaagattgtcagtagtgaatgtttggtttcccttattgaaatcaaaagttacaaaatttcataacatacataaaatcaccaccacaaaaatccatctttcccaacataaaattaaattaaaaataaaatgagtgtctgttagcatatcaaaaaatgatgtttcccttttgaactagttcaccaagttcatgcagaagaatgaacttggagaattctatcaccgacagcccagacaacagactgtggcctgatattacttatcttagtggtgggagtgtatgaggttggtaggaaaacaacagcaacaaataaaaatgccaggatggtctacagaaaaagtttatttaaaattttttaaggcaaattttagagaaagtttcaaaagggaacattgcacgccattaatttttgccctggcacacaaactttcatcctttagaaggaaccagaataaatttgaagcttttaataaaatatttcatggggtaacaaaagcaacattaaacattaataaataagtctttgctgcaaattcattttgaagtgtagtcatccaagtgcaatatgcattgtgtaaatgtaacttttggaaatattaatactaataaagtctgagttcatgaaatgttcttgcctgtcatcttgagaccaagatgcatcgtcaaattgcaagcaaacattgtgaaatcaaaacccagggctgttggctcagtgagatgctgaatgagaaattgttaagtaaaaaagaccaaagggagaaaaaatgttgttctataactaaacaaatggaatcagtaaaaagtcattatttctctaagtacacatttgactacacaaaggagccactgtgttcatccaatgtgtcccagtggtcataggccttggttattcaaaaaggactttttcttttttgtcattacccctaccttctgtactgtatacaacctaaagaaagttttatgtatacaaccaacaattcattttccacatgtaattttatttttttctttcaaaggccaaatcttccattggaataaaaaaaaatcaccaactctttaagttctttcattttctatctaagcctccatattatatagaaaaactgatattgcctctttaagaagtgtaattttacctacattgatcaatgtaactctggttctttacaaaaatgatggaaatgttcccagctcaaattataatttcaggcattaaatgataggttcccttagaaaatgtgagcacgttttctttagggcaatgttgacattggctagtcaataaaataatgttttcttctgtattaactcatttagtggaaacaagttcagggttggccagcctacatgaccaccttagtgaaatcctgaaatgtgttattgttttctcaggtaagtattgagaagcaggaaatttttctttttctgttttgttattgttgatgttgttattgctgttcttcatgatgacatcaactgacatatgcctagcattctgtgtactatgcagggaaactaattcagtgtactatggagagaactaactcagaaaagaatgagaaagaggatactgggaaagaggaaaggaggaaaagtcactttgtaatttagtataatctaagtaccaagactgtatttctgttcaaaacgaacaacaaaaaaggtgaaaggcattgtctgtctactggaaaattctaagtttattaaacacaaaaattcccttcctaagagatttctgagattccctattttggccaaagttatacatgatgatgatgattagcacacaaagataataaataatgaagaaatcagtgaatatgacttaatagaaatgtccttatattttaagacccactatagcacttactctgctgctaggcactcctctaagcatcctacaaattttaattcatatcatacttgtaacaaccccaggagatgcattctattattatccaatcttacaagacaagaaattggaccaaatagaagttgtttgtccaaagctacatagctaacaataatatagtcaaactttaaatcaagcattctggcttctgagactatgccttaatacccattaaccatgctgcctcaatgtgctatttagcagaaggtaagcctgcttacattgtcaggttgatgtacctatattcggctcttttaagttgtattggtagtcactcaatatttcagatagtctattggggcttctaaaataataatggtttgctattcattaataattactaataataagtcaattattattttagaagcgatagtgatccattattattttagaaggaatatttgattttttttagtagtttaggatattggcattaaatctaagagaaaagcctgaagtaaaggcatggctccaatttttttttgtatttatggtaatcctacaggttgttaccttacagacttgctcaaaaaaaaaaaaaaaaaaatccatcaatgagcccaaaacctgaggttgtggatgacctttgatttaagggacttgaaagggtctccagatcaccatcattgaggtaacacgttgagctttggagacagacaaatttgaggtttcattctcaccttaccatgtactatctttgtatccttaggcacattcttaatctctcagcagctaatgatttttagttgtaaaatggaactaataatgtagtttcttggagttgcttggagaatttacatatgatgccatagtaaaagctcaaagagtgttagttcctttcctttttattgacaatatcatgactataattatattttcaagtaaaatgggtatttcacaacacgttatctctgtctgcaaatttctgcaaataactttaagatatcaaagatttcgtgaaattgaacatctttgagagagagaaagaggataaagtagattgtcatgatcctaccttctacacctcaaatctccaccactagatttgacttaaacaaaatacagaggacattatcactagaaggctacattttaaatgtttgggtttcagctaggcatcattactcacacctgtagttccagcatttggggaggatgagacaggagggtcacttgaggcaaggagttccagacaagcatagacaacatagcaagaccctgtctctataaaaaattaaaaaataaaataaaatgagtgtctgttagcatttcaaacattaattaaatatttcagattatttaggtcagtaaatagtacatttccccctgcaaagacacttgtttcccacattgaccctcatatcgaaagattccatctctcaagaaaattgagtttatgtagtaatacttaatttaactcccattttcattgaaatcctatatacagatatagtcaagtttcttatcagcatgaaaccactagtgtgctcacacctaattgataaaattccaacccaaagcaaagaaacttaacatattcactcatctttattgtcttattgcaagctaattgttgtagactgtaaaactattcatcaataattagttcatatccatgatggaagattatatttcccagtcctgttaaattcaggtgtggccatatgacttgctttggccaagatatgaacggattggaatatgttaattccaggtgaaagttttcagagtagtccagagctgagacctgaaggattaataaatattagccaggtaaagagaagagaaaagctattctagacagaggaaatagcatgtgttaaacctggaagagattggcaaacccaagcctttaggttagtgtaattagagagactcctggactgcagtagtaggaaagaggtaagatggtacaaatttgttcgtcatatcaaggactttatattttttagcaagtgcagtaggaatccatataagggttatgagcatggaagtgacatgatccgatttagttttgtaaggagagctcagggttttgtacacagaacaaattggagacagagatagtggaatctgttaaccacataaaagactaacatgattatccaggctggaactgatagtggcttgacccagagcaatggctgtggaggcgcaacaagagggtagattttaaatataactaggggaagacttaataaatgcctaatagacttaatgatagatagaatgtagaaatagaataatagggagtcagaaggatgactttggggctctaaattaagtgactaggtggaaggagactccatttatggtgacaaggaaaacttgcagatgtgcacacttggagaaggagagcaaatatatttaacctgagaacataatatggagatcccactgagcaggtgatgcttagagaagtaatctggacaggtaacagattattagattattagaaagattattataatatgattattatgatggaattatttagaaagagagtagaaaaggagaagagaatataaaagcccctgctatccaggtctgagtaactctaacattcaactggagagaggaagaggaatgtgataggaagactgagaaaaacagagttttaataaatcgactcccactggaaagcacttaattgattcttcagcttgaagatataggatgggtatattttcctaaaagagagcagccatcagtagattctgaatctgggtcagtcaggagctactgactgacctcaggggatgatagaagagggaaggggcacagcttctttgctaagcgttggtgaaacttcagcttcttcacagttttatttaaggccaaaccatttctttattttctacggtgtttcctcaaaaaaagacactattgtcactctgtatgtttgcatttaacacactagtatgtttaaactgtgtttatagtcttctagaagctgtataaacaatttgggtcccgccacaaactaggtacaatttcttcaactatagcctagtggtacaagaagccatttccatgtaaaaatcattgtttttgcaccccctcatcatgccacatagattcaggtgctttcaccttcctcaaactgcagggcccatgttacttatagctgcaaattggcccactggatataaaaattcctaaaggggagaaaaaacatgggattatcccatttttaaagggataactatttagacatattgtccttggtctaatcactcacctgtccctgacttgatattaggtactttaagggactcctaatttgaaggaaaagttgccactatccaaaaaatgatgccgtttctctcaccccacccggctaaggtgagagcacctggtaaccaacttccttcagtacatttatcctccagagaaatttgcctaataaattccaagagcttaacaaatactagttttctcattttctgcctaatgcaagcttagaactcagcttccggttgacctgattactttcctgaattctaggccctttatcaatgctaacaataaaggccagtctcatatctactgttttatttaatagtcacaataaccctataaaattcatcttcataaaaatgccaccctgcctcttgttcaggcaggaattttcttgaaagacaaattttaagttacccttgattgaggctttagaaacaatagtcatgcatgacataatgacatttcagtcaacaaaggaccatatagaagacggtggtcccatgagattataatgctgtatttttactgaaccttttctatgtttggatatatttagatacacaaataattgcctagagtattcaggatagtaacatgctgtacaagtgtgtagcctaggagcaataggctacactgtatagcctatgtgtgtagtagtctataccatctaggtttgtgttaagtttactctctaatgttcacacaatgacaaaattgcctagtgatgcatttctcagaacatatctccgccaagcaacccatgactgtatttcagagctcatggcagcaacctcacgttccaataagctacgcagaaccctgggtagtttttgggaactgacttacccatcttctacaatccggttagacttagctctctaatccatctagaccagctattttctttggtcatttctattgtctcaatcacttacgttaaagaaagtcttttagagatgttaatcaggaagtgctaaccaggctgctggagttgctgtagcgccagcctcagatcttttgagacataaagtgtatagatacatatgtgcgttacttacgttcctgtcagtcaactggttgtctcatcatcttcagaaccataagacataacctaaaatgatgcttgaacttacttcttaaaatctaaaaccacatttctcacatagtcatcacacatatatttctaataggatagtacaatacagtgataattcacctctctgtatagtctacttgggggggcaaggatatttaaatttcaatggcctgaattccagtcttggttctactatttttttttttttagtgatcttaacttttttgagcttcagttcattttttcctcttctgtcctacttacctgcaaggagtattatggagctgaattaagataatacatttgaaagcaataaagagtatttttcatatctggttgataataatttaatgactacatagtttcaacaaaatacttctatatattaaggctggtttcagttcctgtctcaatctcattttgcccacaaagaagagaataatcaagattagtggttcccataactaactgatttcacctgagaaactatatatatatatacatatatatatatatatatatatatatgtatatatatatatattctcagactctacttaccaaggttttgactcaatggaccaagatacagacccaggagcctgtattttttaaatgctcctcatgtaaattgctacagctttttggaggaagatggcaatgagtgttaacatttaaaatatacttaccctttaacctgataattttacttcctgccagcatacttcaacaagggcagaaagatatacatgcaaatatgtttatcatagctttgtttatactaaaaagacaactttttatcaacaggagactaaataaatgatggcacatttatacagtggaaacttaggcagttgttaaataatgaaatgctggcattaacagatgtccatggcacacattattcttaaatttttaacaagcaaattaaacaacagttttatgatctttttgatgaaatgttaaaagtgttggccgagcacagtggctcacgcctgtaatcccaacaacttgggaggccgaggcgggcctcctgaggtcaggagttcgagaccagcctggctaacatggtgaaaccccatcactactaaaaatacaaaaattagctgggcatggtggtgcacgcctgtaatcccagctacttgggaggctgaagcagtagaatcacttgaacccaggaggcagagcttgcagtgagccaagatagtgccattgcactccagcctgggtgacaagagtgagactctgtctcaaaaaaaaaaaaaaaaaagtgtttgtggtgtgtttgttcatgtgtgggtgtataacagacacacattgaaccactaactatggccaaatctaggaaataggtttgggaaatagagcaagggaaatgtgagattttactttttaatcaatacaattaaactttttttcttacagttatgattcacaatcatctacatttttattgtcaatgtcatcacttagcagcttccttaaattgcccccaaatataccctgaacactaatttcttcattcatttagcctatgaataaatatgagtagttatgcccaataagtgccaagtgctgttccaggcactagcaacaagccagactacaagctttgtcctcatggattaagcatcctaacttttctgagccttagtccttccatctgtgagactgatatattactctcatagagtattctgaggatgaaattaaacgatgtgtgtaaagtacctaacatagaatatagcaccatagatgtgctcggttattgtaagctacaatacaagcatatgtggttttactgcactttgctttattgtgtttacaaattgaaggtttatgtcaaccctgcaagtctatcagagccattttccaaaagcatgtgctcactgtgtctctgcatcacattttaataattctcgcaatagttcagactttttcattattattgtatttgttaggctgatatgtgatcagtgatcttgatgttactatcataattgttttggggcacaataaaccgaacccagagaagatggcaacctcagtcaataagtgttatgtgggttctgactgccccactcacggaccattcccctcatatctctccttctcctctggccctcctgtttgctgagacacaacattgaaatttggctaaataataaccctacaatagcttctaagtgttcaaatgaaaaaacaaaaagagtctctttcatttgaacacatgtctctctcttgaatcgaaaactagaaataattaatgaggaaggcatgttgaaagctgagataggccaaaagttagttgtcttgtgccagttagcccagttgtgaatgcaaaggaaaagttcttgaaggaaattaaaagtgctactccagtgaacatatgaatgataagaaagtgaaacagccttattactgaaaatggagaaagtttaattggtctggatagaagatcataccagccataatattcccttaggccaaagcctaacccagagcaagatcctaatgctcttcaactctgtggaggctgagagaaaagaggaagctgcagaagaaaagtggaagctatcagagattggttcataaagttaaagaaaagaagccatctccataacataaaagtgcagggtaaagccacgggtgctaacatggaagctacagcaagttctctagaaattctagccaagataatagatgaaggtggctacactaaacaacagattttcaatgtagacgaaacagctgtcttagtctgttttgctttgctataaagaaatacctgagactgagtaatttataaagaataaaggttttttggttcatgattcttctcgctggaagattgggcatctggtggaagcctcagggtgcttcctctcatggtggaaggtgaagaggagctgctgtgtgcagaaattccatggtgagagaggaagcaagagagagagggaatgtgccagactctttttaataaccagcttttgtggaatcaataaagtaataactcactcatccccaaggaagggcattaatttattcatgaggaatctgtcaagataacacaaatatttcccattaggccccacctaatgggaatcaagtttcagcatgagatttggaagggacaaacatccaaactatagcaattgccctctattggaggaagatgctgtctatcactttcatagctagagagtagaagtcaatgcttgacttcagagcttcaaaggacagcctatcttgttaaggctgaatacatttggtgactttcaatgctcatttaccattccaaaagtccttaataattatgccaaatcttctactctgcttatactctataaatggaacgataaagcctgggtgacagcacatctgtttatagcttggtttataacacattttaagcccaatgtggagacactgctcagaaaacaagattcctttcaaaatattactgctcattggcaatgcacctggtcacccacgaactctaatagtaatgaacaaggagataatgttgttttcgtgcctgctaacacatttattctgtggcccatgaatcaaggagtagttttgacttccaagtcttattatttaagaaatacattttggctgtagctaccatagacagacaatctgggcaaactaaattgaaaaaccttctggaaaggagtcaccattctatacaccataatcttcaggattcatggaaagaggacaaaatatcaacatcaacaagagttgggaggaagttgattccaatcctcatggataactttgagggagtttaagactttattggaggaagtaactgcagatgtggtggaaatagaaagagaaatagaatggaagcggagcctgaagatgtgactgaattgctgaaatctcatgataaaacttgaacggatgagcaaagaaagtggtttcttgagatagaagctactcctggtgaagatgctgtgaacactgttgaaataacaaaggattttgaatatttcataaatttagttgataagacagaggcagggtttgagagggctgactccatttcaaaagacattctactgtggataaaatgctatcaaacagctttgcatgctatagagaaatcttttgtgaaaggaataagaattgatacagcaaccctcattgttatcttacttcaagaatggctacagccactccaactttcagcaaccaccctgctgatcagttaccagctgtcaatgcttgggcaagactctccactagcaaaacaactgtgactcacagaaagctcagattattattagcatttttagcaaaaatatttttaattaaggtatgtacttttttaggaataatgctattatatttttaatagactgtggtatagtgtaaacataaattttgtatgtactgggaaaacaaaaacatgacttgctttattacagtggtcctgaactgaacctgcaatatctctgatgtatggctgtaattgttattgctgtcatcatcaccatttttttcatgaccaactgctcgatccagtgtaggttttctggggaaaaaataaatttcatctcaagaacgttaattgctgaccttgtaaacaatgtgaactacatttcctttactgaatcacagcagacttagaaaaaaagagagaatagaaatcaattcaatgagagaaaaatgttgccttctatttatttaatacatcccttagctacagaattcttatttcctcggtttaacaaagtagattacacagcagaggctgatgcacatttataaaaatatatgacattttgtttatgtcagtggggatgaggaatcttttttttttggagataagagtaccaaagggcagtgagtggccccttaatcctaatagcagatacttccatgagtgaaaaccacagttaatgaagctctgaaagtgaacctctttttacatttgtacttgattttgaaacatgcaaaacatagttgaagccagtgtgagcttctctttcgtaaggactcagaagctaaatatggagccaagtttaactatccaattaaatgtactgtttacaaatgaaaacaattatattttcaattaacaggaagatgaaaaatgcaattactttagctatggcatattttattttatttcttttttgtttgtttgtttgttttattttgactttgtgctgcaggcagagttaattaactctttcagcaaaggaaaagaaaaacattaaacaatgattatgtgtgaatttcctggagtgatcccagttaggtagcaggggcttgattgtctgattctgtgagctctaaaagaaaccccaaggtaaatagaagtactgcagatagtgtaaccatgagcaacaggtatttttgtgtcaaaggaccaaaaattgtccttgtaagtgtataggtctttggtatattctaaaagttaatttttaagttgagaaagataaaaggacaagtggtatcctgaagttcatgtgtcataaaaattattttgtggtagaaaggctaagtcactaaatattcattaagaaataagtgttgtgtaaccatttatctaatcattgtactaggaaatagctacaaaagtaaataccataatacaatacaatacatacaataaaactgctcttaatgagtagttctactgtaatcagagtcacatgaagccatgacataagaatgctttatttcatatatcttatttcatggtaccctagctgggttactctagtaacttggttaagcactagtttcaaagcaggatggtcaattcttccaacacatacaggccaatatagattgttttttcctacaaattcttgaacttcagattttacatttggattacagtctttctcaagaacaatcattttgcaacatgttttcattcctggatttgatcttagtaggactaccaaaatgcaagaaagtacaaaatgttaaaaaagaaaacctcaaagcattttggtagtcgtatttttatgtttgatatgaacattatttaaaccaatgaaatacaatatattgcaatacaatatttcaaagtagcatattcttttaagagatttcctgttacatagtcaggctatttaatttgctcagtataatgattaaaataaacttttctggtgataatgtctattgtgagtattctaattggtccactctgattgtcttgaaaattccctaagaaattaactcttttttatagatataagtgttttggcaaatgtcacagattttttacagaaggattagagaatttttttcactcttgtctttttggtatgtatgtgttttatataagacaagggtgtattccaaagctacatctagcaaaatttatgttttagtgtttcaaaaaaaaatctgtgccatgacagtcattagatctgatcatgacacttttgaaatatttagccaaagtcctcttattccaccgaaacacagttggaagcaattatttaaaaccacacataatttatctggaggttttaaaacatgcctttgtatataaatagcttttttcttccatactgctttgcttagttcaactgtgaaggcaattaatttttaaagagttgaaagaccgttccaaaatacatttatctctgctgatccctaaaatttttctgagtgaaccaaatacctaatagactctacagataactctcttgtgtagctcttatctcagccataatgttacattcgtgtgattatctaacaaatgccagtgttccctctgcactgtatgcttgtggagagaaagaccatctcccattgcttgttattgctctctagcaccatttcagtgcctgtagttgcatgtaaaaattgttcaatacttatttgttaaatgaactttatgtaatgggggacactttgtgaaaagtcagtaatcactccttgacttagtttcactcttttcataaagtctaatcatatatacacaaaaactgttgtacatatctattgttcaagtagggaataatatgtaaaatgtttttagtcattcagtaaaatcacatactaaaaatcaatgtcaatttggttttttttttctgtcattgttgatttgacagaaaaatcaatgttgatttgttttcccccccagtggacagaaatttttcaagtcaaaaatttattaaatactacctgttatttgaaatcatttcttttaaagacattcaaaaaattatgacatcttattcgttctcacatcgtcaccatgagataagtactatttttcaacttgcagaggaaatgtcttctactcaaaaaaagaagactatttggttatattggtttctagattaataaatgcccttggatatataacatctaacaacttaaggaaattcgataaacatttagaaaattaataagtataaaaagtgttatgacccaaagcatagtttatatactatcaagtaaaaatgagctataaaattaaccataatttcacagaaaagagtatttgtttggaagtctaacaaagttgagacattatacagagagacactgtatgggtcgatatctcaagtaagccatcatctaagaaccttgcaaatgatccatctgaattatatatatgatccatctgaattatatatacattataataaattataaatatggccaacagttaatttctttggtttttctaagggtaagttaccccagtagacagtaatatcaatagaatgtttttcattcagaaagattcataagactccacaaactgaaataatagaattttggaacaagaacctctctgcatcactcagacgactccttggagagttttaggaaggccagttgtaattagttgaaacttgtctttgaacaggcgtctagagctatttcttctagtaagaaaaacgcctgaaggcactaagtgattacaggaatcgaaaccaagattttacttaaaggcatgtgtgtaacatatcatgcgtactctcctcaaaatgccctatggatcttttttcttttctttaatttaggctccccaaaaaaataatgtgtgccaaatgatccattctacttcttgccaggtctggcatgatatgaagcctgacagggacaataaggggacaaagcaaggaggagtactgaattacttttcttgctttttttttttatgttaaggaacaagcccaaagaaaaacatagatcattgtgacaaatgcattgtatctttataattcattgtagttggcaagaactcctaccaagtaataaatgttaagcaaaccagagccaccattgcataggtaggggtattcttccactacagtcacatcatttggcctcagctcaaactactgactttgtcttgatgattttcttcattgcattagtaagttagcaaaagtgggtgggggtggggatccctgctttattcctccttcactgtgtgtgagcaaatgcatgcatgggtggctgaggtgcgggaaagaagaagagagaatatgcagaggttaggggatttttaaaaacatgtaagttttgttttattttgttagtttaaatttgcccttaggtattgttcaaaatgtcctcatttcctttatgacacaagggcttttagaggaatgactgaattaaaagacagtttataaaagttgcaagatatagggaaatgattgtttacaaaataaggcattgatgaggaaggagacagaagtgttgctgggatgactcttcaaggggaaagtgaaagttcagtgactgacaggaaaacaatcatagcttctgtgcttcatagagctggcctgccactcattgcccctttttcactctttgattcaaacatatacaggagggagaaagtggcattgagcctcctccagctgacaaaggaccagagaggcaaaccgaggctgttagtctaccaccatgctattcataccatgccctctcctgaaatgctcatacacccactctctacatgttataaacataaagccttagtcaaatagccacctccgctatgacactttctttgaccacttttgccaaagtggcgtcatccccctctacagagctaagtaatgattctttaagaaaccctcacaatgctttttgctctccatctcttagccaaaaacaaaacaaaacaaaaaagtctttggttgtttaagctaacacaaattacttcactcccttatgcctgagtttctaaatatagaaaaatggagataaagtcagtaactacctcacagggtgatttcgagaattatataactgaattgctacagagtgaacaatgcaggtgaagagataggtgctcaataaatgtgagacatgttaactatcatgactactactgccattggtgagcacacattatatagttccctttcttgagctttgctttttattcagcaaattgatcgaacgcatcctctgtgcaaacaactgtagttggtgctacagaacacacaaaatctataagacaccattacctggcctaaggagcttgtaatcctttcaaagagataaaacacattactttagtgttggaacaaagcacaaaattataagaaaacttccaaggaaagttcaaaagatggatcaattagtggtttctccaaacctgctttagtatcagaatccccttgggaaagtgctgtttaaaaatatagattcccagacaccaacccaaaaatagtaaataagaatctctgacttgtagccaaggaaattcaagtgattccaatgatcacccagtaggaaatccctagaatagtcacgtacaattggaaataaaaggctttctgttaaaaggtggtcttggccaggcgcggtggctcacgtctgtaatcccagcactttgggaggccaaggtgagtggatcacaaggtcaggagatcaagaccatgtgaaacccggtctctactaaaaatacaaaaaattagcagggcatggtggcaggcccctgtagtctcagctactcgggaggctgaggcaggagaatggcgtgaacccgggaggcagagcttgcagtgagctgggatcgcgccactacactccagactgggtgacagcacaagactccgtctcaaaaaaaacaaaaaggtggtcttgaccaggcatcgagacacattttataagagttaggatagaaggaagaaagagtggtgtcacttaaaagagatgagttagttcctagccagtgatcttctcaataaggatgaaatattatcttctgctaagaatcaaacaggtgaaaatacagttcaaggtttgggaaatgtggagaaagttggaagagttgtaacatgttttacagggataactagaggtgaattaaactgagggtccattatgctacaatatctctcactgcaatttccaaggccagtttatacctaggctagggtcattcttcttaaattcccagaagcttatataaatgaaaatgcactgacattatcaataaaagtgaatttttaatatcactgacaataggatcattaactattgtgaattcttcatgtctgttaacaaccttgtttcttttgccaagtataaaatttcaaatttgatctcatgaaaagtctaggagtcagattctcataaataacaacagatctatccatttgctctttgttgatctgtagctggcatctgaatatatgaattcccctagggtgagaatgagactctataattaaagttaattggtgttgcttttcacctgtttttcttcttggtgagtgaactcttttattcctctcatttttccacatcaaattctcagtattgcaatgggtctcccacagttccaggcagtttctggttcttggggggaaatgctcctgtggcattattgattgcagccttcatgagaaggacaatgatttactgtgttgcttcctgtgcagctgtgaatttgctgtacagtgacagggccttccgtggcatcctctgtctcaacttgacaggagatctggagagtgagctagctgtattgaaatgaaagtgtcctcaccccaaatcacattctgtccctcaaactaaacccaggtcagtgagaggttagcgaaaacacggttaagaatgtgctaaagggtgatactgaaattgaggctgtccccactgtcttctcaaggcctgtaacccggcttgccctcctaaaagcttcatgctgtcattccttgccgcctccttattttcctaggctttccacaactgcctgctttcttacccatactcccaatactgcatgctatgattttggggaggacacattcaggccattgcacacctgaacattctttttttttttttggctagagtatcagaatgggcacttgaccttaggcagcactgtgtttggacttatacattgttcatgtcaatgtttggttctaaaaggaaaaactgaaaacctattgcaaatggactccactgtattactgtggctgtaccacattagtctttataatgattataacaatagctgcctggtatggagaacttaatatataccacataatgtggtgaacactttgcatatacaatacaatttaagataaatattccattccagggattaggaaaactgaagctcagagggatcatgttatcttgccagtacatagtcaggaagtaatgataacagaatttcacccacgttttcctaactaatactcatactgttcttttatttatttatttatttatttattttgagacacagtcttgctctgtcatccaggctggagtgccctggtgcaatcttggctcactgcaagctccgcctcccgggttcacacccttctcctgcctcagcctcctgagtagctgggactacaggcacctgccaccacgcccggctaatattttgtacgtttagtagagacagggtttcactgtgttagccaggatggtcgcgatctcctgacctcatcatctgcccacctcggcctcccaaagtgctgggattacaggcatgagccaccgcgcctggccaatactcatactcttaactattacattctccttttccaaaaatctcagtcctttaattattttccctgcttaaaatttcctaaaccttatccacacctcattatcattctttgacttctctttggtcataaattatttattatgtgtatccttccatctatctgtgtacttgcacattgttttgcaggtaaaatccatattgtccatttattttgtgctcactcaacacctggtatatcagtgttatgcttttggagtctttggaaccgttagttttctatatggatcataccctgacttatcataagtggaagtgataagaatggcctgggggtaggacaagaagggagagaaaataaatagttatcactgattctcagagggatgccgagactaaactgaccctaccatcagattgttagatatgatcttcttgaatgctgtttgctacacctcctatctacatgcctacaggcagccttcacccagagctaaaagaaagtggaatccaaatgtttaaaaaatatttatttagaagcttaagaactctacccaaagttctcaggctaggattagtaacattaggttgtaatgtccactcttctctttcttccatactctgagatgttctccccagtaccagcttatcttgttatgcatcttagaaaaattctttttattattattattatactttaagttctagggcacatgtgcccaacgtgcaggtttgttacttatttatacatgtgccatgttggtgtgctgcacccattaactcgtcatttgtattaggtatatcttctagtgctatccctccctcctccccctaccccatgacaggccccagtgtgtgatgttccccaccctgtgtccaagtgttttcattgttcagttcccacctatgagtgagaacatgcggtgtttggttttctgtccttgcgatagtttgctcagaatgacggtttccagcttcatccatgtccctacaaaggacatgaacttatcctttttatggctgcatagtattccatggtgtacatgtgccacattttcttaatccagtctatcattgatggacatttgggttggttccaagtctttgctatcgtgaatagtgccaatatatgaaagtccctggggaatcttgagagccctttgggccagcatcaagactcactgagctgtaatttagtgcttaatgccataaggaatttggaatcaatttttatacagtcatggatcacttagtgatggggatacattctgagaaatgcattgttaggtgatttcattgttttatgaacatcgcagagtgtacttacacaaatctagacggtatagcctatgaaacccaggttatatggtataggtgtatttcttctagtctacaaacctgcactgaagactgtgggtaatagtagcacaatggtaagtatttatgtatgtaaacatatttaaacataaaaagataaagtaaaaagatggtgttataatcttatgggaccactcttatatatatggtctgtcagtgaccaaaatgtcattatgaggtacatgactgtaattttctgtaatgtgtgttgcagctcaggcactactgggaatattgggtcacagtacaagtcctcttttttcatcacaactacagaaaaattacttcaaaatgcatcaactattatctcatagagtgtagcctctcatagaaagaccataagagtaataatatctacaaagtggatctgttctcacgttactcttctttctatgacagtatgtccatttgttatatatggaatgccattatttgcagtgatctatatagcttgagttttaaatcagtatacttttatcaaacggtatacctttttgttctcatctagaaacaaatagacagagtgtagtatccagtattgcttaccaccatatacaaggtaaagattcaccacaatttaccaatactctgagcaatttagttgctgacaaatataactggctattcaaacatgggtaaattgcacttctacaattattcattagggctcctataataagtatttcagatgcctacttagctgggttgctttcatttctaattcataaaggtttaaaacagatttgagaagctgattatgcaagggttggggtaaagtggagaaatagagggctttgcaactgcctgcattttgtacatacacatttacagtattaccagacctatttctgaataaagagaccagcctcttggtccctctgacaattgttatcaggactgaatggcattcagtttttatcaagcctcttctctgagttattgaagcatcccataatatcatcaagtaagtaaacgttgtgcatgtagctcttgccattatcatggaaaatagcaagtagttctcatgaacttgcacaggaatggtgcaagtaacatccctttcataacagcaacgtatccacaccatttcatttgtctagccacatagacacatagaaaggtaggctattccttttatatctattggtaaattttctttcgaataactgctgagaacttcactcctataagcagttggtgctgctggttgaagaaaatagatacattatctaaagtaatagataagtctcattaagaagatggaatagactaattcccagcatatctcccatgcgtgggaaaactaaattgtgaagtagagcagtaacacatcaattatcctttctgcacggaattagacgagcctcactgctactttgtatcacattatgtaattttttataaataactatttatgtcagatcacctcagtttgctgccttattaaaaaaagatagctaacacttctagcttactaatcagatttattcctgaaactacttaggaatccaggtagtctatttaaaatttacatgtgtacttaaggaatccttattcctactaaggaaatagtgttaacatatgcccaaagaggtgatgttttatattaacctaaaaataaaatgctatacatttaatgatgttacaattttaacgaagatcggcttctaccaactaaagtgaagctagctatcaccatttagaacaaagtttttgaagatcttgtgttaaataatgacataatcagtttaagtagttgatcaggtttgccacatcaagttatcatatgtgaagtgctagaaaacaattcagtttcttcagtagtttaaatctctcttgctttttgtctacatagttaatctttattaacttattatgttcacaacacaggagttaagttaatgaaagcttgtatatgaagaatttgcttgctaaagtaaataataaaatttggtacttacctgttttaatttattgactgtgtggtaaaaagtgaaacaccataatgacaatagaaatgctttgcaaattatgaagtgatatttttaaaaagaaggatataacatttatatgtatcctagtttttaaaaacatcttacttattaacgaggagaagaagaagcatacattctaaagcttctgggtctaagattagtttcactccagatatgattcagagggagaaggaggaaagtcagaaggaacattccaaaattggaaaagtgctaaaagggaaagtggcccctaagtgacacccatcactctgcaatcatgacattgctgctgtgctgcgtatttcacaatctatgtttcttagtctgcccaggctttccaaacaaaatgccacagactgggtggcttaaacaatggaaatttatttctcacagttcttgaggctagaggaccaagatcaagcaaggtttcagcaaggtagatttcattctgaagcctcttctcttggcttgtagggaagctgccatcttgctgtgtgctcacaggacgtcttcttcatgtaaagagagagcaaacatgatggtgtctcttctgataagagcactggtcccttcaaatcaggtccccattctcctgacttcatctaaccctaattaccccccaaaggccccatctcaaaatatcattacaatggggcttagcgcttcatcatataaactttggaggggcataaacattcagtccataataacatgagattgagtgcttttgttttttacgtccatgacaaatcaagttaacaaatatttattgagtgaatacagaaggaaagtcacaatgcttgtggtgtaatgaataggatgaaatacatattttaagattcctgtcctcaaggagttgatagcctgattgagaatataagaagtgcatcagaagaaaaacatgcatcaaatataaataataattcagagtgaaaacagagacgtctcaaggcagtgtatggttcaatactaaatgggcagttctcaggaacatttttgcagaggagatggaatctgagtcctgagagatgttcttcacagaagcatgagaaaagaatgccctcttgtcattcacttattcactcatatttactaaaggatattatgtgtcagaggttagaaatacaaaattaatagtgcatagtttagtatctgccctcaaggaggctaacatccaaaaaaaagaaagaaaaacaccactaaattcaagatcaagtctcaactccttaaataacttacaggccttgcttctccagcgtggttctggttctccccatattcatgctcagtctcagggaactccgttcgtcttttcagaatgcctgtactttcttcctgctggacttttgcacaaactgcttcctctacctagagtactcttttcccaatctccatgccatcacctgttctactaattcctaatttctcatctaagacaacacttactccaaaatgttgttcctaaactgaccatccttctaaaaccaaggtctggtgacctttgcacggtgccttctcttgtgctgccccattccgggcatgtgaccaccctgcagtggaactatccagtactggaattggaggttaacatccaaggaacagttttgggattttttcctccatttataaaaccttagccagttgcagtggctcacgcctataatcccagcactttgggaggcagaggcgggtgaatcatctgaggtcaggagttcaagacaatcctggccaatgtggtgaaaccccatctctactaaaaaaggcaaaagttatctgggcatagtagtgggtgcctgtaatcccagctacttggaaggctgaggcaggagaattgcttgaatccgggagacagaggttgcagtgagccgagatcgcaccattgtactctagcctgggaaacagggcgagactccgtctcaaaaaaaagaaaaagaaagaaaaagaaaaaggaacctcatagcgtatttggattcatgatggaaagaagtttgcaggtagaattcactttttaaaatgtctaaaatgaagagaaactgttctcctgtgattctaggccacctcaagagaaggttatgttactgtctaaacactctactaaaaaaagaaaattgaagcacttcatttcagagctgtaataatgctaaatacaatacatctaaaaattaaaatataatttaaaaaaatagtttagacttcccatctatgaaaatgtgggtaaaacagtaatgttattttcccacagttgtactattgttgatgatctaactcactcctggctgagagtttttattatgtgcactgaatttatccacaaactgtaatacaaatatgctctgagttttttaaaatatgtatcagtgtacaacctctaacttagatgttgtttgcatcataaaataattctcccgctattaaagcctactagagtagttctcagaataatgaattccttccttatatttaaattattattcaactttttagaagtttagaatttgtgcaaatgctaaggaaaatgtttgtctcttcaaaaagtatccttcttaatcttctctttcctaagagtatgtcaaagctgcatatcacaatctttatccattttacaaatagcatacaactcaggatctcacttattttaaaggttaattgtcagactcaaggatatgaaaatatacataaatgcataacatatatactatacacaaagcaaaataagtttgactttatgacaccttttcataaacatgcatttgaaagttttgcataagaaaaatgaagagtgactctaaacagagatgatcgttgccagtttctcactgcagaatgaaatattttttctcctttaccctataacccaaatatcacactgagcttaaggatgaagctgacattttaaaagatcaccaaaagcgttctctttccaattgcaattatgccctctatctcagtgggagccattgtctgggtcttctcagctctctagcatctttctggcttgctttcattaccctgattatctattcatttgccgcccagtactcattttatgaaagatcatgtctgccatttctgtaatgagtgcttgacttttactgccagcataaacacataaaatatataataattaaagttcactagtcaccaaagtcttgagatccgtcatgttgctaatttgattttttaagcaattgcttctccgcgaacagggctgattttgcccccttaggcagtgcaagacttatggttgaaggagatgactctaacctagagagatcaatttgaatgggcaccatatatttcaaatttaaggttcattttctaccaaataacatgtctataaattatgatgggtcttagagccaacaaaaatttcatcaaaatttgaacataaatgttgttctaaatgttaaagattaaacaatgtgcttttcaaaacagttaaatgttatttaattgtgtagcttttatggagaattgtttaaactctaagaaaaaagttaattggaataactacaggagcctacacaacacagattggaaacttcacaatgtgttgacttacattaagtaaggacaaggttccagaacaccacttccttattttgaacacacttccttgttctgataacattggcaaagcaccctaagtgccccatgataatgaattcatctgacctttaatcacaaagcgattaatgaactcatgagatactcatgtggctctctggggacataaagatgtgtcatacaaagtgtaatgtttgtaaatggatacagtggaacacgtgttagccaagggacttgagtagcagactctcagtttataaagaagcaggaaataaagaggtgcttccatttatacagattttctttagagataataaagatcttgatggtgtattcaaaaaaagcacagaagccagaagacctgagtttgaaagcagaatgtatcactttccagccatgtggccttgggaaacttttcttcacctctgagcctcaatctcctcacctgtaaaaggagaattagtaatatcagacttcctaaaggctgttacaagagtaagaggtacagggtcgaagggaggaggggtttgaagtgatcaatcagtcaatcaatatcattcctccctcacaaggttaagaagtaaatcaaataatatgcactgttttgaaaaggcctttataaactgcagcatcatgcatgtgtttatttttgctattcttttggaaaataggtactctgaataaagttcacagttgtttctttttccccatacacagaatggatgccttaggaagacactagtaactacataaggacatagacattgttttgtgaataaaccagatctgaccgattaagtactttatcaaattacctttttcaaatttgaaagtaacatatcaggtttgaagcaacacaggaaacttctctttttaaacaggtctctgctctgcagcagccttcagcaataactgagtttataattaaatccagcctgtgtattcagccctgcagtggggagctgggcagaccacttcacctcaccggcaggagttaaatgtgatcccatctcccaggtccagtactaacacactgtcattctcattaagcatgtgtagtaattctttaccaattctaaaaaactactaattaatttacagtacttctggtcacacataattaaaaaccattttcatatctttgattaaaagagacacaaccttttctgcctcagttcattgtcttacccgttcttagtaaatcataatcacttccctggaatttctttttttaggagtgtaatatctgctcatatcgccttgacttcaggctcaagctcccattgcctagaaaatgattcaggaaatacaaccctcagaagacaaatactacctcatcttgaataagtgaggcagtcatcttttggaacatgggcacttccaatctcagaataaatgctcagatatattttacaatataatcagaaaaccaaagaaattcaaaattcacttgaaggattatgtggccattgttcatatacagtgcatatgtgaaattctctctcagcgtggtgaaatgtggactcaacacatgatcactctgtactcatttaaagatgcacatgtcataacagatattactacatgttaatacatattaatacactattgaaagagcactggaataggagtcaccatctctggttctaaaacggactcatactttccaatgattggacttgctatatcacttaagccacctcaacttcaatatcttcatcagtgaaatgagaacttattggcttatagagttattttctctgaggtttccaaaataagtcagaaactatagccagaaggtcattctggcagcttgcctgtttttacaaataaagcccacttgtttacttactttctacggctgctttcacactacaaaggcagagttgagtagttgtgatggacaccatatgggccacaaagtctaaaatattggctatctgacccttaacaagaaaagcttgctgacctctagtctaaaagatgatagttatgaatttatttgaaataccatgaagtactattaacctatatgatagaaactcttggtggattgaaattaagcaactgccatttggctcaactagctagaagaaatagttaaaagttcaatttaaacaaaggaaatagctcctaatagtttcccttacactatttgatattactgaggtattagatgctatcaataaatatttgttgcacttaatgttaccaactgatcactaagagattttgcttaagaaaaataatcgattgatgattgattcacaggaagttgatagaattgatttttacaactctgatatgcaaattgtaatattagatatgccaatcaaagtgccactatgcttaattgtttaaatcttaatctttgagaagtgcttctgcttcgatgcaagattacctacgttttccaaagctaggatgaaaaaattgatgaatgaatgaaaaacctattgagctaaagttttttctgaaaatcatctgcatgctattattaatactttctcagtaaccatggagaggaaaattttgtgaaaacccagaaaatgaatttaataatgtggatattatgagccaaaatagatttattcagtgtgtgaaaaaaataactttttttcagaaatttcaaaatttctttctcagtgataactgacattaaacagtattgagtaatgggactctctcctaaatatctttttaattttggttacataaaactcataagtaggtactgataaaatatttttgaaatattaaaatggttattttatcctcacgaatttctacccccaaattgcctcaatacttccaaattgaagaagtaccaaaaggtcttgtatcatagagtttctggcgttacatagctataattatctttcactatgacaggacaagaagcttgaagacctagggtgtaagaaggatattcaggagaggaaaggaagccttacttcttctgaccagaggattctaacagaggtcaggagaagagaaaggcaagaagacattagatagattgaaaggcacaacaagggtagaagacctaatgcttctcttccctttagggtctctgggggagttcccagggcacaccaggctctttaacaacagagaagacctcagatcattaagaatgcagagcagcagggtcaggaaaaagcacaggttcaataatcattcccaggcctccctttctttcctgtgcctcgcatgcggggttagagcatatggacctgccttgggcccctccacagtgaataacaaggtgaggtcatcataccatctggagggctacagaatcatcaggggctggataaagaaaatggcagaggctcagaaggatgtagagcaccccaacaaaccaaaggaggctgagtcagcagggaggagcccataagccctacattagccaacttttagcacctatagcctttgcagactttagcagcagtcacctattaatctctaaaactgaacccaagcccatcccacctcaaaggagagctgccaaagcgaattcaaggacctgcaagagaccagccaccacctttcccctaaatccctaatttcagggatataatgctgtcctccataaatcctgataccattttgaaaaagagtaagggaaaagagaagaaatgggaagaattgagtaattctctcaagtagattgagctaaagctagagacatgttaaattattagatgagattaaattttaaatcatattgggctaaatttagttttttccccactgctcagtaggcacagtcctcctaagatcaattaagttatagagaaaagctacattttctctgcatacccaaattgtagcatgaatacatttgctatcacactataattatattgtttggtttagaggaaacatattgatgagacgtttactcagggtttaagaaatctctgaaactaaagaagatagcttttctctgcatacttacatattagaagctgtgtgagataatggagagaaatgtgctggaaggcagacctgagttctaagcccaattcaactatttattatctgtgtgagcaacttaaaaagtcatttaaactctacagcagtgagattgtgtgttccatgtgaaaaatctagggaatcattatgccggattacttagcgtcttcatccataaaatgggggaggagaaacagacggggaagcaataatgtctgcaacctttcccattctaatttcctagtagaaatgactaaaaaggcaggtgtcatttttcttaggtaaccagtaaccagtaacttttttagtttggttcagtaggaattcacctatgggccatgattccagaaaagtttgagaggaacttattgacagcgatggtatttaaggacaaaatcagagtgacctatgtgggattagaaatttgcgtccaactttcagcaacctgttttgtaacaaataaattaatttgaaaatcatttcctagagtagtgactaaaaatggtaagggatcaaaaattagtgtgagtctcaaacacaaatgaggctaaaaaggctcttcaagatgaatgcctaaacctgttggatttctttaattttaatatgaaagaaggatcttttgattcctctactcccttcccctgaaatttcctcatttataccaataaagaaatcagtgcaattttcaaattgcaattaagttttatggacttctaaaatttttctgttcaatgggatcacaaatgttttaatattttggatgaaaaaaaggaaatgagatgtccgtgtcagtgaatcaatcattcattgatcatatgggcatgtaattctccattaagaagtatgtaccggaacaggtccaaagaaagaacaatagtgatacatgtgacaataataagtctagctttagagttgcaatagccttccgcgtgccaggtaatgagcttttcatgcatcttgctcactgagatcgtcacgtgtggtcttattaattcacaccacaatgaccctcaaaagtaagtgttgttatgcatcaccatggtgtaaaaatagcaggaatttttctgactatactccaaaaagagattttagccgttagttcatcacagtctaatagctaaacttatttctaatagtttaagtatttacagccccacaaagtctatacttcagcacttcaatcccatagattaacaataaccacagtaactctttgctctctatgagcaaatactgccatcttgtggaaattgcacgccaaacagaacattattgttccataaactcaaaagtttttcttgtgtttattaagaattttgcaactcaatttttgcattgtcatacatacgcgcacacacacacactcgcacacatacatacacattattgttgcttataattacaaggtacaattctttagattttcaagttcaatttaaaagggccagtgctttgggaagattgaagggaacatatctctttgcttattataagaattcatcctattcatcttccaggcagtgcattatattttaccacacttgctttacataatctttaaattgggtttttgttaaatcataaaaaggaggccatagtgagaccattctgatggaatttccaggaacactagattttgtagcaaaatgttatgacagaactctggacttagagaacactttcattcccttccaacacttgtagcccatgccagcctgtattcctggaatctgttgtcaggggtgactgaggggtcagatggtccaatttctctgtacatccccaaagatgaaatctccctgcaatgccccagccacttgtgctgccgtgagcataaaataaacaatacaaagagatttttgtggcatattcgtacttgaagcacctagagagggtgcttccttctttcccctcgatgatctcctatcgctcagctggctgaacctaaaaattctgcaattaaatgattttttttgggtttaaggcttttaattcctattagaatttaaataggtgaggtattatatatatatatatatatatatatgaggcatatatatatatttcaataatgatttctaaagtcaaaatattttccaagtttagaaagaataaggagacaaaattaaataaaatgaaatgcaagggccccaaataccactgagaagaaagtgtaggcagtaattaagttcctgaatgaaggaaggaataaatgaacatgaattgagggcattaaaaaaatggcttcacagtgtcactcaagcctctccggtggaatgtgcagtcgtggtttagaataaattttgtacccaaggaaatgtctggaatgaagtcattcttcaactgtttattaaatggatagatgaataaaacaggaatggaataaattagaaaacagcatcaatcgtaagaaaaaagaataggatctgatatcagagtttaggattcatttaccaaaactgtgttgagtatattccatcaataaatatgcacctgctctgtaggaggcaatatggaggatgagtacacactctcgaaaatggaacagactgatcaagtaattataaatgatgataagtgctatgaaggaaaattcttacactttcacagtgtattagttcgttctctcactgctatgaagaaatacccaagactgggtagtttataaagaaagaagtttaattgactcacagttccccatggctggggaggcctcaggaaacttacaatcatggtggaaggcacctcttcacaaggcagcgggagagagaatgagtgctgagcaaaggggaagccccttataaaaccatcagatctcgtgagactcactatcacaagaacggcatgagggaaaccacccccatgattcaattatctccacctgtcctgcacttgacacgtggagattattacaaggtgagatttgtgtggggacacggagccaaaccgtatcacaaggctactgaccaatatggtgtgatgcaaataggagagcaggataacaggatctcattttgtgcccagatgtattctcattaagcaaatgttgctgtagttgccttttatatctacaagtacttataaactcaaatttaaaaagaattatttgttcaaagatgactacatttttcctccaaggtaatcaatggtgctctgactacctagagcctttaggtgggcaaatacataagggatgtgccattattttttattattatggtaagaattcttaacatgggtgctattctatgaaaatttttaatgtacaatacagtattgctaactatagttacaatgttgtacagtagttttcaagaacttttccctcttgcataactgaagctttacacctatcgacgagcaataccaacatcatttaaatgatattcatgaataggccaggaaagtaattttgataccatgattacatctttgtgtgttgcctaacacagtgctggaaatttctacaagtagttgcttctttggatcaagagattatttcccatgtgtatttcttaaacctgttacttggaaagcaaaatgagagaaggggaatgaaggtcataagtttgggaaatgctgagttaaacaaaatcatgccgttttcttttctgctggtcttctgagagtctttaataggctgacatctttgtaaattcccaagagtgtgtttctcagaattaataaccacaaggcccttttcttacagaggtcttgtaggtactggtttgctgtgaaatgcacttttggaaattctggaaatgcaaatggctttttctggaatggaagctggaataagggtgacatataacccattaatattcataatcattttagtaaattcaattaatcaaattaattactcttctagagcaacactctagacagatacatttcacaggaagcaaggagaaaaggtccaggttgtgggggaggtttcagaacagtctcagtcctggactgccagcacggggcaccagagctgaggctgtgggaacgtctgggagagatgacagggacctgagaccaaccctctaccagagccttaagggctggtctcactctagtttaactcagattaaacactgacccaacttccaatgcacaaaatcttcttccctttatcatgttgcttgttcttctagccatgtggatgacatgaaacaggtaaaaaggtcactacaactccattctctgaactcttaaattgtaagcagtctcaccccaaataatccaagaccttgggcaagagtacaaatataggttcacataccccaagtctaattatgtaaaaattatgcattaaactaaaacctgtttgatataatatattctatgttcttatctggacaaatataccttcatgacccctgggaggccaggtttaagtttctatgtgactagccaggaggtctgaactgacccaggagcacagggctctggggccctttctttccacctgcagctccaacttgcacgctgaagtgtctcctacgcaaggctgtatacacccgagctcactcatctgagctctgtccacactctacaaactccaccctatagagctatggtgcacccgtggctgtaagatcttctgccaggaggacaaccctgggaataggcctggcaggccctggaagagcactaagctgtttggccaggaaattccagggaacccagaggacgatgcacactctgtacaggcacacagccttggtctgatcttccttgccctgtgaaaaagggcatagctggaggagggccacatctaggctggcctcaggtagagcctaagaagcactgggaattgagaataattcctctatgaaaaacacactttaaaaagctgcagtgtgcagctaccctcagactctggggaggggaaaaagaagcagcagaagaaaaagaagagggtttttcctatttgaatttaactacttctgaaagcctctggtcaggttttcttcttgttttccaaggtaagattacttcccctttggcattaaaagggaaactagatcagttgtgcgaaaaaccaaaaaagatgtattttatcaacttgaaacttatcccaaggcttcctctcacactgtgttaaataataggtcttcttaattgaatttctttgtgtgtagcatatgctgggtgacattacgccagcatcttgctctaagcagcaaaacgttcttcataaaagcattaagatcctgagtatcattctggatgtaggaaagggacacagaactacaacaacttgaaagcatataaaaacagtgcctctgaattgtgattgtaaaaacacactgaagcaaaccaggaggaaaatatttagaattatagaatgaaaccagaagaagaagaataggaagaaaaggagagaggaagatgggagggtgggatgggtgaagagagagaggaaagcagtgtggtgcaatgctgtctgtagaatcaaagcaatgatgactttctgtttcctagcattccatctaaaacaagcagatctatatattcatttccctttgacagccaccatcctacagaggtgggattataaatggatgtgttgtgaaccagggcgataactatgtctgtaataacacatgcttatgttctttatcccaaggatcctggagcttcagcagaatggtgacatggacatcctgaagcacaaatggtggcctaagaatggccagtgtgacctgtactcgtcagtggacacaaagcagaaaggaggcgccctggacataaagagctttgcaggggtcttttgtatcctggctgctggaattgtcctctcctgcttcatagccatgctggagacgtggtggaacaagaggaaaggctcccgggttccatcaaaagaggtacttgattgagagatttggctctaaattgaatcaacaagcaggctgtatttccagggaggaccatcccagggaggataatgggttgggggtggtccttgttttttcgtttcttgaagattaaaaataaagttgtgaaatataaaaattggtaagatcaatatcaatttccattttaggatatccccagatcagtgaagaggagactatagtgtttgaaagacttagaaattcatataccataatgggctttgaaattctctcaaatctcagaatagattttaattcagtgatttttaaaggccatgattcctttgaccagttcacagagatacttaccattttgtttcacttagttgtttaacttgtaagtaaattcctcgtatctctaagactagccccccaaaaatacaatactgtaataaaaatgatcagaattttctcttcaccactagtgactgcctccttctctactcatgtagacctatagaagctcttcgatggccccaagcttatcaaatccaaaatccacatcatgaaaacatccaaatttcaatgtttctcctttactgtggagtcagcttcacttcagggccatattaaattttatctcaatatctgaaagaataattacagaattacacatatctcttttatagtggcctgagcattgttttcatcaagaagtatgagacttataaattaaagaaaatctgaagctaaatcttgattaatttatcttatttccattggactaaaggggtgaaaatgttttaactgatgaagtcatattcactaaagcttcacaaattgaaacaaaaaccaatctgaatttgctaaacaattttatgtgatggatagcttcaaagaaacttttaaagtttctataactagaacttggctgactaactgatgcctgaggcaactcctgaaaggatctactttaatgcacaataaatacggcttctcatttgcatatgaattgttgcacattaatgtgtttttttcaaacagggtgatttcaaaagtagtgtaaggattccttcttatcaccttatatgcaaaattgatcagcagcatttataaggaaaagcttggctttagcaaagatgaattttagcttcctacctgtgtgaatgagcatacattctaaatatgtgaagaatgaattataaattaatcaagtcacattgtagtgttttctttgtggaataagcttctggtatctccgttgacattgattcaatgcaaaagaccacattaatgcaacattatagctgagactcatatttttaaaaatctggaaagtaaggactccccaagctccttatattttgaattactctatatgatattaaaattttgcattattatatctgttgatggatgactacattacagttgctgtgggaaccataaaattatatgtctcaatcctctaaagtctcagtgataatattgcattaatggatattttttattgaattttgaaataagaagggagaaggaaaaacagtgatgcacatcaaaatatttttcactgaggaacactataatagcacaatgaaaaaaatacatgctccattctaacttgtgacagctaatccagatcctatgaaaaaatattttctcctcttatgattaatagatatcttaaattctcataaatttaatttattgagtttggctgtaaataagactaataacaaggataattttatttccttccagttttatttctcaaatattgggcgttaatactcacttttagtgaaaaatataaggaacttatcaatgggtttcaattccaaaaatctgagattttacttatatttttgtttattaactgccttcttaccaagacgccattagcatagcttaaaacgtctttggttttgaggtcagttagcataaagctggccctaaactaaagctatcactcacgtgccctgacttgaaggggtccctaaatatctcactgacctcacagtattgactgattcaggtgctagataccttgagtgcataaatccctcaattagaaattattttgtgttgagtattgctctctctaaacaatcgcacatatccttggcttacaaggaataacactttaacagtcactaacacttcagtatgaaatagcttactatatcatttttttcaagaatggaaacttaagtttaggagtaagtggttgaaaggaacaaaaatttaacttggaatgagacgccctgaaaagggaggaagcatgtataaagaagaggtggggggtagagttgccaaaaccatactttctattgttacaattttgcctgggtctgtcttttatagaatggcaatcacccatcaactgcttacatatctttgtagttgcatgtggcatatgatcactttaaaacctttactgcaagaaaaatatttattgtagataatcttatctcagaattggaatcccccagaacttagcacagtgcctggctcatactaggtgctcaataaatatttgttaaatgaataaaccccaaagttcagttaattacatgtttgctgaactacttttttttttttaaccatcaaagctagtactgatgagaaccttattttctttttcttcatctccaggatgacaaggaaattgacctggagcacctccatagacgtgtaaatagcttgtgcacagatgacgacagcccccataaacagttttccacctcgtcaattgatttgacccctctggacattgacactttgccaacacgacaagcactggagcaaatcagtgatttcaggaacactcatattaccacaacaacctttatcccagagcagatccagactcttagccgcacactgtcagctaaagctgcttctggtttcacttttggcaacgtgcctgagcaccgaactggcccttttaggcacagggcacctaatgggggctttttcaggagtcctataaaaacaatgtcatctattccttatcaaccaactcctaccctggggctcaatctgggtaatgatccagaccgaggcacctccatatga

SEQ ID NO: 2594 - DNA, 53367 bp, Homo sapiens; identical to SEQ ID NO: 1905

SEQ ID NO: 2595 - DNA, 224291 bp, Homo sapiens
gccggtcccttggcgacgggtcttgcatgtgacactcttgccctctagtgcctcaccagcttggtagcagtttgatggctaatattaataagatgttacataacatgagagtactgggccaggactggtgttgctaccacttgtaaagtcaaaaagcctgagccgatggtaacgagtggtactgtttccgtttcttttccatctattgcaactttctcaagcattttcagctctgaactttaattccaggtaagtgtatttatttatttatactgtgcattaatgcctcactcataaatgtaggggcttttaagagataacaactttgctttcaaataatctaaaaatttcaagattgaacaagtgcttcattttattcttgaagaagaaatatagagtattttgattaaattaagtgaaacaaaggaccgtctcattcagggatgattttaaagcttccctttcataagattatggtactaaagaaatgacctcttgtaattgtttaagatattcaccaacttataatgattctgaagtagatctgtttaacagaacacatgtctgttgccttgacagaattttgtaaggaatatcagagactttaaactacctgcctatctacacagtaatgatcctcaaaaggctttctatttgatgcagtttatagacattatttaaaactatacaattaataaaattaaatggaaatggaaagaatcaatctaggtatcaaatacagaaactttaaatttaaagaaaacagatatatcttctatttaatatatccattttgtgggggcaggtaaaagcaaagttacatctttaaggggtttactcagatcctttttcaaatagtttttctaatagctggatactgtttaagcatcagagttatttaatgtcgaaaatgtattagtatctatattctttataaacatattgaaatatagcaacatgtaatctggaagagtttagaagaaaacccttctagacaatgcaaacagctacattcttaatacatttgtattaaattaaaatacaaatcaaatattgagatgtgtgcaactgatctgggacacacactttttttttgttttttttttttgcccttagaaaatttcatgttatcaactactgagcaatgctgttcaccaccagagagcaggatgatatggcagagaaactctagaatatccgatattcagctgaagggaatttttttccctttttcttcatccataccttcctatcaatattatatttaagatggagatttcaaatataagtttgaaggaggctcctttttaaaatagtactgaacatataaagaggcttgcctaagataagctcttttttttctttctctggttaacacagtatctaccatttctaattttgttatcatttttctttatcatcttgatggtaaaacagaagatttgtttctttgtgtaaataatgttaattttgagcttgtcacatgagttaattttcttcatagtctttaaaatgaagaattcttacattactaaaatgttttagataaaataaaacttttatctctttctggagatatttgttatagtttagtttggtggagttatatataccctctttttaaattaattttcttgagaaaagcattatttctgaacattgaggcaaatattaatttttggtgtaactgaaaagtttgttaaaaaatatatagtagaagagataatcaggcattggagattctttttctaaaccatatattctgctaaagaagttattataagctaaaatgtaaatatgtaattgtctacctgtcatttcaaaattttaaaactgtaaagaaattacaattttttttcttttaatcttgggactctgattatatgacttccttgaaacctgattgagtttcagctgctttttggtgattagagccttaaaagtgcatttgttaagatgcaaaatatatttttttaaactatatgtaaatactttgtgatttatatacactataaaatcagggaaattgaattaaggataaaaacactattctcaactaaatgaatgccttgaatttctaattgcttaacagttctgacagtaagggaaaacagtagaagtttactttccctgtgctgtgtctattataaatgagcattcacactgaaatgcatgaactctgaacacctgtccagattaggaatgctgccaggccacaaaagtaacgacctacattataaagataattagtctgaacaatcctcaaaactatttcatgactgaagtttctcgtaaaggggtgattttaatatttcttggtttgtctgtttgtttatagtaaaaaactatactcttagatacctggatatcacagtgagtgatttattctttcatgttactctaaacattttcatcgatttcatgtaagttacaggacaagaaaaaaaaagtagtcaggacctactacaattaattaatgtctataagaaattatttccccaaatcttctacaaattactgagggctataattcttgattacctgttgccaaataagagcttaaaaatcaattattgcagtcctatcctaaaacctttaagcatctcaattatgggtatccattttacatgtgtttcattgctgaattttttttttcattaaaatatttgaaaataacatgaaagtagacctaaattctaggactggctctgccaagacaggagtggccttgaacagctcccttgctggctctggggcttggtttcttcacctgaaaaatgaggattccagagacccttttttatcctgtttgttcaacattttagaaattgatctggaggccaggacgaagatagatgagaaaacatcagtgaataatacaaaatttaacttggtgataagtactattgtctagatttctgctaagtagagatgttacagtttttactcatagaatagttaccttgtaccaggcactgttctactttacatattaatttttagctcatataatcttcacaaagattatttaaggtaaatattattcctgtttcacaaatgaggaaattgaggcactgagcggttacctacctgcctaagatcacatccctggcaagtgctgaagctggtatgcagtttgagtccggctccagcacacattcctttaaccgttatactacattgtctctctataggtttcaaatatttgttcttgatatgcctcttgatggaacagaggtaatccatataccactccaacaatttccatcacttcccttacatatgaaatactcattcattcacccaggaggtatttactaagcatctacttttgcaccaggcataaaggagtccacaggacaattaaatgtggtgccttccctagctaagtatatacagtctagttcaggtgatttctttctcctcttttgctactgctgttaggttgagtctcacttgttctaaaatgtgcccaaggtaacagaagaataatttacctgacgcctttattgatgtgtccatagaatagagagtaatagaaccttcaacctcctcaagactccctatatcatattttttcattattcgtttctactctttttgcatcatcttctctctgcagattggctgtctttccttatctggttcatgtaacctgccctaaaacatagccaacactgatctgtaactttacatctaatggtccaggcaaccaatgagaggccaggttaacactctcttgttcccatgagtctaatgaaggacaaagaaaaggtttggattagaccctaaaagctgcattgtcagcactcacatatgtcatatgtgagcatgtgtgacagaatatgtcagcgtattttgatgcatgcattctggtccaatcttagagggtaaaggcagacattttcccccttaagtcatatagggcagaataaacagcaaacagcagtggggtagttttcttctcttgcatcactggatggcataacactgagggaggtgaataaaacatattcttctcttcataatttctaatacaaagatggagggagaatgataatagaaagtcattttccatttaatgtaccaaacaaagctaatgccctcaagtgcagcttttctcccatccatcttttaaaaattgcagttctagagacagagtgtattcttggtcatactccatgtaaatcagcttcttacttgcctaccacagcagggtttaattaacatgacacaatttcacacattctttcccaaagaaaagcttgcccttgtcaatttttattattattactaaattacttttagcaagtccatgtaacatatttgaggcctcccactgcatttttcaacattataaaatatagttttatagttcattcctttttcagaaaaaggaatattgtcaggatcttttaaatatctttcatttatgttagaacctgaagctctttagttattaatactcattttccagatggtaatcttttttcacttttcttgtactgccaactttaacatgattctatttcatttagaaattgatttttactttgggatgatggtgggtgttagtggaagagaaaagataggttacattgacaagcaggcacttccccttgcagatattgcaatactttgcagaatatatgtttgtatatattgagttctttcactatgttatggaattgtctgtgattccaaaaactaattgcttcttctgccttttgttaatggtaaataattaatggttaatatttgcttggtggagtctttttaaaaacagatgcattgcaaagcaactctattcatgctgaattctgaaaaatctcagaatggaaaaaataagtaattgagtaaatttcagtgaaaagcacattctggatatgcctgatttatggctctgatcaaggtggtcactgctattcacaatgtttatattattgccttgactgtttgaggccagtgtgactgatgaaggtagctgttcatagaagatggtttgacttaaatactgccctagtttgtgagtgccagctgctatttgtaaaatttagtagaggccttttttcactcattcaacaaatattcaatgggctattctcacttcaagtactctattagacattaaaaatatagaagtgaacaggacaagtacttacagatgcttccaagctatggagaaaaattgcataactaattataacagaaaatcacataactaattataactttggaacatactacagaggtaaagtagagagtgatgtgagaatgtgtaacagggaggcctgacagataagggggatcagggaagacttttgtgaggcagggatatatatacttagaaccataggatttggaagatgaaaccagatggggaagtggagaaaaaactttcagacaaaggtagcagcatgtggaaagaccctgagacagaaaagagattatctcttttgggaactgaaagaggacccacttgcctggaacttagaagggagagcatcatctaaccaggcctgagagataaaagtgggaagcataccacacagggtcttgtgggacatgtacaagaatatgaattttaaccagcaagtaaaataagcaatcattgacaggatctcagctggaaagaagtaacagagttccactttgatgctgcattgagaaaatggtagaaggagccaagaacatttgtggtgagattagttgctgcaagtaaaagaaggtgttaaggatgcacgtaggtgattgtgggaccatgaggatggttttagcggaaagatcataaattcagttttagacaggttaagtttgcttgtgacatgattctagtggagccaaatagtggctggaatataataagaaagggcacagtctatgtgagttgttgttgctattatatcaagttgatagttcaatataaaatcctagagcttagaggaaggaggtctgagttatgaatgaacattcagaatttactagagtgtagatgataatgaaaaccaagaagtatatgagctcatctaaggaaagggggaggggtgaaaagaagcccaaggacatggtgctggttatgcctctgattgagcctctttctttctttcttctaagatccatccgactttagatctctgcactaagggtgggcttatgtgcttcccacaactctacttaagctaaaatgctcatagctatccctttatgaacccttagtgtactttcattggtcatcttcaggatatttccctcatttcctgtgttatttctattatcatcatcatagcagataaattttgtttgttcattgtatgtgccaaacactattataagagtttggtttttgttgttgcttttgagacaggattttactctgtcgcccaggctggagggcagtggtgtgatcatggctcactgcagcctccacctcccaggctcaagcgatccaaccacttcagcctcccaagtagctgggaccacctgccaccatgtccaactaatttatatatatatttatatatttttatatatatatatatttatatatatatatatttatatatatataaaattttgtatattttttgtagagatggggtttcgctgtgttgcccaggctggtctccacccctgagctcaagtgatctgcccacctcagcctcccctcgtgctgggattataggggtgagcccctgcacccggcctctaagagctttaaccctcattaaaatccccttaggagatatcatagtagcccattttcttagaaggaaactgcagcatctaaagataatagctgcccaatatgcatttcctacttgttcctagcatggaaggatcgtgttgcagttatcttcccaggtgtatggtatctttgatgcaggctgttggagttcatatttcagttctacctctactagctgtgacatcatgggcaggttacttcacctctaaagggtccaacacaatttcagtacctatgtaaatgtttattaatattagctgcattactattgttattctatatcttcccatatcatattatttccttcagggtgccttataggaaatcttgatgatgtgttgacatttataactgatccaactttgtaactttctcgaacctaactatttcagaatgcctgtctaagtgatctgttgattttcaaaatttaaaatacagtttcctgatcagtcagcatagtcctcatcataggttgaattcggagcagaattcaaccacaactgtcagttctgtactgctgatcaagacagttgtgtctgtgggaactctctgacatgcaggctagtgtgcttgttctgtacttattcagagtaccctactgaccatgcaaaagtcttcaattttctatgtatttttgtgcaagcatttcacgaacatattcatcactatactgaaatgtttacatgttgatcttgttggcctttaaaagtgttttcatctcatttctttttgaaaaatttgaaaaattactgggaaaaaacatgagccctatgcccttggaaatttcagtctaacaaggaagacagacattagacaaataatattgttaataatatttcataagagttatgataaagtctccaaagggagcctcatctaaaggggaagaatacagttggtcagcaaaggcttccctgaggaattgggtttttgtagcacattcagacgtgcctgtaacctgtcaattccaaagattttcttgacattttgtatttgtctacatccaactatgttatataacattgtgattttgttatctaatcatgtataacttagtccatctatctatctgaatctgaagtgtgcatcactgagtcaagccaatttcccctcttagttttatgtttctattatactggcatctttatcttctagtccccaagactgctacctcccccaaccataatttaacagtaagcatgttttttttcttctttcttcccaaatatctctcatttccattctctctcaaaaccaccttagtctggacctataccacctcacacatggattacagcagcagccccttagctgggactgtcttgactctgcctacttcttcactctgcacagtgtggcatgttctctctctgttcatattactgctgttcatcattctgggtgtcactactacactaatcatctgtaaacactgtctttatcaaatccctctgttcaaatgcacccaatgctctttattttcaagctcatactcttgtacttcacaatcactttcaaggacattcattaatctgcaccactcttttaatcaaatattatttccattttcaaccccaaacatagtatcctatattttagttaatttcactctgagctaagcacattgtaaccatttcatttcttcaaccttgccagggagttttgcctgacatgttgtccccatcctcatatccaaacccagtgcatcatggcatgtcactttcaagcaccatgtctcttagaaactgccactgactttactaagcttcactaatctctctctctttctctctgtctctctctctctcttctgaaacctgtaacagatagtctatactgcataaatcactatttattatgtacaacatactgttggctgctgtctcacaagtctcatttcccttaatagagtccattatctaggggaaaggattattcctaatatcctaatatacttccgtggtgtccacagtatttactacagcactaattccaaagtaggtgttcagtaaatacctgatcactaattgcataatgataagtatttttggtgggtgaaggttttatctaccatagatattatgatattaaatttatcccatgttgggatgctatgattacattaacttaacattgaatgaaatagttatttgtaacttcaaaagataagttaaagcattagaatacagtaaaagtgtcaaattaacctacaggtgtaagatgccattgtattccattaattccacaaaaagtcattgctcctggcacaagtggtgcaatgataggcaaaagaaaggtactatctctaccctcttggagcttccaggcatacagaaagtctgactttaaacaaaattttaattatggcaataagtacaaaggagatgctcttttcacaaagaccatgtatacccactggtcttaccaagtttgaaaagtcagagaaggcaccacagggcaattgtggcgaggagcttaattttccatattcatccatctgcatgatgcctcacaagtgaagggctcaggtgaagtctgtaactttgcctttgcctactgctacggtgccaccttccacaggaggagtgacagcaacaggtcagtccatcctgaagttttcagagctaacagaaacatggaagagaatgggaagtagctgtccttggatgagtttgtagtatgaatagaaagctctgagaatctgcaccagagactgaagttggcatggcaaagtgagatgtgcaattgaaaaaggtttgcagaaaacaggagaattttaatgtatgcatttaaatatgttagaccaattcctcagggacgtgcactggaattttttctttagcttcagaaggaaacttgaagagcttaatagaaaagaaatgtccttcagcattttataatggcttacagagaaaataactttgatagattcctaatatctgtcctaaacagtgagagcaaatactcttcaccactctgcctcatcacagataagaattgtataagttacatgcctttcacttttgacaaaggggacaaattgtaaaatgctgctatctaaaatggaaaatgtagcaatacattttatgtctagtcaaaaacacctcacaggtaaaattgaaacgtagaaatgggaggatatgagattttgtattctgctgttatgctccagaatattatagtcataagaacgtacataactgtaaaagcgcaattacttatcaaaatgaaataactataattacaatgaaaactctgttgtccaggtaaatttttatttgcttaaatatcatctgtatctataccagagcatttaaaagagacctcacatggcatgccaagttcttgtccccctttctctgcagtgtttgtaagatttgtcccttccctacaattctccctcacctatgatgattaacagtttacgactacattgtgagaaatgagactgcactggcgtgccagatcaactctgtaagattgctctatgatattctccatgttattaattcttgtcccagaaaaatctgttatgttatccccctaatcaagaaagttgtgtgtctctaacagaatatcacagactggataatttataaacattaacaatttatatggctcacagttctggagatttggaagtctaagagcatggtgctggcatctggtgagggccttcttactgtgtcatctcatggtggaaggttgaagggcaagacagcatgcacaaaggggcaagagagcaagagccagccaaacttgcttttatgacactcttgagataagtaacctgctcccaagataatgacatttatctattcatgagggcagacccctcatgacctactcacttcttcttaggccccacctcccaacactgttgcattgggaattaaatttccagcacacaaactttggcggacacatacaaaccataagatctccctacaatctttcacaacctctgtactctcaagtcttagcataatctgggttacccatacatagtcaaatttattttttaagtatttctcactctttcctcccactcattattcatcatccttacccaatattgtgctcattcctgcctctgtaacattccctctatctcaaatgtctcttcaaattactcccatccttcaaggctctacccaaatcctactccacagtacagcctcaccaccccctggagcattccacagactcccccacttgccatggtctctttcttctctcatcctgttatagtcattgtctctaatccacaaccctcacattattatcattcttgtcactatctctgctttataatttagaacattttaaataaattcagtctgctgaacatttatattttaaatagcatgagagctaccccataaatgtttgaatgcatgacatatataccctaaatattttaatgaatgaactacaatatataatttaaaagataaataacacatttatcctgtaaatagaatataccataaatatcctacaattctattctagaatgttatattattcataaagataaacatattgttcaaaatattgttcattgtttatgtcatagaattttggaagcagaatgttattcgtgaacttcatcattttacttggtacagaggcccaaatgacacaataagtaagaagcagatgtgcgatagactctaatcttatgacaaacactaaatacagtatttttcacctgtgcttgttgttgtaccagctagcttttagcctgccttatgtagaatcacaggacctgtcttaatttttttatgttccattataatttcttgcaaagttccaggaccataaaactctaataaggttttgctctaagaagcacccaggaattccagagggggaaggcaagatggccaactagatgcagcaaagaagtgctactcccacggagaaaaaccaagggtttgagtaaatcaacataatttggacagatctctagaaagaaaatgcttaaagtagatggagatgcaatgcagatgctgaggctgagaagggagaaggcaggcacagggtactggaggcagggctagtccctggccctcaacagctccgggggaataggttcatgatgggactgtgggactgcccaccctcaccatgtgcctatgggatcctggcttagagggccccgcatcccccatggacacttgatctgacaaggggatctgattggagagtagataaagacagagcttcatccagaatggaacaggagcctttgtacatggtgcagctctggcagaacatggtaataggtgtccataacccaggtctctccatctccctccaaaaagctctagccacagctgaccactaggccagaagaaagtagagctgacttccctgtggaactggatcatgtctgttctgcaggccttccagcctgccagcccctctcagggccacaccctagcagccctgcaggaacatatgcacagtacagcctctgctgcccagcctgggtgccttgctccacctgattatgttcctcgtggcttgggagcactttggattcctcagagcacccagaatccaactccaagtacctgaaggatggagccccaattccatccaagtgcccgagggctgcagcagccacctcaggaatgccaagccaagttctgtggctggcactcaagtgggagaggagctcacactctcaaagcactgagaggggtgagatgcctattcatgggctggagtgggagggggcatgcctccctccacaggatttgccaggaaaggttgtctcccatctacctgctgcaacttcggaccagggagccctgcagcacagacacctaacaaaagaaatgcagacgcactgtcagtgatcagagggactcccccaaggtccaagagtggacatggtgaggaggtcacctctctccctgcccactgcagagcacagctgcaaatgtgagaaatacagaggagccatgcagctagataagaggctatctactgcccattactcttcagcatcatctactggatcccagcccaaactaccacgccaaaaatattttgctactatacacccctgtgaaaccaagggcaagaattcagccacaaataaaggccctatagagaggcttgggcatgtgaaaacatccagaaacaaatccaactgaagtactcaaattacgtcattgttaaagaaacactggacttcttagatgcgaaagaatcatggtaagacctctggcaatttaaaaagtcagagtgtctcctcatctccagatgaatccactagctccccagcagtggttctcaaccagtctgaaatgactgaaatgacagacatattatttagaatctggatggcaagaaaggttgagattcagaagaaaattgaaacccaattcaaggaatttatttatactatccaagagatgaaatatgaaatatccattttaaaaacgaactaaactgaactactagagctgaaaaattcagtataagaatttcataatacaattagaagtattaacagcagaatagaccaaactgggaaaagaacttcagagcttgaagactggctcttcgggccaactcaactcagacaaaactaaagaaaaataattgttagaaatgaacaaaacctctgagaaatatgggttatgtaaagacaccaaatttatgattcattggcattcttgagacagaataagcaactgggaaaatatatttgagtatatttccctaatcacactagagaggttgagttgcaaattcaagaaatacagagaacctaggctgcatactatatgagataaccatccttaaggcacacagtcatcagattcaccaaggtcaatgcaaaagaaaaaatcttaaaggcagctagagagaagaagggtcaagtcatgtacagagggaatcccattaagctagcagcacacctttcagcagaaacattacaaccagaagagattgagagcctatttttagcatttttaaaaacaaaatttccaaccaagaacttcatatggcaccaaactaagcttcttgggagaaacagatataaaatccttctcagataagcaaatgctgaatgaattcatttcaactagactggccttagaagaggttcttagggagtgctgaacatggaattgaaaagcaacacctgctaccccaaaaacacacttaagcacacagcctgcaggcactataatccacctagacaatcaagtcttcataacaaccagctaacaacatgatgacaggaccaaaatctcacagatccatactaatcctgaatgtaaatgagctaaatgccccacttaaaagacacagagtggcaagctagataaaaagacaagacccaaccatttgctgtcttcatgagaccaatttcacatgtaatggtacccacaggcgcaaagtaaaaggatggagaaagatctaccatacaaatggaaaatatacaaagatcaggagtggctattcttatattagataaaacaaacttcaaaccaataaaaatttaagaagacaaagaagggcaatacataacaataaagagtacaatccgacaacaagacttaactatcctaaatatatatacacccaacattggagcacctagattcatgaaacaaattcttcttcacccacaacaaaacttagacaactatacaataataatgggagatgtcaacaccccactcacaatgttagacagatactcaaggcagaaaactaataaactccggacttaaacttgacacctgaccaactagatctaatagatatctacagaactagtccacccaacaaccacaaaatacacatatttttcatctgcacataaaacatattctaagactgaccacatgtttgttcacgaaggaagtctcaataaattttaacaaactgaaatcataccaagaacattcaccaacctcagtgcaatttaaaaaatcaatatcaagaaggtctctcaaaactacacaattatatggaaattaaataacttgctcctgaataactccttggtgaacatcaaagttaaggcagaaaccaaaaaattctttgaaattaatgaaggcagggacacaacttaccaaaatctctgggatgcagctaagttagtgtaaagaagaaagattatagcattaaatgccttcatcaagaagttagaaagatctcaaattaacaatctacctttgtacctaagggaactaaaataaaggaacaaacatacccccacagctggcagaaaaaaataaataactaatattaaagaagaattaaatgaaattgagatgccaaaatccatataaaagaccaatgaaaccaagagttgtttcttagaaaaaaataaacacgaccgatagaccactagctagaataacaaagaaaaataaagagaatatccaaaaaagaacaatcaaaaatgacaaagataacattacaactaatcccacagaaatagaaatatccttaaaaatactatgaatatctctactcacatgaattagaaaatctagaggaaatggataaattcctggaaatgcaatctcccaaaactgaatcattaagagtttgaaactctgaaaagaccaatatcaagctctgaaactgaatcagtaataataataaaaaaaaaaaaccctacccaccaaaaaaagcactggagcagatggattcacagccgaattgtaccagacatactaaaatgaactggtaccaatcctactgaaattattccaaaaaattgaggagaaggggcttcttcctcacacattctgtgaagcaagcatcagcctgataccaaaatctggcagagacacaatgaagaaaaaaaacttaggccaatatctccgatgaacatagatgcagaaattctcaaccaaatactaggaaaacaaatccagcagcacatcaaaaatttaatatgccacaatcaagtcagctttatttctaggacgcaaggctatttcaacatatgcaaatcaataaatgtcatttaccacataaacagaattaaaagcaaagccatatgatcatctcaatagatgcagaaaagctttcaataaaattcaacataccttcatgataaaaacccttaacagtctaggcattaaaggaacatatcttaaaataataagagacatctatgacaaactcacagccaatgtcatactgaacaggcaaaagctggaaccactactcttgagaactggaatgagataaggatgcccaccctcaccactcctatagcactggaagtcctagccagagcaatcagacaagagaaagaaataaagcatccaaatagaaaaagaagtcaaactatctctctttgctgatgatatgattctatacctagaaaatgctaaagattctgccaaaaggtccctagaactgataaatgacttcaggaaagtttcaggatacaaaatcaatatacaaaaatcagtagtgttcctatacatatatcaataatgttaaagctgagagtccaatgaagaatacaatcccatgtacaatagccacaaataaaatgaaatatctaacaatacagctagccaaggaggtaaaagatctgtacaaggagaactaaaaaacactgatgaaataaatcaaagacaatacaaataaatgaaaatacttttcatgctcatggattagaagaatcagtatcattaaaatggccatactgcttaaagcaatttacagattcaacactactatcatattacaaatgctatttttaaataaatataaaaaaactgttctaaaattcacatgaaccaaaaaagagcccgaatagccaaagcaattctaagcaaaaagaacaaagccagaagcatcagactacctgacttcaaactatactacaaagctacagtaacccaaacagcatggtactggtacaaaagcagacacatagaccaatggaacacaatagaaaactcagaaataaagccacacacctacaatcatctgatctttggcaaggccaacaaaagcaagcaataggtaaagcactccctattcagtaaatggtgctgggataaatggctagccatatgcagaagaatgaaactggacccttaccttttaccatatacaaaaattaactcaaggtaatttgcctaggctgtaatcctaagcaaattaagtaagcaagttaattcaaatgcaggacatcaaactataaaaattttagaagtaaatctaagaaatactgtttatgatatcagccttggcaaagaatttttggctaagtccccaaaagcaattgcaatgaaaacaaaagttgactagtgggacctaattaaactaaagagcttctgaacagcagaagaaactatcagcagagtaaacagacaacctacagaatgggagaaaatattcacaaagtgtgcatccaacaaaggtctaatatccagagtctacaagaaacttaaatcaataagaaagaaacaaccaaccccctttaaaaacaggcaaaggacatgagcagatgtttcttcaaagaagcaatcaggcaagagaaagaaataaggcatctaaatagaaaaagaagtcaaattatctctctttgctgatgatatgattctatacctagaaaatgctaaatatcctgccaaaatagtctctttattaaaagaagacatacaagtagccaacaaacatgaaaaaatgttcatcatcactaatcatcagagaaatgcaaatcaacaccacagtgagatatcatctacaccagtcagaatggcaattagtaagaagttaaaagataacagatgctggtgaggctgcatagaaaagggaatgcttatacactgttggtgggaatgtaaacaaattcagccgctatggaaagaagtttggagatttctgaaagaacttaaaacagagctatcacttgaccacagattccattactgggtatatacccaaaggaaaataaatcattctactaaaaagatgcatacacttgtatgtttatcccagcactattcaaaatagtaagataaacaatcaaactagatgccaatcaagagtgaattggataaagaaaatgtggtacaaatacaccatggaatactatgtggccataaaaaagaatgaagtcatgtcttttgtagtaacatggatgtaactggaggacataatcctaaacaaattaactcaggaacagacaacaaaataccacatgttctcacttacaagtgggagctaaaccctgagcacacatggacatatacacaagaacaatagacactgtggactattagagggaggaagaaggaaggaggacatacacggtggaaaaactacctattgggtactgtgcttactgcctgggtgacgggatccataccgtaaatgtcagcatcccacagtatccccaggtagtaaacctgcatgtgtaccctctaaaataacggttgaatttttttaaaaggaaaagaattccttaggtgcccaggtaaatccaagcatggctgtacattattttggatttgactagccaggaaatatgtgtttgtttcccattagttcaactatctgagaaaaaatattgttcagttgacagagatatatacacagtttgcttaaccttcatgcactcaaaatactcttaacagtaaatctgtatcagtgtgctgtgataccagaggaagtgtaatcctaataaatgtagaacacccaaataaaaaaagaagcactcatgtttctttcttattatttttcaaagttactaaattttcaaaggttactaagacttgaaagggatttcaaattattgcacaacaaagtgtttcatgaagtctcagttgttttcattacatttttaaaaacatttttggagtagtttttcacataattactaaactcctcaaaaagcggaaatagaatggtatagaaagtgaatcaataggtaaatttgctcttctccaagagtatatggttcccaatggtctcacaccagatttgcagaaaccctgggaagtattttattcctcatattcatcttaccacatgactgttttgatttttggaaaatgcaactatgaaaatatgcagttctaaaataatgaattgcattgtgggaccatatatgcattttgaaagggttattttaatgagagcaattatcataaggttgtttctctaatgaatgtaaaatgtgtatacaatgataaaattgactgtgccatcgactttgcagaaaagaaaaacacatgttttaattatggcataaacattcagtacctgtgattaaaaacaaacagcttgagtatgtattacataatgtatagccagatggcaagaaatggcagtgtatgacttaggtgacctctccgtggtctttgttgtatagtatctacagagtttgatgcaaagcacagtgaatatcatgaaattttctgttagcccaaagtcttttttttactaggaatagagggctcaatggaccccttttcctctttctaccagtcccatgtcctcacacagatctgggagaagaaaagggagggcttcgaatttactatacaccagttcatctgccaagtactctgccacttatgctagtcaacaagataaaaacttgcttattttaatgctgcaaactgactgttttatattcttttctatttttcagactgtattttctgtgagtcctgatcaagtgatacaaatgagctgcaatggtgacataaactcttgacagagattggaaaagtagctggaacaccatcttttcttttaactttttatggtgcttctgttggcatagttggggaaagcacctacaacatgagttttatcatgaagcttcacagacactttcaaagaacagtcattctgcttgccactttttgtatggtgagcattatcatttctgcttactacctgtacagtggctacaaacaggaaaatgaactctctgagacggcttcagaagttgactgtggcgacctccaacacctaccatatcaactaatggaagtgaaagcaatgaagctttttgatgcctcaaggacagaccccacagtcctagtatttgtagagagccagtactcatctcttggtcaagacatcattatgattctagaatcaagtagattccagtatcacattgaaattgcccctggaaagggagatctcccagtgcttatagacaaaatgaaaggcaaatacattctcattatttatgagaatattttaaagtatataaatatggattcctggaatcgaagccttctagataaatactgtgtagaatatggtgtgggtgtcattggattccacaaaactagtgagaagagtgtacagagctttcagttaaaaggtttccctttttccatatatggaaatcttgcagtaaaagattgttgtattaatcctcattctccattgattcgtgtgaccaaatcttccaagcttgaaaaaggttctttacctggaactgactggacagtttttcagattaatcattcagcctatcaaccagtaatatttgccaaagtaaagaccccagaaaacctttctccttccatctctaaaggtgctttttatgccactattatacatgacctggggcttcatgatggaattcaaagggttctttttggcaacaacttgaacttttggctgcacaagctcatcttcatagatgccatctccttcttatcagggaagaggctgacattgtccttggacaggtacattcttgtggatattgatgatatatttgtgggaaaagagggaacaagaatgaacaccaatgatgtaaaggtaaggctctattttctcaagtttcaaagttcagttcatcttccagcagggatacaactatcccagtttgtactacaactgggttacccaggacatgggatttactgggaaagtctgggcaatctaggattatcgctcaccctaaatcaactaagaagattatgtatttctatctgaatcaagaaaaataaagattttactaaaagattgagtgtggcaggatcctgaaatggttttctacatgtatttacaactagagtagaagtcatttcgtttaattactttccagaaactatctacctcaaaaaaaagctattactaatctcagacttagctcatttaaatatgaaattaaagtgaatttgtcttaatgataataaatatttccacaaatttcaagaattacagatctcattgtagcaagttcagatacttttggaagtcaaatatgcagtgcattttctcttatcatatttttctgaaactgaaaatcagtactactaaatatgaagatcaatgactgtataagcatatttattcacatttaaacatgaggatttaacttgatttcagcgaacacttctgacacatatatgaagccaatcatgccaaatttaaattgtattacatttcttattgtgtaaaactgctgcccttaaacagaaaacaattatttgaaatagtttgtcattattatgagttgattgtgttacataaacagctgattgtttactattaaaaaattttaaaattaaagttatctacatttgtcttagtttccaattcgaaatgtcataggattctatctctgttatactatgtattgatttctcataaaagtgagacttttgatacatagtttttattctacagttttgaccttttggtagaatatctagaatcaaatcagagagcaaaaaatacatcttgaaaactttgttcttttctctagtcactaagcatctggcaaataatagtaatgttcatcacactagttaagtgggctaagaataccagaaggaccattaaatgttactgtaagagagtgtgaagactgaaaagaaaaaaaacttccatattcttggcactattttagtctcttccttttagctaaacagaaattaataaagaagctgtatttaagtttccattaagtctttgtacttacttttgaaaatatagctaaattaaaaccaagctggtagtttaagcatttattaggtgtttgaagattacaagcaatatataattcttccattttttttccatttcaaatgattttggtgagaaatgttttcaatatgaatatatttctgaagtgaaattgtttgaaactgtcaaatatatattgttatagaattttaaaatatggtaaataaatccctgagttttgtatgtagccccctgtttcccctaatattatacaaaatacaaaatgccatttgtgctccagaagttaagccagttttcaggggtatgaaaaattagaggcttattgaacacattaaagaaaaatttggcatgtctactttatgaactgctcatatttagatagaaatatattttctaaactaactaaatgcttttttaaaaaatgtgttttgaataatctgggttttttaattacttctaaattgcatctgtgattgtgtctcaaaacactaatttactacagtcaattgccctgagagtataaacagtcattcatgtattcattctgtaactagttattaagcgtgtactacatgtgaagcactttttggaacttacagatagaatcttgaactgtagtccattccagagaagaggggcaggggagagtagagtcataggaaagcacattgtgctgagcatctatccgttcagttcttgatatggctatatcccattccagacatagaggcaggctttagggatacaatgataaagtgggggtgataaataggtaaatagcttgcaacatggtaagcacaatagcaaacatatcgacacagtttcatataaattatgttgtgggaaacactacagtgtgtgctgtgtacctgtaacttaagtatgtacttaagtatgtacttaagcatgtaggacagagttcaaaggcaagactagattgatgtgatgatttggaaagatgtagcagtaattcagacaaagacagcaatttcttgaaaccaggaaattggagtaagaatggagaaggaaggaccaaattaagatctatttaggaagtaaaattgaacaacttagtaattggctgaatggagatgaaagagaatataatcatgacattagaatttgtcatgaaagagaatataaggatgactttaggatttttggcataggttgataattgttgatgatgtgaacaacagtaagtaagaggatcatagtgaagatcattaaaggtcataataaaaatttcagttttattaaagtccatgtgggatgcagagcatttcacaggtagttgcctcacaggaaaagtctgggtaggaaatacagatttcaaattcatcatcctatagggaatcattcaccacatgaaagtgtgtgagctcagccagggaaaaaatttagagtgataagagaagatgatcaaatgtagaatattgaggaaaatcatcatttagaagacaagtagagggaaatatcccttgaataagagtttgaaagaacagtcagagaccaggaagctgagatgctatagcttcagaaaaagtgtgatcagcagtataaaacccaacagcagggcccactgggctaaggactggagagtctcctttgggaaaagacaaagatcactggggactcttgcataatctatgtgaatggaatgatagagaccgaagcccatttgcagtaagttggagtcaggagttgactaagggggtcaagatgtgaagaaagagagtgtagagcactcagtggagacatttttgtataaaggaaaaaagagaaattatacagtagctagagggtagactggttctaggaagaccaaccgtcctggtttgtccaggactgagagtatttgttgctaaaacgtagagtccaagagttagatagggtgacctaactaaatcagataaggaagaataatcaaaaatcatgaggtctaaaaaaatcataaattttgtgattaagagtatataattagtataaatgtttaaatcaattattttatttaattattaccacttatgagcaaatattatattttccctatttgaagtattgggaaaatttaaaagaatgtgagaaaatcaaaagttacataaactgttatgtacaaaattggaaggagagtgcaagacataaattttaactagcaaactaatcactgcatggatgttattttttttcttatgtggaatagaaaatgtgcttccttatttaatgggaagatttgaatagcaatgcaatatcagctttacccacctagatgttgaataatatgagtatattttaaagatcctcaaagccacagaagaaactgtgacatggcacaaagtgtttcattctttgtgccacaaaaagacaaaaaaaaaaaaaaaacagacctaagttgaggtctttgtttgtctaggaatatgcaagctacaagccatagcctgtaaagaaccaaagaagaaaattgtttagataattcaaatattcctttaaaaaggcaggacaaatttcagtgaaattgaagtcaggaaaagtgtgtgtgtgtgtgtgtgtgtgtgtgtgtgtgtgtgtgtgcgcgcgcgcgcacgcatgcatgcaaacgtgttccattggactattggatgagttttagtgacgttcaaaatttcaagttccttgtgatctacaacctaccctcaaacttcccgactaagggttttgggagagagaaagtgatgtttctacaattaaaaaaagcttctaccattaaagcatttgttttacatgaaagcacttcatgacccagtgaacactaataacccatgtgatcttttaggcgcattaactcactcttgttgtaagatccattatacctttagacctaccatttcatataacatttatctcccaagacatctgagaagtcaaatgagaagattctggagaaggtggtctttcagggttttactgaactccttgcagttgaatactctcaatgcataaaagaggttacatatcactccctcctgcatctctcccttcctctctctctttgatttctgtaataggtacacattcctttcaaactttgagaaaattcctaacattcttcggaaaatgaagaacccgcccagtcacatctgagcttactgaagaggtaactgtggctcctcctggagcatcttgtacttctttctggaggtactcaacagccactttccttttttaactaccccagacctttctcactattttcttacatttcaatataccataacttgtctatttgtggattagcccttaaaaaatctacatttttaaagtggccccagaagaaagggaagttcttaaatttttaatacaatgtcatgagtggctatatcattattttcctctctaatggaagatcccagagtacctagagaaaagaaagtgctgaaaatagaagtgggaagctagaaaactgtgaaaaataagaggtatcaagctcagaagataaactcagctgacttttcagtcttgcttggggctgactgtgggaagctctaattggaatgtaaaggtgcgctctgtgctgcttgacttcaccacgaatattcaccaccccagctaagggaagccagaggcttcataaaatcactaaaaaataacaacataccaaatattgggaggaggaggaaaacacaactgcaatcaattattctgtcataagtacacataaaagggtagcaaaaatttctccagacagttcactattcatgtgctctgtatgaatgtcaagatctgtacattgtacatagtattaatgttttgtcatttttctcctaaactcatatttcttgagttcctttccattatatctgatgtttcttatctcttatttactgatattcatttaattttattatgctatagaagcatgtatctgcttgatcccattacttcaaatttgctagatttactttataactggatacagtatgcctcatgtacttgataggaacatatattatctaatcaaggtataccaacacaaccttgttaactacatttttcaaatctgtcttcttactgtattcttttttggggggtgagggaatggaatggtatccctgatgctaccaaaagagttatgtttaattttccaactctgatggttgattgtaaatatttccttgttctgaaaattattgccttctatattttgaagctatgttaagtgcacatattttgaaattgtattttaatatgttttttcattctatgttatctttttaactttattaatgttgttttgcctttgttttgcttaatgctaatacagctataccagctttcttttgattactatttgagaaatatatcttactccttttttatatatttttaatctctctcctgtctttgcactgtaaattagctttgaaaacagctcctaggtgaactttgcttttggtctactctgtcaatatttgtcttttaattaacaagatcaatctacatatagttaattggattatcaatgtatatggatttatttcagctactttattttgtgctttatatttgccccacttgttatatttcttctcttctttctctctcttcctttttaccttcatttgaattgtcagtttctttcttttttctatccattcctggtttaaatgaatgtattttatctctttttttttagtagtttctccaaaaatttaaacacatgcactaaacaagtgccaatatcttcatacctcagtcaaaaggtacaaagttctttatctccaataatgctctctctcctttggcggttgggttattctggttctagatgttaatgttgctgtttaacaccggatattaggcactgttgtttttactaccatcaaagttttattagatttgccagatttctactgtttcctttgccaactgttcaccttttctcatccgatgtgattctcagcttctacaccttacccctttctgtaaagagcagacagtcatgccattgacacgtaattttgatcatgacccccctctgctcaaaaccctccagcaacttccagtgtctttatctctgctacacgcccagctccttttccctcacgctactgcagcctctctagtatctttgctgttccttgctcctgtttcagaattttgcacttgctgttctttctccctaaagtgtccttcccccagattggtgcatggctctcttctttgcttcctttagatctttactcaaatgttactttctcagtgaagtcttctctgaccattctctttaaagttgcaacctctaaatctcccatctttccctgagagtgttttgttctggcacttatgatcaccaatgatgtgctaaaactggctcacattggcttacaaggtcaattttgtgcatctccttctagctttatggaaggaatatttacactgtaaaatagacaaatgtgacaaatctgggctttttattcacacagacccagttgttaaaggcttcacagcatgctaccagacataccatgtattttactaatttattaggttggtgcaaaaataattgtggtttttgccactactttgttatttggactattaaaatgtaagctttattagggcaagatttttttcatctattttgttcacggatgtatctccagcacagagaaatgtgcctggctcagtatatatttgttggatgaatgaattgcattctttctgaagtatatcctttagacatgataaaagaaaaacatcagctgaattaaatttaaaggagtttaattgagcaatgaacaattcatgaatcaggcagcctcccgagccagagtaggttcagagactccagcgcagccacatggtggaagaagatttatgaacagaaaaaggaaagtgacatacagaaaacagaagtgaggacagaaacagctggattggttacaggttagtgtttgccttatttgaatataatttgaacacaactgactggccaaaacacagtgattggcacaagtgtagactacggtctgtttacacctccacttgttatagctcacaatgtacagaaaaacctttaggctgaactgaaattatgtaaggaggtggctttagtccaaactttattttaaagacttccttcaatgagaatctattcatggtaaaccttctcagattttatgcattgtaaatgtctttattttccctcatccttaaaagatagtttggttgacttcacaatgcctaattaagttccctcatatatatccattgctgctcacactgggaagattggtcctccctggaagtcacctaaacatttttggtaatagaatgtccagttccactggtccctaatagttttatgattgtcacaatattaggcaatttgagaccattcttctctccctccctctccctcactctctctctttgtttggtggaatacttacttatttctacatttgatataacgtgatcatattaaaaatacacaggaaaataaattactgtcaatattattatcacattcaaatagccatagtgtgctagcaactatacaactgtacagttattttaaggaaataattttataatttaacatggcgaaatcataaaatagattagcaaagggaaaaaacatttcatattcataatctatttacttttaatatattgtattaaatttgttgttacattgtgaaatggaatgtttctctactattaaggagtgatttgttatgcaatgacgttctaaaagaatgagttataaattatttaaagaaagcaaaatgctgttactgaacacatgaatatgtaaacaggatacttggtgactgattacattttttaaaggtctgatacagtctgggcacagtggctcatgcctgtaatcccagcactttgggaggccgaggtggtcagatgacctgaggtcaggagttcaagaccagcttgaccaacatggagaaaccccatctctactaaaaatacaaaattagccaggagtggtggcacactcctgtagtcccagctactccggaggctgaggcaggaaaatagcttgaacccgggaggtggaggttgcagtgagccgagatctcaccattgcactccagccccggcaacaagagtgaaactccgtttaaaaaaaaaaaaaaaaaggtctgatgcaatgaatccaacccacgcatgatacaggagggctgtcataaatggtaccaaagctcaaccagacaatgatgagttctacacactgtagtagcagaagaatacaagaggcaaattcagaacagagatttaggttctagagatattaagaaaattatgcacatttactttgttaaaataatgtcataagatttcaaaggatatgctgatgaataatgaaacacatttttgataaaggaaatcaaaaaccttggagaaaattgtacgatttgccagttactggattatgtccttctcttggttaagagaatttatttcttctaacattccatgtttctagaaaataaatcagcatgtaaaaaatcttttttgtatctctatgctggtgatttaaacctgtacagactgcagtaagttactcccaaaataggtaacacttactgagtatgtacgttgttttaagtgctttgcttcatcatttaattatcgtagaaatcctataaaacaaagattataagcagcatcattttacataaagaaactgaggctgatagattatgactaacttgcccaagatcttacaactagtaagtggcattcctagaatacaaaatgcagatctacctggctccaaaatctgagcttttccacctcatgtgcttcacagttatgagcttaacacaactggtgttaggtggtgtccataaaaatttcttcctaccaagctccaccttatggtaaattacatcctatcagattctgttatagtttgatgggttgtatctaaagctttgccctagatttaccgataagtctggaacaaaaattagtattagtcacttcttgaaatgtcttgggctgaaataaattttggatgaattagagtggcatagtgacagcatagtgacaggcccttctggcgctcaatcaattaaagaaccaaaattgcccataattctgataatctcactttttctatctgtatgtactcagattttaaagtctgtgtgatgttgtaaagtgctttatgaaggcattcctaacatttttttaaagcacacaaacaaaatagaaaaagtcaaggaaattctgacatattgtcacttagtctctgggaaacatgaattagtagctaaagcacttttttattcttaacttttataggcttccatgaataatgaaactggagactgaagtacaaaatggatcttaaaatcatgatgttaatataaaataaatgatgagatctacttgacatcatttataaactgtttataaccaaagaaatatagccaacttattaaacttctagataaactgaaatttttaaaattaaaattaaaatttacctataaaatacatattagaattttaccttaaaagattatatgctttctcattttaatattaatagttataatgattatacaggattattaatagttattagttacaccaattactaaaacagctatgtatggttttctattaatgccaaagcaaattaccaccaacttagtgtcttaaaacaacccaaatctgtcattttgcatttctgaaggtcagacatccaacatgggtcttactgagctaagttcaagatgtccacagggctgtgttcctttctggaggctctaggggagaacccatcaccttgctttttccatcttctagattccgcacacattccttggctcatattcccttccttcatcattaaagccagaaatactctctgtgccttatttcatggccacatctctctcaaactggaaaaggttctctgcttttaaggatccgtatggcccacctggataatccagaataatctccccatatcaaagtccttaacttaatcacatctgcaaaatctcttttgccatgtaatgttcacattcacaggttccagggattaggacatggatttcttggcgggggaggtaaaggagatattattctgtgtaccacaagctatgctcttcaggtaatcatgctacaattcttacaacgactcaactcccgcaagaaactctgctactctactactgttttcctcactgggaaatgaaatcttgatggcatatacatgctcaaacaattactctagatctctgagtcaacagtagttaactagggaaaattaaattattgtgctgttaaacgcttcatatcccttacacacaggaggttaaacatgggggagcaagtaactcttccttcacttagatgtcttaagaaatgtacctcaccaaagattgcttggttggagcagatgtgtgactatcatcaattcattactttaggagtttctaatatcatgtttctagaagtgcatcaattatgagactagagactgttttgaaagccagttgattaggactaccacatagtcacctaagcacagtttaccattttcattgttaccatttcattatacttttatttttctattttgttctctttgatttatgtttctgcatccacctcagtttcagtgcccttattgtattggcctttccccctttggaatttctattctaactaccccaacctaaaaacaacaatggtgttttatctgttcatcccttctgtctttatctcccctgctttgatatcctggtgcctggtgcagtaatgtacctttttccccccttcatacatagatctttattttatgtaacttcttgtctctattttcttctctgactatataaactgagtagaatcagatttctgggaaagaaaaatattgcgtgtagaaattagaccaacttgttgaggcactgaacaaagatctatcctcaaaaataataataataagttcttcactattcttttggattaaaatatatattttatatataacatattatatattatatatattatataatatattttatatattatatatattatataatatattttatatattatatatattatatattatattttatatattatatatcttatatattatattttatatattatacataatatattatatatattatatattatatatattatatattatatatattatatatattatatattatatatattatatatattatgtattatatatattatatatattatgtattatatatattatatatcatatatcatatgttatatattatatatcatatatcatatgttatatattatatatcatatatcatatgttatatattatatatcatatatcatatgttatatattatatatacattatatatgttatatattatatatacattatatatgttatatattatatatacattatatatgttatatattatatatacattatatataatatgttatatattatatatacattatatataacatgttatatattatatatacattatatataacatgttatatattatatatacattatatataacatgttatatattatatatacattatatataacatgttatatattatatatacattatatataacatgttatatattatatatacattatatataacatgttatatattatatatacattatatataacatgttatatattatatatacattatatataacatgttatatattatatatacattatatataacatgttatatattatatatacattatatataacatgttatatattatatatacattatatataacatgttatatattatatatacattatatataacatgttatatattatatatatatatatagtgctagaacaacatataacagagtcatttttatctaagaatcctaagagacaaagtagttgagttcacagagaaagacaacttacttgatattcttgaataaatgaattcaagtggttttgacaataaaatgaagattagagttgctgccaatggggtaatgaatagttatatcctgccaaactcagatttctgatatgctgaaaaatacttctaggaaattttgtataacatttaacaaaaattatttgacaatattttcaggaaaaagacattataatgaaaacccattttaactctagtgtgattgctttaaaaaagtaagttaggttaatattcaaaggatctcgacataatttgctaatctgctctagaaatgcaataagtatttaaaggaagtaaagggagaaaatactttcccagtctatgtcatttcttatgtgatacagggacactgtcattgctctaactgaggggcaaatgaacaatggaaaactaaagacacatttttccttcttgctaggactgtcctgctagaagcatatctccaatagcattgtcatttgcactttgcaagaactaattagtactcagtcaccattctcaaagaagacacagctgctcattgtattcaaaaaagttatgtttacctaagtggaatctatctttaaggatgccagtggcaagaggctgttcatcaaacttcagaatagttcagagcctctgaagaggcctaggagggcctatgttcactgctccgtacttagaaattgacacaatgtcagtgtggagggtgggggtgatgggaggaagagcatcaggacaaatagctaatgcatgctgggcttaaaacctaggtgacggattgataggtgcagcaaaccaccacggcacatgtatacctatataacaaacctgcacgttctacacatgtatcctggaacttaaaataagtaaataaataaataaaaagaaaaaagaaaaaaaagaaaagaaattgacacaatttcagtgcaacatcctcaaaagcaaggaaagtctatgagagtaattaattatctttgttttcaagccatcagcagacttcagattgtttctctattgtaattgaatgtctctaaggagcaaagttattacttaattaaaactaatccttctggtcacttacatatgacatagtcaacagcttatacttgatctcttttttttttttttttttttttttgaggcagagtctcaccatgttgcccaggctgaacttgaactcccgggctcaagctcagccttccaagtagttaaaaccacaggcccatgccagcacacccaagtatacctgtacttttattgttgatgaacctaaaacacagatattactgggcaccagtgatgaatctactgttaacttgtaaatgaacagaaagcaaagtcctactgtattttttttaaagaaatggttcaagaattcgtcactagtttcttcttaatcattcttttactctgtgatgttcagatgcatttaatcacttatcaatacaagacaattttcatgagtttccaaaccacggaaaagccaagaaacatcactttaaatgtttgcttaaaaatgcagattccccaattccacactcaaagatttttgtcttggtagatcagggggaagtgaggggcccagatcacctagatgattctaatgcaggtagtagaaatgcacatttggggaaacataggtttaaatagactacatttgatattattgtaaaatatgaagacctgggtcctattattttttcctgtagaaagtatcttaaaatcatgttgtataaaaatatttaattttacatatataagcaaatatataatggaaagaggtcacaatagaattaatagttttgtgactgagtttaatctgatgctggaagagttcttacatttagttattttgaaccatgtaccaagacagtgtgataatattttggcaaatatgtgtacatgtgaaaactgcctatggagatcaatatagtgcattttacatgaagggacagaaacagaagattgaagaaagtaattccaataagtggatgacttgttagtattgcctagtaagaggacactggataattttgacaaagtaatgaaaggtacattgcttctgtgatctttcaggaacctgtgcatcagatcagtcagaagaaagattccagcagagaaggttatgatcaggaggtgtaagagttaggatagagaaatgggaattgttttcctaaaggggaaggaacagagagagagagaggttaattatacttcaggtttaattgaatgtgcttctaatgaaatagcaaataaattacaaaagagatctgaggttgaattatataggtgggatagagtaccccattaggtgatttttttaaatgttagcaagagaagtaattttgaatgaagaaattttaccttgggaagctttaaacattcgcctttgagaaactacaattagagtgagccctgtttggggtttttttgtctaaatgtccaaaatgaaaataaatttttattattttaaatatataaacaatccacgcactttgtaatgaaaataattaatatagaaaactacaaagaagaaagcaaaaagcaattctctcctcagtctctctacacgctggatttagtcaatctttaatgtttgcaaatctaataggtaaaattttttatttcattcattttttaattcttatttgtatttgtaagaaagagttaatatggtcacttatgtttattgtccatttgtattccccttttgagaattgtttcttgtcaatcgttttccattggagtgtttgtttttgaccagttattatttttcctcttatttcacactccataaatggaacagcatgttcctttgttgttatttaacctttatgtatttatattcccaggaagttttaattattacaaattaagtttaaaaagttttattaatatcatagagggggaaggctgatacaacctctttcaaaagataccaggttgtagcacctggtacagtgttcctgcagtgagcaacttactgaaatgtgtactctcagagctcatttctcccctgcaaagatggcaatgaaataagaatgcagcaaacctatgagtgtgaaagcactttacaaatcataaatctttatctctgggtttgtttcttttcctgggattagacaattagatttaatcattgctaaggtctcgaccagttctaactctgtgaaattctttaaaacattactaaggaaagcccagcaccaattgacttgagcagagtaattatatggtgaaatagggtgaacagaacactgcttctgagaattaggattcccatccttcctccacatggtatgctttacataacagccccagtgaatgcatgtgtgagaaggctggttggcctccctgacttctggtgaggcagagaattccaagactctctggtttccctgaataacattatccatctgttatataacttgtttaaaatattctgtaggtattcatatgattactccctacagtctattattttgatacagtccataagcttacttttaatttgaaacaaatttcccagcctgtggttcttatcaaatccgtcatctatgtgttcaaccctcaattctgtagacctcaaccattcttttttttttttttgtacactttaagttctagggtacatgtgcacaatgtgcaggtttgttacatatgtatacatgtgccatgatgctgtgctgcacccattaacttgtcatttacattaggtatatctcctaatgctatccctccccactccccccacctcatgacaggccccagtgtgtgatgttcccctccctgtgtccaagtgttctcattgttcaattcccacctatgactgagaacataaggtgtttggttttttgtccttgcgatagcttgctgagaatgatggtttccagcttcatccatgtccctacaaaggacatgaacttgttttttgtccttgcgatagtttgctgagaatgatggtttccagcttcatccatgtccctagaaaggacatgaacttatccttttttatggctgcatagtattccatggtgtatatgtgccacattttcttaatccagtctatcattgatggacatttgggttggttccaagtctttctattgtgaatattgccacaataaacatacgtgtgcatgtgtctttatagcagcatgatttataatcgttgacctcaaccattcttatcttgactttcatattttcttataacttttatttcagcttcaagggtacatgtgcaagtttgttatatggtatagtgcatgtcacaggggtttggtgtacagattatttcaccactcaggaaataagcataatacccaatagttagttttttgatcctcaccctcctcctaccctccaccctcaagtaggtgctgttgtctattgccttcttctttgctttcatatgtactcattgtttagctcccactaataagtgagaacatgcagtatttggctttctcttcctgcattagtttgcctaggataatggcctccagctccatccattggggtgttctacaaaggacatgacctagttctttttcatggctgcatgatattccatggcatatatttacattttcttcatccagtctactacttatgggaatctaggttgattctatgtctttactattgtgaatagtgctgccatgaacatgcacatgcatgtgtctttaaggtagaacaatttatattcctttgagtatatatccaataatacggttgcaatggtagttctattttaagttatttgagaaattgccaaactgctttccacagtggctgaactaattcacattcccactagcactgtatgtcatcttttcaacctcaccagcatcttttatttgttgactttttaagaatagccattctgactggtgtaagacggtatctcattgtggtttttatttgcatttctctaatgattagggatgttgaacattttttatatgaagatcagatggttgtaagtgtgaggctttatttctgggtgctctaacctgttccattggtttatatgtctgttttagtaccaataccatgctgtttgggttgctatagccttttagtattgtttgaagtcaggtaatgtgatacctccagctttgttctttttgcttaggattgctttggctattcaggcacttttttttgtttcatatgatttttagagttttttttctaattctgtgaagaatgtcattgatagtttgatagaaatagcactgaatctgtaaattgctttgggcaatatggcaattttaacaatattgattcttcctattcatgagcacggaatgctattcctttctttgtgttgtttttggtttctttcaacagtgttgtacaactctccttgtagaaatctttgacctccctagttagctgtactcctaggtattttggtttgtgaatggctattgtgaatgggattgtgttcttgatttggcactcagctttgatgttgttggtgtacagaaatgctacttatttttgtacattgactttgtatcttgaaactttgctgaagttgttcattagatctaggagtttttaggcagatactgggtttttctgtatataaaattatatcatctgcaaacagaaatagtttgactttctctcttcgtatttggatgccttttgtttctttatcttgcctgatttctctggataggatttccagagaatatgttgaataggagtagtgacagtgggcatccttgttttgttccagttgtcaaagggtacgcttccagcttttgcctgttcagtatgatattggctgtgggtttgtcatagatatcccttattattctgaggtatgttccttcaatgcctagtctgttgacggtttttaacatgaaggaagttgaattttatcgaaagcttttctgcattaattgagataatcatgtggtttttgtttttaattctgtttatgtgataaaacacatttattgatttacatatattgaaccaaccttacatcccagggataaaacccacttgattgtgatggattagctttttgatgtgctgctgtatttgatttgctaatattttgttgaggatttttgcttctgtgttcatcctggatattggccttaagttttcttttttactgtatctctgccaggttttggtatcagaatgatgctgatctcataagataagttaaggaggagtccctcctcaattttttggaatggtttcagtaggaatggtaccagttcttctttctatgtctggtagaattcagctgtgaatccatctggtcctgggcttttcctggttggtaggctttttattactgattcaatttcagaactcattattggtctgttcggggtttcaatttcttcctggttgaattttgggtagttgcatgtttccagacatttgtccatttcttgtaggtattctagtttttgtggatagaggtgttcataatagcctctgagggttttttgtatttctgtggagtcagtagtattatccactttgtgatttctgattctgcttattcggatcttctctctttttctctttatttgtctagttagctattgatcttatttattttttcaaaaaactaacttctggttttgttgatctcttacatgcttttttatgtctcaattttattcagttcattttttcacatctcagtttcattaattaagttccaatattggttatttcttgtcttctgctacttttgcagttggtttgctattgtttttccagttcatctaggtgtgatgttacatttaagatatttctaactttttatgtgatgttacatttaagatatttctaactttttatgtgagcatttagtgctaaaaactttcctcttaacattgctttagctatatcccagagattctggtaggttgtatctttgttctcattattttcaaatagtttcctaatttctgacttaatttcattgtttacaagaagtcattcaggagtaggttgcttaattttcatgtaattgtatggttttgaatgatcttcttagtattgatttctatttttattgccctgtgatctgacagtttggttggtatgatttcagtttttttaaatctgctgagaattgttttatggccaattgcatggttgattttagactatatgccatgtgcaaatgtgaaacacgatgttctgttggttttgggtggaaagttctgtagatatctattaggtccatttggtcaagtgtcaagcttaggtaccgaatatctttgttagttttctgcctcaatgaagtctcccattattactatgtggttatctagatccctccatagatctctaagaactcattttgtgaatctgggtgctctactgttagatgcaaatatatttaggatagttaactcctgttgaattgaaccttttatcattatgtaatgcccttctttgtcatttttgatcattgttggtttaaaggctgttttgtctgaaagaaggataacaactcctgcttttcttgttttctgtttgcttcacagatctttctccatcccttactttgaggctatgggtgtcactgcatgtgagatgtgtccttgaagactgcatacagttgggtcttgcttctttatccaacttgccattctgtgccttttaattggggaatttagcccatttatattcaaggttaatactgatatgtacaaatttgatcctctcattgtgtttttggtgggatattatgcatacatgattgtgtagttgctatatagtatatttacatctgtttttgtggtggccagcaaaagactttcatttccatatttagcactcctttaaggacttctttttttattattatactttaagttctagggtacatgtacaccacatgcaggttagttacatatctatacctgtgccatgttggtttgctgcacccattaactcatcatttacattaggtatttctcttaatgctatcccttccccatccccccaccccatgacaggccctgatgtgtgatgttccccgccctgtgtccaagtgttctcattgttcaattcctacctatgagtgagaacatgcggtgtttggttttctgtccttgcgatggtttgctcagaatgatggtttccagcttcatccacgtcactacaaaggacatgaactcattattttttatggcatagtattccatggtgtatatgtgccacaatttcttaatccagtctatcattgttggacatttgggttggttccatgtctttgctattgtgaatagtgccacagtaaacatacatgtgcagtgtctttatagtagcatgatttataatcctttgggtatatacccagtaatgggatggctgggtcaaatgatatttctagttctagatccttgaggaatcaccacactgtcttccacaatggttgaactagtttacactcccaccaacagtgtaaaagtgttcttatttctccacatcctctccagcacctgttgtttcctgactttttaatgattgcccttctaagtggtgtgagatggtatctcattgtggttttgatttgcatttctctgatgactagtgatgatgagcattttttcatgtgtctgttggttgcataaacgtcttcttttgaaaagtgtctgttcatgtcctttgcccactttttgatggggctgtttgatttttttcttgtaaatttgtttaagttctttgtagattctggatattagccctttgtcagatgggtagattgcaaaaatttcctcccattctgtaggttgcctgttcactctgatggtagtttcttttgctgtgcagaagctctttagtttaattagatcccatttgtctattttggcttttgttgccattgctttttgtgttttagtcatgaagttaaggacttcttttaaggcaggtctggtggtaacaaattcccttagtatttgtttgtttgcaagggatcttatttctcttttgcttatgatgcttagtttggctggatatgagttattggttggattttcttttctttaagaatactgaaatgggcccccaatcttttctggcttggagggtttcttctgaaaggtctgctgttagcctgataggtttccctttgtgggtgacctgctccttctctctagctgcctttaatgttttttctttcatgtcaactttggagaatatgatgactatgtgtcttgggaaaggtcatcttgtatagtatctcacaggggttctctgaattccctgaattttaatgttggcctttctcacaagtttggggaaacttttgtggatgatatcctcaaatatgatttctaagttgctcattttctctctgtttcaggaatgccagcgagtcacagatgtggtctctttacataatcccatattctcagaggttttgttcattatttttattatttttcctgtaattttatctgactgagttaattaggaaaaccagtctttgagctttgagattctcttcacagattggtctattctgctgttaatactttcaactatattatgaaattcttgcagcgagtttttcagctctatcagatcagtttggttctttcttaaaacggctgttttatcttttggatcctgtattgttttgttgtattccttagagtttttggattcagtttctactttcttttgaatctcaatgatcttcattcctatccatattctgaattctacgcctgttatttcagctatttcagcctggttaagaaccatttccggaaaactacttcagtcgttttgaggtaagagggcactggttttttgagttatcagagtttgtgcactcgttctttctcatctgtgtgagctgatgatcatttagtctttgatgttgctgatggggtttttgcttttatcttctttgatactctttgaggtttgattgtggtataaggttggttcaattgactggcttcaattctgaaagatttcagggggccaaggctcagttcagcaatcttgggctacatgctctaactctgaggaactggtacagggcccttggctttgttatctggcctcttgaggtaaggaacctgctgcgcaggaagggccaatgtgttcttagtccactggccacactctgatgggggggtgccagccaaagtgcttcactggggcaatggcaacaggatccatactcattcacatgtgccaacagctgcattggtgcattggggtgcacatgcgtcagttggggtggggtgccagcaaaaacctctgccttcgttttcacagatagaacatactggcaaaatattttggtgttgtattttgggctgtggtccagtagatggcgcttaagagtgttagcagatagactcttggcggcatggctctttgtgctctgtggtagcaggggagagagatgacaccctcacctaatctgctcctgggtcttggaagagccccctccaatcactggctttatgcctgcatttcttttcttgggtgttctggtccagagaggtccctcaggcagggaccacgtttggcagacaggtaatatacttgcccagctggcccttcggagggaggtacaccccatgcctccactggcctgtggcatctcatctctctcagtgatccaagagtgagggctccttcctgcttgggcaccacccaagccagcaagtctcacttggcgatgagcagcaggagtgggtggagcccacctaatctgctatccaagtacttcctggggaacatgggattgtgcttgcctgccgagttcaggtagaagcagtctgctgggctgtaagctctagcaggcatggcccacctggctaccagtggcaggagtgagtggggttgcccgcccttctgtccaggtgattttcaggacaacagaagatcactccccttggactcaagagttgcccctgtaaaacttctgggtggctctgtgcctcagtttagaagtgtgggggatggagcgggcatggaggagagccaggggattttttcattcccagtcttgcacaggaccccacggggctctcactcacttgccttttcccattttggagaggttcttctggcctctgcactcagcccagacaggctggtgcccagcttcactcctctctgctctctatgtctccctgctgccttgatggatcccaatgtggttttttaggtgatcagcttgtagggtcagtgttcactagtcagtgaaaatgacacacgtgaactgcttctagtctgccatgctgacccaaactccccaacttccacatttttatagactgaaaggcttctcatcatttcatctttctgattatttacattttctagccagttgcataggtgaatataatattcctgctgaaaatagcttgagagttaagatcagtggccgggcacggtggctcacacctgtaatctcagcactttggaaggccgaggtgggtggatcacgagggtcaggagctcgagaccagcctggccaacatggtgaaaccctgtctctactaaatacaaaaattagttgggcgtggtggcggatgcctgtaatcccagctactcaggaagctgaagcaggagaatcgtttgaacctgagaggcaggggttgcagtgagccaagactgcaccattgcactccagcctggccaacagagccagactctgaaaaaaaaaaaaaaatcagtgtgggtccaaatctcaagtctgcccctttccatttaagtaaccctaggcaagtgtttaacccacttcaccatcagtttccatatctttaaaataagaatcacacttacttcatagcatgaaagtgagaatgacactctatgtcaaatgcctaatacaagttggccctcaatatttacactattttttttactgtgaacataacatgtactgggagaatatatttgagcagcattttggaaggaatactaaaatgagtaaaattaattcttataaatgcttcagaagtataaagtcagctacaagaaaactagaccatttttggccattcactcaaaaaatattaattggtgtctactatgtgccaggcattgttctaggagctggtggtgtagtggtagccaaaatgaacaagtctgctggttacatatatcttacctctaatgagaggaaaaagacaagaaacacataagaacctgagcaaataaaataatcttataggaataagagagctacgaagaaaatgaaacagggtcagtgggatgcagagtggtggaatatgccagggaggttgagcacaaggggaatgctgatttagagaagctgaaagggaaatcttctctggtataacatgtgagctgagacatgaaagaggagaatagcctacaataaacacaaatacataaggtaagagagttctatgcaaaagaaacaggccctattatgaaacaagcctggtgtaatcgagagagagaagaaaggtcagtgtgcgtggagcacagtgaatgtgagggagcccaggatgagaggaattcagaaaaacagacaggaaccagattatgtggggtctggtgggccatggagaggaatttggattctattctgatttcagggagcagccattggatatctttggcaagggaataataaggtctgatttaggttttcttaaaattatactggctgtcgtatggagaatggactgtagaaaaataatggaaggtgagagtccaggcaggtggctactgaattagacccaacaagtgatagcggtggtaataaagatggtgagaagttaacgggcttgagacatattgaaaatgtagctaaaggaacttgctcatagatggtatgtgggaagcactaggaaagaatagaatcaaggatacctcctaggattttggcctgacagcagtgtgttcctccagttggggagccctagagaagagactgtactgcagtagttgtgagacatgcactgtggacaaacactaagtttgcatcccctcttcatcacctgatcctctgtatcaattttctttttggtaaaattagaatcatatagcagcacttattactcagatgtgccttacggattaaattaataaacacgtgtaaagtacttaaaacagtacctggtgttagttattattaacgggatggggagggtgggagcaagaattctcttctacagttgctacatctatggtgccttttagatgtccaagtagagatgtgcaggcaatagggtattcgagtctagagttcagagagatgttgggaggaaagatataaatcaggaactcaatagcatactgatagtatttaaattcctgccactggataaaatcatctgggaaaagacagtagagaagagagtaaaagaggatcatccctggggtatgtcaccatgaaggtcatggccacatatacttagatttcacagaaatgatttgagagtctaaatgaattctttatttcactctttatttttagggaacatcctattcctaaattaattcacgaaagtctcatttgaagttctggatcacaaactgccctccattttacatttcacccatatgttctcccatcagattataggtccctcatggtgatgttatgtgccatatttttttaatgtccttcactcttcctagcacagagtaatacacataggctccctcaataaatgtctgctggaataattatttaaagaaattatgatgaataatctgtgttttccatggcaccatatgaaggactagctactgaggacatgaattattttgctctaaggaagaagataaactgaactcattttattagggagaaaatgtgaaccctgtggaaaaccaaagatgaatctaggcttataaataaacttatcttcctaaaacctgtctttttctactgcacaaggaaggggtgtaaagtgaaaagataatgaggctttagacttaggcaaacttgcgctcaaatctcccatctatataagttgtgaagccagaacaatttacttacgcatgtgaacccatctcatctttaaaataggaatgataataatacctacctcatggagtttgaaaaggtctaaatgagttttgtgatgtgaacagggtcaggtgatgcatgcacatgcaatgtgtggcattatagaagaagaaccctaaagttcgagaacccatatcttttatggcataaattggatactcatatattagtttccttatctctcctaaaaaatacactatatttttatgcaaggtttttgcacttatgaattcattatgctcaggacatagctcacaattatgtgcatataaaactcagtttattttttaaatgatgcatacaatgcaagtgattgtgtgtgtgtgtgcgagagagagatctgttgatacaaaagtacattgcagtataaaaaatgtacttagttttacatacataaatttacttctttcttaatgaaaatatgtgtgacaagatccttcatatgtaacaggagggatttcttacactgtagtaatttgctgcttttaaacagacttagcagcatccagaggcaaaggctgttatgggctcattatttcctgccccccagaggatgaactgtgctaattaagtacatttaaagggaaaaaatgcctctttgctgtgtccccattatgctactgtctctttacttcctgatgcttgttacaatttattagctgtgaattatacctgccagtaaattaacccttctttctccactcaatttgtcagataaaaaagttgcataaagttaaaagccagccagttggcttcctgagaatatagatatggaacaatttcctgcagcattgagcctcagaagaatttaacagctttggtgaatctagtaccaatgctcattttcaagccaggagcaaacacataaatcatgttcagcacaatgtacctgcctttagaaagctgtttacagccatgtatatttattagttttccatgatttcaagcagtatgttttctttaccctctccttttccttgcaagcacacacacaaattcctatcacaaagtctctctggtacgtcacaaaacacagcctttgggggtgattatttttcccgagtatttttacatcctcgtgccaatgcttcagatagtaccctaaattaactgtatcttttgctgtccatggatacttacaagtttccttttgccacttgtcaagagcagtgaagagtcttgagatttcacttgcaaactaacaagtcaccctgacatagtttcatggttgctggcagaaggtgcaacactcttagatcaaagagaaaaggactttattactcacagcattagcgttagccagagtagcagcatgtactccaagttctaattcctacagggtgatgtgaagagtgccagatgatacctgcacatacagtgggttgcattataggagatgaactctaagcttagggaaaccaaatattttataatggacagtaagcctgagtgacctttgccacagaagtaaatattgtctttttatgctgcaaaataaacaaaattgttctttactacaaagaaagacactatctctatcttccaaggttgtttttacagatgtcctcaaaacaacagtacagagcaaaggcactaagtgtctctgcccacaagatatgcataaatgtaagagtactgtattagtctgttctcgcattgctatgaagaactacctcagactgggtagtttataaagaaaagaggcttaattgactcaccgttccatgggctgtacaggaagcatggctggggaggcctcagggagcttctaattatggcagaaggcaaaggggaagtaggcacatcttacatggccagagaaggagtaagagagaggtaagggagaggtgctacagttttaaacaactagatctcatgagaactcacccacaatcaccagaacagcaagcaggaaatcaaccccacatgattcagtcacctcccaccaggaccttcctccaacactgggaattataatttgacatgagatttgggcggggacacaaatccaaaccatatcaagtaccatgaattattttaaaacaccactgatgctttttcttcatgaatgtgtattacaatttaatagtgttttcaatacatgagtttttacagttaatatggacttagtaacttgaatacataatcccaaaatcaagtcttcttgcaaagaataccataaaatcctttcttaaactaaatggaaattcaatttttagtaaatgtacttaatcgatgtgtaactcaatttcctcaccagtataatgaaataaatataatacttaattcgatttattattgagtagattaaatgagatagtccatgtagaatgcttaacacagagcctggtattcattaagtgttcatttctccataaatgttaattttaattagaattaattgtcagtaccctttgatgagaggtacttaaaatacccccttcactaaaccaccaccattgagcccacttccaaatgtaccttgggagtgctggtttgccttttgttggtatagaggcattcatcaggaaagggtagagatacaagaaagtaatattcttgaagacttattatgtgtttttagttgactatgtgacctagtgctttcatgtattatttcattccttcttaacagcattctcataaagaatgcattattttttagatgagtggaccgagattcagacattactgaaggtcacaccatttgtaatggaaaagcaggagtcaaaccctgtctcactctagtctgactctgtgcctttacaatttttaaccattcagtcttattttcctcaacaatctttctatcttttgggactaactatgcctttgtgacagaaaatcctctctactctgtagactccattgccaatgagaacaataggttcacagtggaaagagagattatgcctccacctgtattcttctaaaaatgatatccatctcttcatttttgaccttttttgaggaaatgacaagatgtaattcagaggatacaaagtagtagatatgtagcatgaacaagtctaaagatctgatgtaccacatgagaactacagctaataaaattgtactgtatttcggattcctgctaaatgagtaggttttagctactcttgctataaaaacaaaaaaaaaataggtaactatgtgagatgatggatatgttatttgcttcactatagtaatcattttactatctatatgtatcccataacatcattttgtttatcttaattatacatgataaaattgatttttaaaaaaatagtatccacgatgtgttaggcccaagcaacttatggcccaaatgcccctttttgtaccaaagcctatttctggatccataggctcagtcaacatgtttttctcactctttttgaaagtacctgattcctagtttagtgtttctgaaatctctctcaggaactttaatgacagtgtgacatctttgagaaatgcaagcatgacctctgttctgtcatatgttggttttacaagggacattacattaaacagaaaatatgaagtgataataagcctgcaataataacaaaatcctcattcaggaaagtgaaagaacttgtgttttacttttagagatagactcttactattacactaacacaaacaaataaaggttaaaaacatgcctttttaacttagttccataggaattttgtttcttaccaactctgcacgaaagccaattaaacattatttaaaaacaactggaatgggccaagcgcggtggctcacgcctgtaatcccagcactttgggaggccgaggtgggtggatcatgaggtcacgagatcgagaccatcctggctaacatggtgaaaccccgtctctactaaaaatacaaaaacaaaattagccgggcatggtggcaggcacctgtagtcccaggtactccggaggctgaggcagggaattgcttgaacccaggaggcagaggttgcagtgagctgagatcacgctattgcactccagcctgggcgacagagcgagactccgtaaaaacaacaacaacaacaacaactggaatgaaaaccaatatagggaaataatcttaacattagaatcaagtatgcggaattaagttttgtatctcctaaaatctttattgacagtagcagaccatatcaaaagtcttctgaaatgcttctagcgctctcaaaaatgctccacatcaagaaacttttaaaataaaataaaataaatgcctagtggaagagttcagacaacagtcccaaaactgcctgaagacattcagaattcctctataatctttatacagatattaagagaaaaaaagtactaatagaaattgttctggtttgtaattgcaagtataatcacacagttcctgaaaataatagattgatgttataatattgggcaagccaatcaatgaacacaatatgcagaatgataagtggtgaaaaaaatgctgcaaccttttgttgataacactgctgaatccaaactccaacccttgttcaagttgaacactctcgtttcattgttgggtaacaacaatgaatattgttgggtaacaattttatatatgcttctctttgggttaggtagtggcttgttgttgttatttgttttttgcttgctttgccctctttaaaatttttagaggaaaaaaacataacagatacataacatggtctcatgagaaaaccagaacacaaagccatgaaatgaagaatttcattctgtcaacctgtttagctttccctgggagttcaatcatcgtatgggcttttatgtgttccgctgagcatttactgagaacatcagccattatgggctgctgcctagctacatggtcatgtcgttacttcgcatttatctggaatcctctattctctcaacagacatttttattctgttccatatgactaccattgtgagaaagctttgttattttacttgaatgaggcagtgagtaggtctttattttttcaggaacatactcctcccctgtagctgtacctgaaaattaggtgactttctcatagctttttcaaacccataaatcttctgtccctttcacgcaatgtacttacttatatttcaattttagcatcttgcaatcaagtctgattcctagaccttgtttaaactttgggctgtttttaatttatgaatcgttttggaaatttttctttgcattgagttataaaatgtagactaaaactctagcaatgtagtaaaatcttttcaaagtttgtctttcatttattgatctgatccagatcctcttgtgtgcatcaccctagaaaccttcaatttaatccattttttttcagtacccctaacatcttaaaacttagtcattcagacaccacccacccgccctctgacaccttcttcctgattgaaagaggcatttatgtatatgagtcacctcctgccagcttcacaggaattacataaaagcaatctgccaaccatcttggcctaaggacaaaaaatcacatttagtgtcaaagtaaaagtcattcttgcttgttggaaaatcacaatagagcactttaggaccttaactcgcaggacatcaggccttaatctacagtctatactacaaatgagggaactcataaatgctatgctttcatcggtttgggtaagcttcttggcctaataatcctaaaaccattttaaatgctttttgtagttgaaaatgaaaggctaattcatattcaggaaagattatacatatattaaggggagaatgtggactaagaaataaacataatattagcaaaacacattatctttccatgctaatacaaaaatattcatgcagaaagttatttaaaaagcaccgcttatggcaggaaaggtggttttatggtctaagaaaaatgaattgaaagatttgcctagataaattgttataactagaaatattggtcaggatatttttagtttttttttgtttctagacaagacagcttagaccatatggaaatatgggtttaaatcttccatttaacctcttatttactgtgtgggtttaaggaaatctcttaacatgtctgagctttggtttccttaaatgtaaagtggtgaaatcgtgcatgccttctctctcttgagttgttttaaagatcacatagatgatatgtaaaaggacaatgtaacttttatgtttgtgtaattgcttataattctcaaaaagcttttacatatcatctcatttgagttggctactgtttttgcaagatcactacgaaggcagggaaagtcttaactctttctagctgataaaaagaatcctggaagatcccctgtattccatatcctttcccttcccatcagcacttccacctatacattcacagattcagggaacctgaaaggaagtcccattgtgtttctcagacacacatttctctcagctgtgaatatctctaatcagttccagattatcctaggaatttgagcctggcacaaatcatcactgtctactagaattgaaattttggctgccaacctagagcttctcccatgtccatacttgacatgtatgattgggcagggggagagaggatgagaatgtgtgtctctaaaatgcatcataagtcaaaccttgcatacaaggttttctctctctgttacaaaggacagcacacagaaaattaaagtacacacttaaggccagtacagacttatgacacttctcccaaggagagacagttccaagctcagaagtctagattttagtgcatgggaggttgaccttaccagttcttgaatgggataggtttctccatgtagaagctgtggaatgtagttagattcaattggagactatctctcataacaaggaaactcaccatatgagggatgttagaggagagttataacgttgtatcatttttttctttctttggtttcaatttccacctttattcagatgaagctgaaaataagtggaacagctggcaataaaaccttagccactaacttgaattttttgtgaaatgccagtcaagtaacaggaatgacagacatgtaagtaagccccagtagtatccatttttaaaaatatgtactgtgaataaaaataatagcaattagagaactttaaatcatattttaaaggataccgtcttaaaataatcactattcagaatttgatgaaagtaaaattttagggttatcttcagttactcatgttcaaataattttctgtgactaaaactttggtcaaaatagaaaatgtgttttttcctaggatgatctaaaggtatttattgtggatggaaagaattacagaatacaaataatatgaaactcaaaattacatcaaccaaatgcactttgttttctcagctgactcaaaataatgagtagccaaggtaatatcggctgcacattataccttctcacagtaccaggatacctgaagaaacaacacttcactcctagtctagtcagcacctttgcaatttttcttggaatgacgttagcttttacataacccatagtagcaagcttgtgaaacaaagaaaccgcaatttagttcggggtaactctaaaatgtttgtgttcaaattaccaataagactcgttttcatgaagggtctttctaaaatacactttctaagccagtgtgcgtattttcatccatattttcaaacagaaaaattaagaacaagacggatagtaactttcttgacagttatgccttggttgagaagtttaggtattaactcacagcttccatgtctagaccgttgctggctctctgatagttaattgcctctattatgatattatcattagagtccccttaagatagacaaaagaaaattgtaggtttctaggtctactcaattaaagcaattgagtttcatagtttcaggaaatgaccaatttaactcctatctggaatttgtgatattggaaacatttgtggaaaaggaacacattctaaagtattttgaaagtttcttaaccagtttttctctaaatcattgttctatagtaaacacagacatggataaaatgaattcctaaagatataaatttggaattttaaattaagatataatttatttggtaacaaaataagtggatttttaaatcctctcttccttagtaatagaacatctattatgttctccatggtatgcagacagtaatgtagaacttaaggggtttatatagttacctagacaattttatcatttactacatttttttgaagttatctttgtaaagaaaaaaaactttttccattaaggaatacatgttatcctggacttctggtgtcactaaaaggtcattgatttacatctgaactgggtcactgaaagcaaacgactatgtggtggcctaaataggtaaaatcgtggcatctttcccagtttaagagtcatctgaccaattataactcaaaatttaaatcaaacctacaagttattattagaagaaatactgagattggtctgaggctacaacataaacaaatgtgatctcagatattggttaattatttcaaagactaaaacattgaagtttatgttttatgcttcacctgtgtatatttgaatgccccacaccaattatacataagatctggagtgtattcccaacatcttcccaaatgaaagacctatgaaaaagtattttataaaaggtgacatatttagagtgagaagggctttatgtaaggaggaacacattattcatcctgagcagatgaaaagtaagacataaactttgagaacaaggtgaaagcagaggtgataactataaaagaatatcttgtcaaagaagaagcccatgtcaagcttactccatcatggagataaatgtcagccctgcttttgctcaaagagcacacctaagaggaaaaggcacaaagggttagagtgccaatagaaaaagaccacctgccacttaccacaaatgaataaaacaaatatatatccatagtccatggggcaaccatagcaaaggaccatctgatcctcacgacattgtcttaaagcattccttacatccccattaggaataagaagccgttaaaaccacctatacctacacctatataactagcacattcctgctgacagagcttggaaggcattgagcagttctgcatttgatcctacttttttcacaaagaggtgaatatcaaatattttaaacagcaagttaaagtttcagagcaaatataatttaaaatttggttctgctttgggaaatctgtttaggaggcatttgtaaacagttgaaaggctcattctaaactggaatggattgccccatcctatcaatgcccctgagatgaatatgaagtcagcaatgggagttttttaattctatgataattggctgggagttctttgacctttaattaaacaaaatacgaattaatgaactttctttctatttacagcagaggcttgaaatggtacaagttgggataacaatcaaaacaagatgctattttttcactaacaaataaatacaaaacatgatgctgaaatctgcatactgatattgatctaattatttattttgaacctgtaatttttcatctttcttcactcgaaggaagaaaaaacatcaggaaaaaaaggagctatttcttcttggatatatatgtcacacataagcaattttcaaatgtctcatgagctggtctcagtattaaaagaggcttctttagtctagcagaatttcagacaaaaattctagagcctttataacatagaagagttttatgaaagggtctgattggatgagatgtaaagagataaaatatgtacatagttacaattatattttacaaattaaacaaaaaactttttttcttgttttgcttttttcgttttatgccttaactggtgaacatttaaaaatatgctgttagatgagatcgtgccactgccctccagcctaggtgacagagagagactccatctcaaaaaaaaaacaaaaatgctgttagaatatggacacaaagaagagagcagtagatatagataccagatatagatacttgagggtgaagagtgggagtagcgtgaggatgaaaaactacctattgggtaccatgctcattacctggatgatgaaataatttgtaccccatagccccacagcacacaatttacccatgtacaaacctacacatgtatcccctggacctaaaataaaagttggaaaaaaaaatttagggatcattagcagatcattgcaaaatctgctaggattttgcagataaaccataagatccctcgaaaatatttttctttgtagaaaccatgtgagtctatacagcagggtctcaggagtatgagggataggcagtaatatgttcatcctcctgtttagtgagagaagcttccctgcaacagtttgagaaattgagcatggcagtttcgaaggtatcttccagctctaaatccttctttgtgataatcatgagtaatgtgatgcatccttactctgaccccaagcagaggattctctactcaggttctggtggccaaacctctcctgctttcactcactgagggaatggaagagtatttctatgaaggaactcctgggatctctaccctttcctgttacagtagcaatatgtttgtgccccactatcaccaccacatctactgaactagagcccatatagacctaatattagtgcccaaagtattgttgtgtattttttatatttgtattataattgacttcattttataatctctactatgttttttctttttcttaatcacttatatgcaatgtctatcatatttattgttatacatacttatgatgactttaaatcctttttatagaattgggatacagcattaaaattttattgtaatgattatgtttccagctatgaggcattaaatattatgtagtccaaaacttacaactctgtgaggtaggtattttcttatttatttatttatttatttatttattatattttaagttctagggtacatgtgtacaatgtgcaggtttgtcacatatgtatacatgtgccatgttggtgtgctgcacccattaactcgtcatttacattaggtatatctcctaatgctatccctaaggtaggtattttcattgtttttttttttagaacaaggaaactaagattcgggaaaggcacttgccaaggggaaaagttactcagtgtccttagagctaggattcaagcccaggaaacttccctctaaaaaccatactactaattacctttctcaagaaccttccaattagaatattgtcagaaagtcacaataagttattttggtacttgattaggcatgaaatctttgtgagatagcaggccgtttctgattctgattcctcaagtcagctggccttttctctttccttcttgagtcattatctttttgctttttctactgtcccttcactgaccctccaaacttccagtccaccttctctggaaatatctttccacaattttagttccttttttggccccagaaatgtacctcagcttcaggtctaaactactctaaacttcaggtcagaagcattaattaatttgtttattcattcaataaatatttatgagtgcctactacatagcactgggcaaactgtagtgaagggaacacacatgctccctgttctcatgtttcttatgttcaataggaatagataacactaaacaagtaagtatatagcataacgtatcagacactggcaggtgttgtggagaaaataatgcagggcaaaggaaatagagaagtctgagcctcagaaaatagagaagtgttgttacatttataaggatgtccaggaaaagcctgtctgataaggtaatatttgagcagagacataaaagaaatgtgaatttaaaagtgatgctctgaggaagagacttaggggcagagaaaataacagcatgagtaaaggcccagaaacaggaataatcttgtgtttccctaacaatgagaagggctgtgcgctggaactgagtgagaatgaatggattcctaaaattgcttgactcatctataattcattcaagaatggcatttgacttctaagatagccatttttcagaaaatttattttagattatattaattttttatacatatgtttatcgcttcacagaataaaaaaggcttttcccagatattatctccttttctcctcaaaacatgctgtcactggatcatgggtctaatttgatttgattatcccagcaactgacacaagacatgatgcatagtaagcactcaataaatgtatatggaattaattagttgatgtattaattctgtggcacaatttctaatttttcacctttaccatgttcattattattgaacatcagtgatgggactataattcagtgaagcttcagaagctataaagatttatctagccatttgcctgtaccctaacttatatatgtatctaatttttgtgctgatttacactttttctgcctaactcttccattaagttctttaacatctttcttcgcaatcagtttatgtatattcctaacttatcgtatctaatctgctatattcttggaaaccagatcacaggcctgttagacctatatgtatgtaaaataaagtgacttttaagtgagagcatgaaaccctttcttaaagaataaatttgccttagttcatttgtactgctacaacaaaatgccacagactgggtaatttataaataatagaaatttagttctgggagctggaaattccaaggtcaaggcaccagcaggttcagtgtctagtaagggttaagtgtctctgcttccaaaatggaaccttgttgctgcatcctccagaggggacaaacactgtattttcacatggcagaagggatgggaagaagcaagcccacttcctcaagcctttttataaggtcattgatcccaatcatgagagctccactgtcatgatttaatcacctcctgaaggcctcacttcttaatactaccacactggcaattaagtttcaacatatgtattgtggggaacacattcagaccatagcaaaattcactaactttactacttgcttcctaacagctgttctgatctcataggcattttgcttatttttgcatctgcaatgtaattctagtggattaaagttgttaggcacagtatacaattgtgcctttcccccaacttgcatccaaagaaaattataacgcatttcatcccatcaaacttataatctatggtataatctaaagccacattaagaggttattcatcacaccaaactgatctcatttaccagaagtagccacagcttacaggtttgtctgagcccttctttttcctcactgaagcaagggttcccaaccaatattgattatctacccacttggtgcaacatgattgtaaatgtgccccttgttttggggtacacttaatgtgtcctttccatagaagtcattatctctatttaccctttagttaccctatacaaattttcagtcaaatattattctttcctcttctgactaagaattttttggcattaccagtaattaatttattctttcattctttcagcaagactctattgggagcctactacatgccaagcactgctctgggcactgcagatttagcattgtagaggcagaggttacctttattctgttagctaaatgaatagctctaagggtaagagctaaatagatggctataaataaaggtacaccaatagtaatagcgataaattctatgaaaaaataaagcagagaatccaggtatagcgtgataggctgagcatttatttaaaagagggtggtcacaaaaaatatataagcatgtgaagtgatggacatgttaattagcttaatttcaccatttcacaagtacatttattaaaacatcaccttgtacactataaatacatgcaatttttatttgtcaattataccttaacagagctgggtgaaattttaaaaaaaagaaaaaagagtggtcaaggaaagcctcaccaaagaggttatgtgtaagtggagacctgaaagagtaaggaagtaaaccacatgagtatttggggagagcatatccttaagaggaaacagaaagactaaaaccttgaggtgtgaacaaacttgatatgttctaggagtagcataaaggcaagtatgtctagagcatagtgagtaggaaaggaaatgatacaatataaggcctaaggcaaggaccaagtaatgtaaggatttttgaacatcagttgtcactacttcccaacagttcattgtgtgtttgacttggtgctacttctggacagttttcttaaagtcagtgtaaagagcataggacatgtattgcaaataattttggtagggtaacttgcatgataccatattaataaaattcaggagaaaatatggagacaacagtactcacagttgtacattctgtttttttttttgtggttgttgatgcaggtgaaattcacttatgtaaaattaactattttaaagtaaacaattcagtagcattcagcatattcacagtattgtgccactacaacctctgtctaatccaaaacattttcatcaccccaaaaggaacccatcctcattaatcagttgcacccaattttccctacactggcaaccaccaatctactctctctatctatggctgtacatactctagatatttcttgtaaatagaagcatacaatatgtggccatatatgtctggcttctttcacttagcataatgtttttgaagttcatctatgttataacatgtatcagtacataatttgttttcatagttgaataatatttcattgtatgtacataggcaaatttgtttctccattcatccacagatggacatttcaattgtttctactttttagctatcgtgaatagtacaaccatgaacatgtatgtagaagtatttgtctgaacactgtgttttgttcttgtggtacatacctagaagaagaattgctagatcatatggtaattctatgtttaactttttgagtagtcaccaaaatgttttccaaaggggctgaaccacattacagtcccacagcactctgattcttaaactacctctatatacagatgctccttgaaatacactgggattatattctcatgtattgaatgcatgtcacttttacaccatcataaagctgaaaaatctttacttgaaccatcattaaatcagggcttgtctgttctctgcaagctcttgcttcctcataccttatcttccctagattggagctgtttatactgagttatcatactttgccaaaactgataacctgattagttggttctcccaaaccagctgaaatggactttaattagaaaaactaagaaaaataaaattaataaaaatataaagctaaactttagaagctaaaattctgttgcataatttctaacccaaactaccctagtcatgatatatataaaagatagacggatagacagataatcttctattgattctgtttcactagagaaccccaatacatactccattatggctagagtagatagatagatagatagatagatagatagatagatagatagatagatagacagttaggcagatgtattataaggaattggcttatgaggttatggaggctgagaagtctcaagatatgcaggcagcaagctggagatccagcagagctaagtgtgtagttcctgtccaggtttgaaaatctgagaaccaggagaactggtagtgtgcattccagtctaaaatctgacaggttcgatactcaagagtcaatgtttcagtttaaatctaaagataggaaaagatcaatgttccagctcaaggcagtcaggcagaaggagctccctcttacttgcaaaatagtcagtctttttgttctacttaagacttcatgtgattggatgagggccaccatctttagagaaggcaatctgctttactcagtctactaattgaatgttagtctcatccaaaacatcctcacagacacacccataataatgtttgaccaattatctgggcaccccatagctcattcaagttctcatgtaatgttaaccctcacagagtacttttgagccagcacaatttttaggacctcaactgaattcagatggcccttatataacccatgttgtctagagtatttcttattggagaatccacagtatctgttaattatgaggcttatgaaatcattgattagctgaattatttccttactgtgtaccagtaactgtaccaagaagtgaacactaaagatttcatactcaaaaggaaaaacaactcataaataaataaattagaaactaccttgaactatttgaaatcaaggaatagaacagtgattcttaacagtgtggtataatgtcccctatatcaaaatcacccagggtatgttgcctttgctcagaatgattgttctgaatctctgggttaggacccggaagtctacattttgttaagtttcccagataatctttatgtacatagaagtttgagaagcactgataggaaatgcttttattttagcaattttcaaaataatttgaaatcaaatgttttctaattactttttccaatttgaattatgttgaaattcttcaccaagattcaaaacagtttatgaaaataaagtagtaaataagtgttctacaatggccattttcaaatctttatgagtttattgccttactagatcaatcaaaattcattcatgttcccattcaataaatacttactttcccttctgttcttgacatcacgctgggttttgggaatgcagcagtgaataggatagacattgctcatggagtttatagtccagctttaatctcacattttgtttttaacacataacacaaacctttttttggaagggggtgggttgctgaacatttaattactgtggttttttttaagtatttagcattttcatgtcttgagcagaacagatgcgctacttaaggagtttcatacctctgcaactaaaaggaaatctatttgttctgcaataacagtaagtggattgagacacctcagtcccctcatgtgaaatcttacagctctgcttccttttctgctttcctgttaaaagcaagtattttaaattaaggtattaaaattatgtttatagtaatatataaacatcccttttctgcacaattgaatgaatgagatttaactaatagtttcctagagatactatatagcaaaaaataatgaactatttttaacacttattttcttttaaaaagtacattagtattttgactaagcatgtcaaccataagctaaatagcatatgcataacaatttcaagtgaatacttcgtgatggtagcacttacttaatagttttctcttttccccactaacctgtcattatttgccaatttcagctcaagaactcctctgggaaaatcattcttcaccgctgtaatttagaggttatatataatgtatgctcaagaccagttaaagtatgtaacagaagtaactcaagattgctctataactcttttctctgctttcacacaaacctttgtccttactctgttattacaatagaaacaataaaatacataagcattcaggtgaagaatgaaaattcactaatgtcatttagaaaaaataccaagaagggtttatatgaaggatataaagccctgtgaagttactataatacagctacttggattatcttcctgtttagtgctgattaactccaaaagtgttacggctcaatttaaaaatatagtttaaaattttaggcatatgcctgatgttttcatgtgagtaacagaaagtaatggaacatggaattttctgacaggacaataaggaccttttaaagttggcagaattacaaaggatttcattcacaaagctaaaactcaacttctgtgtattaggaaaggatttaagaccatatatccatttctcatttgatcttcatacaaaacctgggagttacatattgttattcttgttttccaagggggaactgtgatttggaaaggttcagtaacttgtccaagcctcgtattattactgcatagtaatcaagtagcagagccagagtcctaagtcactcggatttcaatctgctgctgttctgccatggtcatgtatgttggtgaggccaagcacaagaactgggcattcagcagatggtggccttggcctaaggcaatttaacaagagcgaagataatctctaagactcctcactgtacttagcaaattcctaggtgaaagctcatagaaaacacagtccagcctttggtctttaagactattttaatctggcaggacaaatacagtttctacatttttatatgtagacttcacatttagaatatgggcaactgagagctgagtgattgttttgccattaggagtgttaattaagttagataatgcagtgctatgtctatagatttcttgtcaagggagtttaaatactgttgcaaaaactgactgggtattatgcttcccactagcttacctatctttcctgcattctttcttatttccctgctgaatgtcaattgtgtaggtaggtcaaatagtaaagttgatcctggccttattatttattttcctctaagggtatctttcctctaattgttcctgaggccctactctaatattaacctaattaactgttttcagcatatttcaatgtttttcttgtctaagcacaagtcttgtatagtctttccagttctaaacctggtcagagagagactaaggtggtcattggagcacttcatggtgctccagtgtcctgcagtccaactctgcagattgtacagtgagtaagtgttctttaatctggatgccagtgggtaaacattactagtttggctggtgtggtggctcatcttatgtgtgaacgtaactaagctaagggatgcccatatagctgctacaacatgatttgaggtgtgtccgtgggagtgtttctggaagagataagcttttgaattggtgagctaagtaaagcagatggccctccccaatgtagggggcatcatccaatttactgagggattgaatagaactaagaggtggaggaagggcaaattcactctctctgcttgagctgaggcatccatctttatctgcctcagacataggcgctcctggcttcaggctttcaaactgccacttataccatcacccaccaccaccaccaatttctcaggccttcagatgcaaactgaattatatcaccagctttcttagttctccagcttgcctccacaaccacatgagccaaatcctgtaataaatggcctcctatatctatatccatatctatttcctatcgtcctgtctctggaaaatcctaaataatatagctgactattcactgaccaatctagtcttcccattcccctcatacctttaggctttgaaaactaaaagtgacagttaaatattgaaagtggaaaaaagagcatccttgtcttcgtttctggaagattatgtcaccacagttctgtatgccagtgataagagggttcatgttgtattcttgttgtttccatggacaacagaagcagtgagctttgaaatccaaaatccttgttaagtcacctctttagctcttaaatagctttgtgaccaagggaaagccacttaaactatgtaaatcatgtctaccacttctgaaatgggaataataatctctagtatactaagtatatctgatgcctggaggaggtatgagtgcgtgtacacgcgtgtgtgtagatagacacataggcataggagcttatcatttgctgcttaattgatttcatttactctagcaaatatagacatttatatttctaaatagtatatgattgactataaaatattaactctaaaagtactgtgctcaaacaaaaatatttttatctgctaaaataggccaaaatataatctaagaagcataaataagaaacaaaaaaattatcaagacattccaccaagaatgccacacgtgtcatcaacactaacataaatcttcatgtaaaacttctttgcaattacttttaatttcaatttctgcctcttcatctatttgatttattctgctaacaaaagttagagaaaattcaaaggctatcattttgctcagttctcagaactcagattctttaaattagttcttttttgtcttcaactagatattttaatgcctgcaaactttcttagctttacagaatgaagacttgaaaaaaaaaaaaaactaagttagtggggtagcatacagattaaaatttggaaagataattttgaaatttttgtgttaaattgtatttgaaatgcaattatcatataattaagttgcacactatgttcccttctaacactctgattagcattttcaactgttttgtttgctaaagcataaacaattattttctgctgcagaaatggttgcttcattgctgtagccatgagtggcttaatgatggaggtgtgttctaaaaaatgtgttgttagccaattttgttgttgtgtaaacatcacagagtatacttacacaaacctagatggtataccctactacacacctaggaccaccaaaatatacatgctacattgttgactgaaacatcattatgagattcataactacataagtatgtgttgatacacagagcagtatttatattagtcaaaaaagtaaacaacttaaatgtacaacaataggataaaatgggtaaataaattatagtatactcatttgatgcaatattctgcattcattacaaaatttggttttggaagattaatgtgataggagaaagcccatgatatactgtcaaatgaaaattcaaaactctgtatttttaatcctgattggtatagctttaatttttattttatggcactaatttacctatataactatatgcctgcaaatattattatatatgtttatttattgagaaaaaatggaaagaaaacacatcataatactttattagtgattttaattatttttaattagaaaaaatgttattttaaaaataataattgatacatggaattgtaaattaccttcctatatatagtacagtattttggaaaaactaaaaacaaaagtcccatttttcaataatcaagccacttttgaaggtagacatctatgttcttagggttcctggattggcatttgaggagaccactaaattgtgcctcttcagacaatcgtgattccttacctcctccatgaccacagtactctatcagatgggttttgcttgcccagaatacatgtggttttctgtctgtggtcgtggagcactgacttaatttattataattagaattttagatatgatcacaccattttagacatgttgcatatacagaataaagtataattttatatcatttttatattttgttcatagtaatgagtagactacttcagtttaaaatagaataatgctgaataaaatcattctagtaatgaagggtttagtgaaaaggatatgacctaagaatattgctgggtacttaagctttttacaagggttaggccagtaacaaatatatttttaaaaggtgggaataatggatgaatgtataataatgttctcataaacatctgcaaaatctggtttacaaaaacaacataaaagatgacaaatatcactgtttatcttaagtatataaaatatcatctagaaataattttcccctctttaccatatataggcataattagtatctgccatctgtttcaatgtatcttttatgtgtttagtgtttatttctagaatatcaaataaataggtaaaatggaaattcaaatctgcaaattcagggctaatttagtaacttaaatcattgtattctagttgactaagaggttagttcgcaggaactttatttagcttctaaggcctaagaagaagacaggtttcttatatatagtttttcttatcaagttttgtaaatgtacattaaaaatgcaatcaaggatcacaaagcaaagttcgaattccaattaagtttgaacaaaaagaaaggcaaaaagaaggttcattttaccaaattgtaagacttaaagcactgaacacaaaaaaaatatgttcaaatagatttcgaatctatattttaaccactgaaagaagaaaaataagagactgaaatgaagtgagtaaaatggaaaaagaagaaagatatgatctaagtggaaggaaagataggaagggtgggctagaatgttcaactggggaacaacagaattgagagaggaagaaggggagaagaaagaaagggaagatattataattgtcagcattatatatatatatttatacacaaaatgtgtgtgtattataattgtcagcagtacaaatatacagacacttgtatatgtatactatatatcttacacctaggtatatccttccccacaccagggtccagcatctgacctagaagtcccatttgtaacttcatcatgtccagctggctggattcctcctcccccatccaaaccgtgccccaccttgtaaggacctaacctgtccctgatgacattgctgtcagttcattcttttgctcccatagttaggtgtagagatccaccaacaggcctgtcttctatttctgagtgtcatcaggacgcacatattacatggttcagctgtgcacaccaaaaagcttgcttatgttaagagagtagtgataccaaaagaattagatagctaaatttcaaaaacttaccattggctagatgagtctaaatttgaacccagaagttctctacctctgcttttaaaatcaggaagaatctcttgcattcagataaagcatacaatcatggggtagtcaatgaataaaaaactctatctgcttatgatccaaaaaagttgggaccataaacatgatgaggcagaccttccagatgtcagctttataattaagaaaataagatttagttgtgggcccaactgtattaaggaaagggagaaagaagataaggtgtgatagagtagaaggaatgcctaatttggatctatatccgtaagctaggataccactaatttcatctatgaaagatcatttacaaatctaacagcattactttctgcctagttgaagtgaacactcaactaccgtgtgtgtgtatgtgtatgtgagagagagacagagacagagaaggagacagagagagggagtataagaatcagacttaaagattgagaaagaaaaaagaagaaagaaaagtacattaaatactcagcatggtaaatattttataggatataacaattaaaactctgattcaaaatagctttacttatcagaagtaggatattttattagtctgttttttaatgaaagggcaaattagagatctactttactatgatatctcattttgaacaacaatcattatcttttgggaatctcagattttgattttgaaaaccaaagacttgtctgagaaataatctgtttctttcaacatacgttcttgcatagcttcactaaaaatgagtgcccttcttttggcaattggtgatctatatgcctgaagggtaaattggatatattttatgtactagatcgtagttcttttgatacctacagaataaactcttttcatttaacttcctttttccaactgacactttttgctgatttattgcaagctaaaggataaataaatgtatgtgtttcatgtaaactcaaaagtatctctctagttttaaagtgataaagaaactattttccaccatttaattctcacatgtataaggaactggttttatcctctgaatgcaaaaaggatatatcttttggaaactttttaatgccattctttacctgatacattttttaaattatgtatttcaggccctgcttgatactcagaatcttttgcgtgcacaaatcacaaattttacattcaacctgggattttcagggaaattttaccatacaggtaagaaaaagggattaactgttctcattaaggcttctctgatcactctatttaaaattgcacacttttcctgcccacactgtcctacattccctatgttcctccccagcattttatcattcaattctatttaacatgctattttttaatttttgtaaaatattaatggtttgaaagtttatggaactatctgatggcctttcatttttattgaattataatttacatatatagaagtacataaatagtaaatgtgatattcagtgaattttcaacgtgtacacagctgtgtaaagaacaggcagatcaagaaagagaacacttccaaaatctccacttcttgtgcccctcacaataactaacttctctcaaagaagagtagtattctgacttctaatatcatgaattagttttgcttggctttgagtggtatgtaaaaggaatcatacagtaaagattcatctgtatccagctcattttgtacaatgttatttttgtttcagaaatattactgtctataggttataattctttccttttccttgctgtacagtattccattgtctgaacatacaaaatttacttgtctattccattaagctgtagatggttgggtgtttccagactttgagtttttctgaatagaaatgttcataacttcctgttacgaacatttttatacctgtccttcagaggacttgagtattcttttctgttaatcatcaactaggaatggaattgctagttatgtggcacacttataattaattttagtagaaaatgtcagtttttcaaaatggttgtacctgtttatattcccaacagtatgagtgttcctgttgctctgtatgcttgccagtatttgatattgtttgtctttttaattttagcttttctggtgaacatgtagagatatcatattagggttttaatgtacatttctctgaagagcagtaaatgatctttgttcgtatgttggctggctatttggatatcctctcttgaggagtatctgggttttctgcttttacttaatgatttgtagaaattctttccttgaagtttacagttccatgtgttccaagtactttctcctgctgtctggctgtctcttaattttccttatggcgtttttaatgaacaaaaatacttaattttaggccgttcaatttatcatttttttctttaatggtcattcttttctatcttatttaagaaatctttgcatactacaagaacatgaattttttttctttttgagacaggatcttgctctgttgcccaggatagagtgcagtggtgcaaacacaactcactgcagcctcaacctcctaggcttaagaaatcctcccacctcagccttttgagtagctgggactacaggcccatgccaccatgactggcaaatttttcttgtagagaaggggtctcactatgttgcctaggctggcaatgtataaatctgtgatacatctggaattgatttttgtgcatatatcagataggggtctttttttcataaaaatatctaattggttagccagacatggtgacatgtgcctgtagtcccagctactcaggagacttagatgggaggataacttgagctcaggaggtctaggctgcagtaaactatgttcatgccactgcgctccagtctaagcaacagagcaagaatctgtctcttaaaaaaaaatctaattggctgggtgtggtggctcatgcctgtaatcccagcactttgggaggccgaggcgggtggatcgcgaggtcaggagatcgagatcatcctggctaacacagtgaaaacctgtctctactaaaaatacaaaacattagccaggcatcgtggcaggcccctgtagtcccagctactagggaggctgaggcaggagaatggcgtgaacccagcaggcggagcttgcagtgagccgagattgcgccactgcactccagcctgggctacagagcgagactccatctcaaaataataataataataataatcatcatcatcatcatctaattagcacccagtattgaaaagaccatcctttcccactgcttcatagtgtcattattatcataaattatatggccatgtaactgtggactctcattctgaatttccctattaaatgtgaaaagaaatcactctaaatattgagaataattaaaaagttttttcacaatcataattaaaatgagtaaagatattttgacttgcctcaggatagatgaacacaatttcatgattgaaagcattactctgtatttttagaagttaaaaaaactgattacatgtattggtatactcatataatggaatactctgcagtcattaaaaagagataattttaaatataaaccatatagaaaaagctctcaagatacactgaaaaatcagtgtacagtacagtgattagaacatgctcccatttgtataaaaataaagaagataaaagctatacaaaagtcaaggtatagtacagtgattagaatatgttcccatttgtataaaaataaaagaggaggtgaaatctgtacaactctatgtatagaactcttgtagcttagaaaactcagttaccaagtagttaagtaacttgtgccatgcaagatgtcttaaataagatagaaaaggctgaccattaaagaaaaaaatgataaactgaatgacgctaaaattaagtattttttatataaagggctattaatacaagtataggatatctgtgggagaattcataataaactgatagtaatgggtaactatgaatgtattagttttcatgctgctaataaacatatacctgagactgggtaatttataaagaaaagaggtttaaaggactcacagttccacatggctggggaggcctcacaatcatggcggaagatgaaggaagagcaaaggggtgtcttacatggcagcaggcaagagggcttcgtaacttaatgcagggtaacttccatttataaaaccataaaatctcgtgagacttctcattcactatcatgagaacagtatgggggaacctcccccatgattcaattatctccaaccagccccagccttgacacatggggattattacaactcagggtgagatttgggtggggacacagagccaaaccatctcagtgaagaagagaatttgagaatcaaacaagagagatgaaaagaagagttactttttactaaattttttctgagcctttgcattttataacatatatgtgtgttagatctaaatgaataaacacataagtaattttttaaagtgatatcatatttaagcaagtttatcagttttctacaattgcaaatgcttttcaaatttttcatttgataatatgagcaagagttactttgtatgtatttgatgagtaccttcaagggtttaataaacatatcatgctgagaattctatctatatactactaacatcaatataatctccatatgcacataaacaacataaatagtaattttatttttagatagaagcatactgtatttctagagtaagtcaatttccatttgtttccatggaagttagagagccatgagacttgactatagtattttcctattgtaaaattgtgtaatgaatacaatatgtataatcatacaactacatataactttcacctaccaatttgaaaattgtgtaggatttaagaataactttaacataagaagcgtggaagcttttattcctctgaatttcttagatcaatatataaaatacacattttctgtgattattttaaatattaacaactgggaacctcatgattatgtttgactttgttttatgattcattgagttggttcttattgtaacctcaaaaataaaaacataattagatatctattttaaatcttttgcttacaggaaagttcttctaccttggcaatagatatgtgaagtgagaactttctctttatgtgcagaggtttagttcatctttctagtgaagttagactcatagcataactaactttcacaatggagagctccaagagcttaaggaaacagaagactgcccacaacctcttcctaaacttctgagttaggatatcctaacttcaggatgattatcttagattctttgacatccattgaataaaggaaaattatcatatggatgaaaaaccaccatggcaaaattagggtgaaatatgtggtgtgtttagggggagagggagagagtaggaagagacatcacagcaaaaccaggacagcccagatatgctcaagaaatacaagaaaacactcctggcaactccattatttttttgcccatcgttgaatactggggaatgatgctagccaattcatgtcattccttctcatctctgcaaggtttgtcctctttctttacttgggcacttcccacagctcataataagagtatcctctccctaagtgagagaaagtacaacacagatggaaacagaggccaaggtttgaaagggtcttgttagctgtgtataatatgagagtttccacaaaacttagccagggttgtctaagaccagttaaatcattttttagagggaaaagatacaaaatttaatatttgatctttcaaaaattagatgggataaaaagtaattgaattatattgtcttcctttctaaatgaagaaattgctattcctttttctataaaaaaattctatccattttactcagtcttgaagggaaaaagaaaagtggcattgtcataacagtaatactttatgtcagaagagagctttatcttgtttgatttattttaatttttgaagggtatgtgcatttatgtgagaaataaaggggtaaaacataaaaatcatagttcccttttagtgctttgttaaacacttttcatgtactttttcactgaatcctagaagttaaagaacgtgttaacttgttttctagataagaacatagaaacttaaaggggcccaaggtcacatagcttgtgaagtgtcaaaaaatagtcttaactcatccttgactagggaagctgaatggcaaaagattctccttatttatagatttgttagctttttatgtttccccaaatcactgagatccagtagtacctgtacattctaattatattatagaataaattaacaatgagaagagcaatgttatattgaatgaataaatgctgatcttatttctagactcaacgtttggccagtgaatgatagttaagggccctgaatttggagttgctcaatctgagttagaactcagaatttcaattcaggctctgtctcaaacctctcagtgagatggaacaagttacttcacctctccaaatgtcaattcccttatctgtaaaatgaagttagcagcagcactcacctcatgaggttgttttgagaattaagtgaaatgatgtttgtaaagtactcaacacagtgcttgacataacaacacaacataaactctcaatcaatgatgattttaaatataatatcagaatagcaaatactacagataaaatagtgtagagaagttatttaaataaatatattaaaaaataaattatagtttgcaataacttcataagatttcagcatagttttgtgataagttaagaaatggcacttaacactgtagaaaagagtttggaaatttctcaaagaacttaaaacagaactaatattcaacccagcaatgccattattggatattatcatatatccaaagaaagaaaatcattataccaaaaagacacatgtactcacatgttcactacagcactattcacactagcaaagacatggaatgaacctaggtgtccatcaatggtggattggatgaaaaaaatctgatacatatactccatggaatactacacagccattaaaaaaggaatgaaatcatgtcctttgcagcaacatggatgcagctggaggccattatcctaagtaaatcaatgcaagagcagaaaaccaaataccacacgttctcatttataagtgagaactaaacatcgagtactcatagtcatagagatggcaacagtagacactggggactaatggcagagagggcaggagaagagtaaaggttgaaaaactacctgttgtgtactatgctcactatctgagtgataggatctttcatatcccaaacctcagcatcatgcaatatgcccaggtaacaaacctgcatgtccccccgaatctaaaataaaagttgaaaataaaataaaatacatacaatctgcatcttcccagaaaaaggaaatggcacttaaaattgaggaatttgacttcttgttcttctctcttcctccagttctgacaaaggtgggcaaagtagggaagcaaagagtgggcaagaggccacgacagtccaaccaaatgtaattaacccatagttaattacacttcaactaatttttaatcatgatttttttttttttttttttgagatggagtctcgctctgtcacccaggctggagtgtagcgacgccatcttagctcactgcaagctctgcctcccgggttaacgccattctcctgcctcagcctcctgagtagctgggactacaggtgcccgccaccatgcctggcaaaattttttttgtatttttagtagagatgggatttcaccatcccatctgaactgagataaatatgtcagaaggcagatatcatttgtctaactcttgcatgattcaaatatatgaatattttagtcacagatttcactatgatattcaggaaaggacaacaaatgcctgagctatctttttagccaggatggtcttgatctcctgacctcttgatctgcccgcctcagcctcccaaagtgctgggattacaggcatgagccaccatgcccggcccataatttttaaagtaataagcaacagacatttgttttcaatgtaattctaatgtaaaacattctcaaagtaggattaaaagaaatcagataagacaaatctataaagagaagacataaaattgtgcctaatatgaactgagataaatatgtcagaaggcagatatcatttgtctaactcttgcatgattcaaatatatgaatattttagtcacagatttcaccatgatattcaggaaaggacaacaaatgcctgagctatcttttcaaagaaccctgagatctgctgctctgttctgataaataatatttgagcagaggccaactaaaaaaacatgaataaagggaagatgacaggaaagcttcaaggaaagataagaattataggcaacagggaatagagcttaaaagcagtgggagaggagacttctcataaactagggaatatcagctcactgacattgcagggtatgtggaaatcaggaatgaattgatttctgggaaactccaagagactctgcctgctctcaatgtgagaaaataaaatggcaacaaataactgacactaatacagtgtcctggagactacaaaatgttaagcaacaggggagtatcttggttagaagcagagatgtttaaatgcagggaaactaaatgacatcattcttatgtcaagcaaaacatgtgtttaagatcaccagtcacacctacaaaatgcttctttacaaaggtcaccttatttatcacctcgaatttagaaggacccaagaacctgctatggttgggatcatcagagtttctaaacccctgaatccatcttcctatttttcttgcctttctcactatgaagcttccctgagccataagataaccactcagaagcgccaagaatgctggtgactcattcattaatcaggccaatgagttaatataatgatttggtcagttcttgaacataatgtcacctctgccacatagcacctgtgaaaactaccttctcctttcatgtagtattataatgaggaaaaaaaaactcaaggagccatgcaaggaaacacaagaagaacagaagtaggaaatacaggaggaaaagaaaggggtattataagttacccaatattgccagaattatgtatacactacctccccccaaaaataaaataggtactgctgtccatctctttacctacatgaatacagacattaaagaggtcatgtgacttggccacacaactcaaatatgttggaacctaaaaataaactaaaaccttctgactccaaaggctacacttgttctactatacaatggtaacataagtgtatatgaagaagaaaaaaataaagaaaataaaacattagatttaaatatgtaatctttgtacgtagtggagaggaagttccttcatatcagtagagtacttaagcatgcgaaagtgaaactgaagactgcccttgttgaatgattatgctattccactcactctacagcacttaatctttgtttcttctgtatacatttgaatgaccatgaaatctcatagtatgcctttatctctagtaaaggttttcaatgcccaccaaatcacaggacctgattcttttcctgccaataggctctgcctcccttctttgggaaactgaatgaacaatgttaacaggaactgggtttagttgactggtccagggtagcagtccattctccatctttagcctgtagggctctaataaaacaaatcacatcagagctgccattgaaaatatgggaggagatttttctccacacaaaaaggacatcataggaagaacccactactcagggagcttattggattcaatgttgtggctaaaattcaagtgtggctgcataattttgaaatgactagtattatgatattccaggacagtagtgagcaccttatactgctcttattttatgctatagtaaagaagatatgcctagggaagtacaaaaaggactcttagccccttcaaataaggtaaaagaacagtgaaatttcccacagtcaactgaactgcaggccaaggaaaatgggaggaaataaaatgagttcaagtatgaaaccaccaagaaacaacaacagggctgacccttaaggaaaaaagagtttcgtgatgcaaaatcttcttccaacaacttgagagaaaggacaagcatatggaacacaagtgtaccaccaaggagcagcttggattgttttgatagtggtgaccatgatttcaccacttcacaacttctgtccatcaccttcatccttcagttttccctaattttctcaacaacgatttccacatttccttcttttctctttcttatgtgtcagttttcaccaaatactgagtaacttcttcccagacctaaggaggaacccgaataaaagaattattttgttgtatacacagcccatgtcacaatgacctactactactgaggctgtgacacatattccttgctcatatttcctaaattacatttcctacttatcccccattctctccagactataaactgcacaaaaatgctgaaagttaagagttctaatatccttgggaatggttatatatttccatcttgcagtgatttcatatccatgtctcatgtttaataacatttaagagttttacatggtctctgattatttcctgattaacagattttccttgatacatttgggtttaaagccttatacgtaaaacagaataaatgatggcttctaaatacatatacgagaaaagattaaatagataagtagattgattgatcatagatcagtgtaactggaattaattggataatatttccccccctaaaggaactgaagaggaagatgaaggagatgactgtctgttggggtctgtggatgagttctggtggtttcctcacatgtggagccatatgcagccccacctcttccacaatgagtcatctttggtggagcagatgattctcaacaaaaaatttgccttagtaagtaactcactttgttgcattgaagtagtgtacactgattggagaaatgaaaagattcttacattgtggcatagttgcgcttttcagtggcttttccatatgatcatttggaatattttggtattgccgcctttcagtatgtggctcttgagtttgtattgagtgctcaccactatgcttaatgttttgaaggatctaatttgagagggacctcacaaaatacaagatttattatgacattatggtcagagcacctaagacatggctcctgtccagaaggagtttcctgctgcactgagaaggcagaaatatgcatgttaaacaattccccaacaaaatgaaatactttttcaagacctaatgacaaaccttacagccacaaaacccacagttcaaagaaataagtatcactgggagtagcccaagatggattcttctggaaataagattttagatacgtcctgaaataagaataaatcttcgggatcaggattaattgaaatgaaatgaggctgagggaaaagagcaggtaggagaccataatgactgtatgaggtaataaagactcaatctaaacagttaaaagcattgcaaacatatatgctgtatggatggaacatttgtttggctgaagcaaggtacaccatgtaatactgaagggtttatattcaggacagggaaatttatagtaaaagtttaaataagcacattatgaagaaaaatgtgcttgtgatcagagagagtaccgaggtacacttacatggaatggttttctacaccaactgttagaactaagaagtttcagttggttctcacagtaccttactcaaatatatacaagacaaggttagaatgtatacactatattttttttcttgaggatatacaagaccaaatactttatggtggcatcaggggcccatatttgtcttttagcttcaatctactcccccaaataaacaaacagcttcaggtgcacctttgccacatattgatattttgtcaagaaagcaagaatagtgctcctccatgctgatactgtgaaaatgttttgatggtatatgcaaactgctgtgagaaggagagtcatcttttttcctaaaaaaataaacaaataataagcagcatgtaaaattggtaaaacggccccagaatttgtaatagaaagtgctaaaactcatatctcaaaacagcagacattaattctgtcattttcagaaatctagactgttgatattgacaatgttaatcactaataaattatgtggggaaaaaattactttgtggtttacttctaaatctgttgagaaaaagagaaagggatttgtgagagacgaaaatacgtaaatacactaaagtaaagcaccagtaaaagataagatactgagaagtgaggagtgaaattgttgttgttgttgttgctgttttgacagctttccaaaaataatgtaccaaagcagctttgataaaagacatgtcattcactgttacatctgctgaaaactagaatagtatctagaaattacttgaacgaatcaatgaatgccaatattatgtttatgtttaaaacatttgcagatatttggaagtacatatcctaagaatatacttaggctgggtgcagtggctcatgcctgtaatcccagcactttgggaggccgaggtgggcggatcacgaggtcaggagatcgagaccatcctggctaacatggtgaaaccctgtctctactaaaaaatacaaacaattagccaggtgtggtggcgggcgcctgtagtcccagctactcaggaagctgaggcaggagaatggtatgaacccaggaggtggagcttgcagtgagctgagattgcaccactgcactccagcctgggcgacacagccagactccctctcaaaaaaagaaaaaaaaaaaagaatatacttaatacatatgctagaacaggcatgcacaggagttacatgcattttttagaattcccaactaaaaagtatcatgtgtaaaagaataattcaaaaacaatatctggtcattcttaaccacctaagtgttaagcaaagcagatttcttagaagcgtcattcctaactacatgttggcaattcaaattattgtttttgaagcagaagagagtagttgtaatagatcttcagaaataagaccaaatatattatttagtgtttaatcaaatccaggacaagtagaatttattttgttgcaagaggatagatatgaaaaaagactgaatccagaaccagtccctccccagccataacaatatgaaagagcacatataaataaggcatttgggaacagcaattagcatataacactcaatagatggcagctgctgtttttatcattatatctagtatcacaaaattgccatctttaatttttgcccaggctcctgaggtgtttggactgacaggtaagagggacaaaaatccttaagtttaaaagtttactttgtattgggatggcatttgtttaatgtgaattttacccaatttctaaatatgtgttaactcttttactttccattaagcattagggttacaaaactgcattgttgctgactttaaagatataataagaaaagatcaagggtttccaattttaacatatttttattatttcttttaattctcaaattaacccggaattgtaggtctatttattttcccattatagatgaagcaactgagaatcagagaaatgcagtgacttattcatgattataaaactcactagcagtataattaagaccagaaatcttaatgctgcataaattgcagtgttaggtcttctaatgtggcataaagtgtgccccctgccgaggcttcctccctagcctcccaacccaattcacaggtgtgaatcaagatttcttttctgctggtaatccaagggaatatctggttatgctggtaatataaaggaaatggagaacttgaggtggaactcacagggcaacttttccctcggattccctgaagttccctaatataggcagagtctctaaaatgttggagggggtcgaaggggtaggggagacaaaaaactaaatctgaggaaatttccacttgaccaaatatcacttctcatgtgtagttacagaatccactttaattcaatgaaaagtactctggagaaaattctacttcaactcactagatggaacaaagcaaatgtttaacctgtgctaatatggcatttctaaattggattatatcctgctcttctccaccagcttggaggctcttgattttaaaatgagtgttggtatttcccaatgaagaaagtgaaaaaacatgcaaagaagcagtgggctgtcttgggagcaaataggtgttcaaacaagaatggaggtcatggatgcaatattcaaatgggtaattgtgttagaggacatttaaagtacccttccagctaagagaatttccgagactgtgatctaaaacttttgggtttcggcctttgctatcatcatttacagccacatacctgctattttcattgagttttaacaaatacatcttatctattatccttttgcacaatgtggacacatctgactcacaaacaaatttgatgtctattttaatttgtctttgaaagctctaacagtttattatgaaaggtcaagtaaatcctttaagcaaacttgcatttgatgattacacccatcaggaaatgcagctttagaggttgaatggaaaaaatttttagttaccaaatataggataattcaggggttaaactgcaatttcaacaggggatttttttttggaaaggtacaaattctgagacaaagattaaatgtatcattaataatgacctaccacaaaatttaaaatatcaactgtacagtgtgtaaaatagaataacatatcattagaaaggtaaaatagtattctatttaaacctcaaaaaagtcttcaatagtatatactctcaattgaagaactgtatctaaattttggaaaatggtggtggttaaatttttaatgataaaatagttaatagatatttctatcatagaactctgccaatatcagatgatacttaatgcttttatagacaatactattaaaagtagtagtagtagaacaatgttcctgataacataaaatcttactgaagattgaacttctaattgtatcatcatcattcttttaaatggtgtcctttttgcctctcttttccaagtgcagcagaacctgttaatttacattagctggaatgtctattgtcaattataaaactttttagattagtgagcatgttaacttttccaatatggaaataaagattatagtatcaaaatgtaatttaaaatatattgaaagacttgctggcttaaggaatatatgacaatcttttaattagtttgcttgccagctagagaatgaatgaatactaccacttttatttcagtgatgcactttataaaaaggcatatgagattttccttttattgacattgaacacaaagtataattctaggtgtcctaatagagaattccagtcgggttgcaaagagtccactcagctggtaggccactttagagtaattcaagcagcacagtttagaaagacattggccattgttcagagcaaaatgaccaatatgatgaagtctataatttacttcataaaatgaatagctgaaggaaattcaagaaggcaagaggtaaaagagaagactaagggatatattatcagggctactattcaactaagagtactggtatggccatgccagttattacaatattgaaatgtgacaatactttacccctatcctgctaccacatcagattcttccccaaggtgtcccaaatctcccccattactcaggaactaaaggggcctggcccagaaagagtctccagcaccgatctccagctgtccagctggcagcagttctgattggtcagtggcatggcatgctggttggtagatatttttcgttatcattccagaagataatcagtcagtcttaagatttagaagagactagaatcagtatatttataaggaaaagtatggaagtcatatagatttaagaagtagagttcttccaatctagataagttatgtatagagaatggtgcttgacatctagtaggtagtaaatgtttgctaaataaaaataaaagtaaacgtttcttctagctcttaagattctatcattactgtattaaaatgtaggttttattattatacaggtatgatgagtccagtagatcaggagatgactgccattgaaaagatcagtttgttattcccagttaccaagagagggagtgtgccacaaggatgcagggccacaggggaagcaccagggtcgctcaggaggcagagggagcaggggggaaaggtgggcaagagcctttactgtggtttctgcgggaaaggtaaggcaagacagggtaagcaggctcaggattggcgactttgaataatttcagtatgctctgaggtgtaagagctgtctttagtcatctaatacttggatctggggtgattagatcaaagagatagttgctcaacatatgagagtctgataaaggaagcagaggagggtaggagctctgaattgcttgatttacatttgagagtgctctcagggtggtgtttgctatctcttggaattgactagcctgagaacagcaatctctccagagtcagcaaggcccagatatcaaagcatcagaaatacagaaaataaagaggcatgatgctttctcccggttatgtatcttgaagcaattccacaggttttcaaagcccctcaccatcccagctgtcatattcatataatttctaatttgtcgttcttatatcccccaatctgaacattattgtccactgatgtggtgttatcaaagcagaaaatggtaaaatattttttctttcatgtgcactttacttctattaatgtagccaaagatcacattacatttttacaccatcatatcacacctgtgtctgcccgaccctctgtccatgagccatttattaaaccttcaagtatttatttttatccagttgatttttcaaactaaatgctagccttggaattacaattgtccctttaatattccatatttgttatatgttcagtgttttagtatatcaacctcctgctaaagactgactctgttatttaaaatgctttatatctttcctagctttgtgtaatccctatattttacaagtatgacttttgcatcttcaagttattagtattgttgaacatattaatatggttagagatttgtggtagagcaatacatatcctttagctgtgttcccttggtatatttctagcaattgtttcacatctattttttcaccagaatagtttaaaatctgtttttctaaattgaaacatcatatctaattatttttagaattatatattttaagtatcttgaactccaagataacactgtcatctactcctaagttctagcacctccacataggtggcagaatcacagaacattagagaaggagtgtttaggatgaagacaagcaggggaaaattggatgtaagtagacatactggattactaataaattaaccaaagaataggaaataaaacccagctttaactaaaccagtggaagcgggatcataaagaagtgagatgtgaaaagtatttctgacatagattcaataagtttttaatcagatggatgatgaggaagcataagagaataacaggtcaaaaataacattagggtttaagcctcccacttttctatctgtgtgtatctctttaaactttttgcaaaggtgaactgctgctttttctttagaagttctgtatttcacctacatgaggataccccctcttacccatatctacagtactgcaaaatgtattctcatttggatatatcatttgaacttttgaaagtggttttgattggaattcttttctttgtaaattcctgtccagattaccttcttttccatcctatgggaagactccatactctctaacaagatagacattgtagaaagaattcctcaattcctttccctttttcctctaacagaaatactagatttcatcttcaacacatttatctggtaacttaaacgatttcataaaaagaaagataaatttagcacatgtactgcatgaaaatagtgccttactgtccaaatttatgtggacacaaaatgaactaacagcctttatgaattctcctagaaactcatactagtgggctggagtcagatgtgggtatgagggtgggggaggtctatttccagatccattcctgctgctcccgaattttcactgctctttccttttacgcctttcatttacttaagatggagggggcacttgcattctgagaggtggttataaacatggcagagatggaagtgatggcagaagaagtaagagtcaatttcacatgagtgctaaccttggctccgctttggcatttttgtgtctcccactccatgttcccatgcatttaacaatttctttcagttttttctttcttttgtaccagctcctgctccttttcaaaattttccatctctacttcacttccaaattttcagcccacacctagattattgcagcagcctccaaaccagcctccaaactagtctccccaatttcccgtttttttcctttaatttttgctcagatcaggaaacgtgaaacttgaaattctgtgactctgtttccgctgcatgaaacagaaccttacggttcagtgagaaagattcttgactctcttaaggaaatgtaggaagataaattgttgagctccaaaatatttactagacattgcgcttagggctttccatacatcctcggttaattctcccaaccacctgtgaggttgcttattctcgtattgaaaatgaagaaagcaaggcttagagagcttatataaattttccagtgaaagctggagaaagggttttatcccaggtctgtctaattccaaagcccatgtaacaaccatggtttgtaaaattaacaagtagccatgccattgatactgttattgctgttacacagatctcataatcaaaatgttattacttctttaaggaattatatttttacacaaattcagaatacaatctgactttttacaatgtttttctcctaaagagctgtctataggatttatgtagtttcttgtgtttgcgatctcagtgctgcaagcattactgtcctggtggcttttataaataccagagagtatacggtggttataacaaaaatcaatatcaactttttatgctttcagaaatattaaacttcacttaaaattagtactatgtagacttcaagattcctaatcaaccttgcatattttcagggagattaaatgtgtgtgcaagtactctgagaatttgaggctgtcctggattatttatagctttcttacctctcaaagaccccaaaggtccacataaacttcaaactctgagaaagctgaattaaaccaaactttcaattcctccattatgaatccagataattttcttttcagttattttgctacagcataaaaagtaaggcttcatacattcattttttttacatttctataaaccttttcttgtgtttacttgaatacaccccagcaattcaaaaataccaacctgggctgtgcaaagtacaagtgtttacatgattcttttgagtattctcacaaaagcgcatcctttagtgctatgtttacttatgagacactcaacaaagatatgacaacacttcaaaaattctggagggaactctaagagaggaaaacaacatgctcagttaaatgaaaatgtacttgaaataaatgttataattgttagggaagactgggagaaaatcactctcccccaaatatttcttttcttaaaggttacaagtgaaaatgaaaattaaagccaagtatgctaccttttatagccctttttcagtattggtactacatttttagcttaacttttgttactggaatttcttactacgtttggcttacaaaatgtcattccatttcttgaaataatttagctgctaacttgggataatacttaaagaggaatatgtggtgttaagaaggggtttttgcttatgttatttctacagctctatcaaatttatggtacaccagaggtattccttccctcccactttatatgtaatatctaatatgtataatagaagaaatgtatattgtttagtaagactttgtttttagacatgattgataatgacaatgtatcttctttgaggaatgtctgctctgaaataagcactctgaattgtttgagaatggaagtaatggtgagaggagtcttagtttaccttggtttttttgttttgcttgtttttgtttcccccaaataaagaatactgttaactaaataaaagaaaatgaaatggcatttgaccaataactttgtttatatccttcatgctggacaactctgtgagatcattagttttattacccttacttggcaaatgagggaattgaggcacggtgaatttgcataacctgctagggtcctgggaccaatgaagagaagcactgagattgagccggggactcaaatctgtgttctcctaaatctgtattctcttcatgatagtatcctactctctatccctaggattcctggtacaaggaaaatttcattgtcatgggtttggctattttgagatattgaaagaataagactcttttcttactgtatactaaattaaacaccatacactcatctcttttccggagatgagtaactccagagtgataaggtgacacttctgttttataagttgctataatgccattcagttttacaagatctcattattaacacctttaacacttttatccaaagacttttgttacttttattttatagccatattttttgctatcttgtgagacaaagaatatctccttcctcaggtttctggatccataggaatatcactacccagagagactcacctaaacctcaagttccagatttttttatgagggtttcattatataggcatgtttgattgtattattggccacatgattgaactcaatttccaactcctctcgcctaccctaagatcaggctgatatcaccttgctcaaagctctcattctctaattacatggtgggacttcctggcatgactaaccttcatcctgagtcatcttgttagcataaactcaaatataatttcagggtatcaccataaataacaaagacatttctatcactcaggaaattccacagagttaggagttatctcccaggaatcagggataaggaagaccagacaaattctttattaatacaacagctgccaacaggggatgattcttgaacccttaaaacaaatctactaaaaacaacattgtcatcacagaaatttttttcacataccacccagcaaaccaaaatttatattataaatcaaggagcaccatgtaagaaaactagagaaatagttagtggtcaaatctataaatattaaccaaatttatgtaactgtgtctatcatattttaggagattattccatccttaagtatgtagaaagaaaattgtatatgggagtttaagtttgttcatggattaaaaatagtacattcgtatttagcatctgaatataaaatcatttctaaaaccacaaagattatgtcaaagaaacacagaattataaacctggactttagtgactacttgtacaacccctttattttacaattttttagaaaatgaaaaatcagattcctgtgcttaaggtaattaattctttcaagatttttcatttcaaaccataccagaaatattatcatttatcacaggaacatagtctaacatttaataatctttgcatgtagtaccaaatctaaattccctaatctaatgatcctgacttgccttattttgttgtaggctaagaagacagtcagcttcctttgaatagcaactttacatatattgggccactctgccaacatccataccatttcttactttcttccagtgattgcggctactacaggactccttccacaggtgccagaggttccacaggttcttataagctgaattgtggtgtagcccatcagtgtcaccttaggaaaacaaatcatcattagaagcttgaaaatgcttcacaaattcaaataattatataattttgactataatcatcctgttgtgctatcaaatagtacatattattcatgctttctaattatattttgtgctcattaatcatgcccacctcccctgcaacatctactatcctacccagtttctggtagccatccttcgactctctatctccacgtgttcaattgtttcgagttttatatatcacaaataagtgagaacatgtgatgtttgtctttctgtgtcttggttatttcacttaacataatgacctccacttccatctatattgttgcaggtaactgaatcccattcttttttatggctgaatagtacaccactgtgtactattatactgtgtgtatgtatgtgtatatatatatatatatatacacatatatatatatatatacacctcataatatacctcactttctttatctattcatctgttaatatacactggttgcttccaaatcctggctattgtaaacagtgctgcaacgaacatgagagtgcagatatctctttgatacactgatttcctttcttttgggtatatactcagcagtgggattgctggatcatatggtagttctaattttagttttttgagaaacctccaaactgttctccatagtggttgtactaatttacatccccaccaacagcgtataacggttttcttttctctacatctctccagcatttgttgttgcctgtctttttggagaaaagccattttaactggggtgagatgacatctcattatagttttgatttgcatttctctgatgatcagtgatgttgagcaccttttcatatgcctgtttgccatttgtatgtattcttttgagaaatgtctattcaagccctttgtccattagttattcagattacgagattttttactatagagttgtttgagtttcttatatattctggttattaatctcttgtcagatggggagtttgcaaatattttctcccattctgtgggttgtctcttcactttgttgaatgttttgtttgctgtgtagaagcattttaactcgatgtgatcccatctgtccattttttgttggttgcctgtgcttgtggggtattacccaagacatttttgccaagaccaatgtcttggagagtttcccccatgttttcttatagtagtttcatagtttgaggtcttatgtttaagtctttaatatattggtttgatttttgtatatggtgatagacaggggttcagcttaatttttctgcatatggaaatctagtttttcaagcaccatttgttgaagagattgtcctttctccaatgtatgttcttggcacctttgtcaaaaatgagttcactgtaggagtattaatttgttgctgggttctttgttctattccattggtctatgtatctgcctatatgccagtagcatgctgttttggttaccataactccttagtataacgtgaaatcaggtaatgtgattcttccaattttgttctttttgttcaggatagctttggctattctggatcttctgtggttccatataaatttttggattatattgtatattttgtgaaaaatatcattggcattttgataaagatttcattgaatctgtagattgctttgtttagtatggacattttaacaatattgattcttctcatccatgaacatagaatatctttttatttttttggtgtactctttaatgtctttcatcagtgttttatagttttcattgtagagatctttcactttttggttaattcctaggtagttaattttatttgtggctactataaatgagattacattttgacttgttttttacattgttcaccattggcatatagaaatgttactggcttttgtatgttgatcttgtatcttgaattttactgaatttgtttatcagttctaatagttttttggtggagtctttaggtttttccaaatataagattatatcatttggaaacaaggataatttaactgtttcttttccagcttgaatgcccttcatttctttctcttttctgattgctctagctacgacttccagtgctatgttgaataacagtggtgacagtgggcatccttgttgtcttccagatcttagaggaaagcctttcagtttttcccaattcagtatgacaccagctttgggtctgtcatagatggattttattatggtgaggtatgtaccttctataccaagtttgttgagggttttttatcatgaagggatgttcaattttatcaaatgctttttcagcatgaattgaaatgattgtatgatttttgtccttcattctgttgatatgatgtatcatattgattgatttgtgtatattgaaccatcctcacatcccaaggacaagtctcacttggtcatgataaacgatctttttaatgtattgttggatttgcattgttagaattttattgagaatttttgcatcaggattcatcacagatgttggcctgtagttttctttttttgatgtgtctttatctggtttcggtatcaggataatactggcctcatagaatgagcttagaagtattccctcctcctctatattttggaatagtttcagtaggattgctgttagttcttctttaaatgtttggtagaaatcagcagtgtagccatcaagtcctaggtgtttctttactgggagacgttttattatgtcttcaatcttattacttattattggtcttttcaagttttggatttcttcatggttcaattttggtaggttgtatgtgccaaggaatttattcatttcctgtaaattttccaacttgttggcatatagttgctgatagtagccactactgatcctttgaatttcggcagtatcagttgtagtgtttcctttttcatatctgattttatttatttgggtcctcatccttttttttctttgttaatctggctaatggtttgctgattttgtttatcttagaaaaatcctttttgtttcattgacttttttgtattgttttcttcatttcaatttcgtttacttctgctttgatctttattatttcttttctcctattatttttgggttcagtttgcacttgcttttctagttctttaagatgcattgttagattatttatttgaaggttttttcttttttgatgtaggcacttacagctataaactttcctcttagtgctgtttttgctgtatcccataggttttggtatgttatgtttccattatcatttcttttccagaaagtttttcaatttccatcttaattttttcattgacccactgatcattcaagagcatattgtttaatttccattgagtttgtatagtttccaaaattcctcttgttgatttctagttttattccattgttgtcagagaagacgtttgatattgtttagatttgtgtaaatgttttaacacttgttttatgacctaacatatggtctatccttgaaaatgatccatgtgctgagaaaaagaatgtgtattctgtagcctttggttgaaatgttccataaatatatattagattcatttgttgtatagtgctgattaagtccaatattttttgttgagttcctgtctgggacatctgtccaatgctgaaagtggagtgttgaaatctccagctattattgtactggggtctatctctctctttagctctaataatatttttttatatagctgtgtgctccagagttgggtgcatatatattttaaattgttatatactattacggggttgactcctttatcattatatagtgaccttctttgtctcttctcacagtgtttgttttcaaatctattttgtttgatataaggataactactcctgttcattttttgtttcaattggcatggaatatcttttcacatccctttattttcagtctatgtgtatctttataagtgaagtgtgtttcttgtgggcaacagatcatagagtcttgtattttcatccatttggccactctgtgtcttttgatcagagagtttagttcacttatatttaatgtgattatttacgtgtagaaacttactcctgccactttgttatttgttttctggttgttttggggtcgtctctcttttcttttcttccttcctgtcttcctttcagtgaagataattttctcttgtgctttaacttcttgcttgtttctgttgtgttttttgatttgaggctatcatgagactagtaaatactgtcttgtaactcattattttaaactgaagacaacttaacactgattgcataaacacagaaagaaaactctacactttaatttcatcaactcactttttaattttttgttgttccttatgtcttgttgtactgtttatatcttgaaaagtttttgtagttattacttttgattggttcatcatttagtctttctacttaagataagagaagtttacacaccaccattacaatgttatcatagtctgtgtttctctgtgtgcctactattaccagtgtaccagtatttttaccttcagacaatttcttcttgctcattaatatcattttctttcagattgaaaaactccctttagcatttcttataagacaggtctggtgttgatgaaattcctcagcttttgtttgtctgggaaagtctttatttctccttcatgcttgaagaatatttccaccagatatactattctagcataaaagttcttttccttcagcactttaaacatgtcttgccaccctctcctggcctgtcaggcttccactgaaaagtctgctttcagatgtattggaggtccattgaatgttatttgttacttttctcttgctgcatttaggattctgtctttgtctttgactcttgggagtttgattattagatgccttgagttagtcttctttgagttaatctgcttggtgctccataaccttcttgtactcgaatgttgatctctttctccaggtttgggaggttttctgttattcctttgaataaactttttacccttatctgtttctctacttcttctttaaaaccaatatctctgagatttgccctttggaggctattttctagatcttataggtgtgctatgttgttttggtttggtttggtttggtttggtttggttttcttttgtctcttatgattgtgtattttcaaataggctgtcttcaagttcactgattctttcttctgcttgatcaattctgctattaagtgactctgatgcattcttcagtatgtcaattgcaattttcaactctagaatttctgcttgattctttctcattatttcaatctctttgtaaaattaatctgatagaattctgaattccttatctctgttaatcttgaatttctttgagtttcctcaaaatggccattttgaattctctgtctgaaaggtcacacatccttatttctccagtattggtctctgatgccttatttagttcatttggtgaggtcattttcctggatcatcttgatgcttgtagatgttcatctgtgtctgggcatagaatagttaggtatttactatagactttgcagtctgggcttgtttgtgcttgtccttgggaaggcttttcagatatttgaagctgcttggttcccaagcccaatatcactgtggtccttgcagactcgtagaggtaccatcttggtggtcttggagaagatctagaagaaggctctggattaataggcagagattcttgttcatttcccttagtttctcccaaacaaacagagtctctttctctgtgctgagctgcctggaactgggattatgatgatgcaaacacccctatggccactataactgggactgcactgggtcaggcctaaagactcagtcagcacagcactgagtcttgtccaaggcccactataactactacctggctaccacctatgttcactcaaggccctaggccactacaatcagcaggtggcaaagccagccaagtttgtgtccttcccttcagagcggcaagttcctccaggccccaggcaggtccagagatgctgtctgggagccaaggattagagtgaaaaacattagaaatttgcctgacattctgttctactatggctaagctagtactaaaaccatactataaagtacttcctgctcttccttcccctttccacagggagaagagcctctccctctgagcaccaccaccagcagcccttggcagggttctgtcaggccaccggcaattttcacttaagcccaagggttcttctgtcagcttgtggtgaatgctgcctggcctgggattcaccctctgcacagtgggttcccctctgacccacagaaggtccggaaatgctgttcaagagcctaggcctggactcagagaccccaagagcctgcttgttgctctaccccactgtggccaagctggtacataaggtgcaaaacaaagtcccctttacttttccctatgcttttctcaagcaggagtctttcaccatagtcaccactgctgggaatgtgctgggtcacacatgtagtaagtgcgtcccaagtgcccaaggctcacagcatactccctggctatcactgatggttattcagggtccgagggctctttaatcagcaggtgataaatccttccaagactggatctttctcttcaagacaatgggttcccttttgtcctagagtatgtcaagaaatattctctccaggagctagggcctggaatgggggcctcatgactgcctggtgccctctcctactgtagctgagccggtatccaagatgcaagacaacgtcctctttactctttgctctcctcgccttaaacagaaggaaggacgcactttcattgctgtgagttgcacttcctgggattgggggaggagtggcgcaagcaatcctttagctgctctggctagtgtctccctaggtcacatgccaccctagtccactggctctaatcccaatccagcactaggagttgcctaggaattgaagtccttgtgtgctagactgtctttcaagtttaccaaggaccttagagcatgttggcccatggtggcaagacttgacaagaaactcaagctctaactgatgacatgcataacttccccttggctaagtctggtccaaatgatccctccatgtgtgagcaaagcctgagcagagcatggatttgctctctgctatgacagggtagtactgagttcaatgtaaagtccccctgtcactgtgctctccctcccccacataaatagaccctccgcacttcatggccactgccgggagataggggaaaggtggcattggcgattcaagactgtctctccaaccctcctcaatgccattttcattaacttttatgaagataaaacgaggtactgcgattgcttacctgattttttgttcttctgatggtgcttttctgtatgcagatagttgttaaaatttggccttcctgcagggggtacaaatggtatagggttctattctgccattttgctctgccctcataatttttaactgcagtctaaaaattgctttcaagtattatttacatagatattaaaatttccctgatagttaccatatgtttattcttcagacgaacaggcagtgtaatgaagataattgagaaagtgaaaattggaatgagaaggaggtagtcagaatcagatcatactttttcactagtatttgttgagtacttgccattggcaagacactgagtatatcgcagtggataaaatggaacctaaatttcatgaaccttattgtttaatgaaaaagagagatattacataaatgtcttttctatgcaaaaaaatacatgcttacaaactgtgctgtgtactatgaaaaaccaaggaaagctactaagagaagttttaatgtcgacttcatttagattggcacttgtcagtaaagtcttctccaaagatatgacagaataaattaccttcagatttatccaggtgaagatttggagtagaaacatttcaggggaagaaaccacatataggaagatgctgaggtagaaaagtgcttggtgagtttcagggaaagtttcatgtgactaaaattcagtgaaggatggagggtggcacaagataaggctagacaaagaagcaaggatcatatgcagcgcttgcgatcatgctaagaattttgtaatttaagtggaaagggaaatcagggaaagattttgagtagacagtcacataatcatatttgtatcttttaaatattactttgcagggaatgtattggaaggaagcaagagagggaatgcgattctatgccaaaaggcaatgggataagatggtagattcgactagggtgatgataatgatagaattgaagaaaagtagctaaatttaagatatataccagagatagtactgataggacatgacagtggactaaatttagaaaagaggaaagaggaggtgtcaaaactatctatctttcaacacagcaacttgttggttgatggtgtcatttaatgacatggagaaaccctgcagaaagagaatatctggtagggctgagatgtggaaatcatgagttcaactattaagactattaattccacttgtgatccaaatacttcatttacgttttatagttacatagccagattcctcagtgtttttgaaccatgtcctccactagaaaaatcttaacatagatttcagagttcctagatctaagatgctactttcaatcaaggatcaatgaaaagactaattagaattaacttttaaggtagactttttgccacagattaaaaaataatatgtgcttaatctcaaatcgaacaatccagaggagagtaatcagccaaaaatttagcatgatggctaaagcttttaaaacctgatagtctgccttccggatcacactacctgcaatcttaacccaaacttttctatacaataacgtttcaggtgttctctctggtgatgaatgcaaatttgggagcaaatttatgttgccttcttctaaaatgaatttaaaagcagccccctactaactgaatgactcacaagctggaactactcggcagtggctgagcatatttggaggaatcagaagagaagcaggcttaggaaggggtagtggggtagaagtcagagttcaccacaggagtctcatgagaaagaatcccaaaatctacagtgaaagtagaaaatacagtctgtctcttttagtggaaaataagtggcccagtagtttcataatttccacattatacttgagtggtaggatcatagcatctaaaaacaatagaggcagggtagtaatgacaacaataattttaaaaatccattaaatgcatatcatgtttccagaactatactatcttccaaaattacctctgaacccctttgaggtaatgcccttatgactagcattttagagaacaggaaacaaggcttagagctcataggtcatttgccaaaagccatgcagttggtgaatgagagcatgaacagccagatacgtctgattccagaagcgatgttttctgctactatgccacactgcaccagcacacaaataaaagatgaaactaaaaaacccatttagtcaggtgtgctggtgtgcatttgtagtcctaactactgcaggaggattgcttgagcccaggaggtcgaggatgcagtaagctatgatcaccaccactgtacaccagcctgggaaacagtgagatcccgtctcaataaattaactaattaattaaaaattgcagtagtttttagtgttaaagctaggaaaaaaaagtaaaaactgtatatacattggttgccaaatatttttaaatccaaaataagggaaatgtctctgctatgctgggccatcctttcatgccatgtgggttctgaagacacagctgactactcgccgttattgaaaactaccttgagcttttgaacagcataatttcttacaaatttgcagatgcttgaattttataacatagctcttgtcattgtgtatttcttcccacactcttcaaaaagttgttaacctcctcagcaccacataacatttccatgtaacaaacctgcacatgcacccctgtatctaaaagttgaaatttaaaataaaagaatactatttaacaaccaccagaaataataaagttacttcagcacattttttaaagttgttaacctataattcattttttaatgtttgtgatatgaattcatttttcttcatctggtctttatcaccatacccctagccttcaatcactttagttgagcacaaattatgtgttgataagggatgtctagtgggaaaaaattagtttagtttgagtttttaaaaaccagtacgaaaaaagcaatgagatatttcaattcaatttttagtggagttctaaatatgatggttatgtagttatggtaatttctgcaaatgatgcaaataaaatgaagaatatgaaactttacctctcacccttcagaaacacaggaatggtccactcaacctccaataccacccatcctctttctcacagtagcaagatagtggctcccgtttttggcatcctcaactacagctgacggaactgagttttgaacaataaacagagtttacgagataagaaaagggcattccaattgaggaagacagtgtgtacagtatacagcaatgacatgaaggaaatcatcagaaattggggcgatgagtgctgatagaagatgaggctatataggtaggttgggaccaaattttgagggccttttatgctgtatcaaggaatttgaacaagtatttaggtaatggcaaaccactggcaagctgttttctttctgcattcaggcacttcatatactttcttcccctcctgttcttatttaggtttaaaaacaaagctaaccatacctctaactttttccatatcagttggctgcatatttctgcaatttaaaccatttagcagcctgatactatgattctgtgtatgtgaaactgttatttggcatgaagacagtcattaatttaaaagaacctatttgagtggaatttttgaagattttttccaagcaattgaaaaatataaacagaaaaataaaaaataactttggagaaaaaaatacctgtcaactactgaagccatgggtgttctatttctaaaagacacgtttcattttgtattactgtgtaattttcctctatgcctttttttttttaactggagtcattttatgtacaagagcttgacttcaaatcaactaagttcccagaatatttggctgtttcagtaccttcaactttcactataagggcttctacttcaaaaaaaattactctgttgaattttaccacattatccaatcaaaagtgtgtgcttctcctaaggcagggaacgttgttactgctggcccacatgctgaaaggacaacagaaatgtggaaaacttggtagaaactgtagagcagacaaaataaaatcttaacagcagcctaatgaacttggaaggtgttctgttcctctaataaacattggttttattttgcgggaagtgcttagttttgtttgtaataagtgtctaacatttaacttgttgacgtatgggcaataggaaaacaggtggctacgacaaggatgtgcaaaatagaggctctttcaaattattcattaaaatcactagatctgtctcaccacccctcaaacacagatgcatcaacataaggactggtgaaatggctaacaggcttcatgacgtctagaggtgttaatacttatatcactttaattttaccacacaattaagtaatgatgcatttaaatatatatatttacagtacatttgaaaatcttactgtaaaaataggatcaagataaatctttacacgctccaattaacatttgcttggtcttaggagcacggcattccaacggacatgggctacgctgtggcccctcaccattcgggcgtctaccctgtacatgttcagctttatgaggcctggaagaaggtctggaatattaaaatcaccagcactgaagaatatccacatctgaagccagctagataccggaggggttttatccacaaaaacatcatggtgagcttcctccagtatgcatagggtacaactaattctgcaagatttcattcctcacttgaagaaagaaaaacacaaatgttagcagcataaatgtaggaaaagctccatgctgcaggaagcatatttgtcatatctaagcagaaaatgttttaattaaaatcacttcttttcaattcttcaaatataactgaaaaaggttttgttactgacattaccactggtaagcaggcactgatgttaaaatactaaaaaaaaattacatttaacttgcagataatttttagtagacatcacttcttcaaaatgttattcagtatgaaaaactaacaccaactctgtctatattaaccatgctgctctttgacaagccagtcaaactgtgttcttctatttaccatgccaggctaaaaaagaactcaaccatttgcagccagaagccacatgtgaagccctgcataatcattaacatataataatatagagtaaaaatgacaggtgatgctaattaaatcatttgcatacaccatctaattctatcctgggcttctctgttttgttttttacaatttcagcaaatgtatattgtcaaaatatgctactacctcccaaagtaagcaattaaatcctaatttattcccaaatcagaaaatcctaagaaagtcctggtaaagctaggaatgggcctcctaatttagaatcacacactgggaagaaacaccacagaagaacactatgtgatgagccaccgtaacactctgttgaactgatatgtctgaagagatgtttaccctttagaattaggttataactgacttcttttcagagagtttttcaatgtctgcaaaaattacagagtggatagacatatagcttagatcatctcccatcttgacttttccctcaataaaaactgttgtaaatgctagacggggacataatggccacattttatcccaatctgcccttcctctgtactgaaaatgaacctactgtggctcaagctgccagaattctgaccagagggagtttagaagacctgggatatattttttcatttctcctgaaaacacatttttatctgtattataaatgcatgaatcatgcaggtaatcaaggctctaacagatttcctgttttgatggaactgtccctgtggatctgcttttgcagcaatctgtggaaacctatatttggcttgtgggctcttggatgagagtttccaagtgggaaatgttcagcagacagttgattacacaataagcgagagaaaataagactaggagccatccaaatagagaagcaagtagagaccacaggagccaatatgccctcctagggagagaatgcatctagaaatagggaactgaggagtgaactttagatcacactcttattttgctgtatgagagcaacttttttctgatgatccattcccaaatccaactcaaaaggtctcattatcttcccttcgaaccggctattgattgtgccattatccttaattcagttctgtaattcaaacatcattctatccccctaccaccacttccaatcagtgtctatatttcatcaataattcctttatatcttttttatttcctttcccactgccaccatcttaatttacttccttgactttcatgtgtgaacctggtgctgcttcctactttatctatttacaggttccatccaccacctcactgcagtctatcccatagacagtgccaaccttttaatctttctaaaatgctgcctttatcctggccttcctaaccttgattagttccagttgcttccatatcccctaatgtgcccttcaggtacctgaaaaccatctggactgtctacctttctatttcctatttccctatggctgaagcacactcactccaaccaaaccccataatagtattgctgttaccatgcctgtgtcattctttccaccttgagagactttctggccactatctacctatttctattccctttattcttcaatatcaaatcccatatcttaaataattgaaaacaaagcaccttagtatatagcaactcaatacctaactcatacctacagggatcttattctcctctgaattcctacaacacatcattttgtattttcatcaggaacataaacaccaattacactttaagctgtttgagccctaaccaaagtctctggacccctagttttattgcattttcaactgagtcattttccttcagccaagacctgatggaaaccagcactctctactctaatctctggttgttgaatatgactctctggaaagaaccagtatattagtccattctcacattgctatgagtaaatacccaagactgggtaatttataaaggaaagaggtttaatggactcatagttcagcatggctggggagacctcaagaaacttacaatcatggcagaaggcaaaggggaagcaaagcaccttcttcacaaagcaacaggaaggagaagtgcagagcaaaccgggaagagccccttataaaatcatcaggtcttgtgagaactcactcgctatcacaagaacagcatgtgggaaactgtccccatgattcagttacctccacctggtctctcccttgacatatgagtattatggggattacaatttaaaatgagatttgagtgaggacacaaaccctaaccatatcagccagagacctctaaaaaattagactacacatcctatctacttactgtttttaatggaaatgcccattggtagagactcattaatcctgctgtaaaccctctaagtggtctttattggtatctccccagaagtatttgttggcagttgctcctgaatgagccttaggtacaggatattgacttcagtccacattggccaagattcttgttgatcatggctttcataataaactcctagctattttcagcagcaatagggttctcaggggttcatcggcatctcaaagtttgactttgatactgttacattcccagaaccaattctagggggcagtccacagcagaatgcctaaaaatgtttctcatcctttccgtagcataagaaagctgtttcaaggaacatgctcatcattcggtgccactgcatttatggagcaaggcagtggaatatgacccttatcacactcctgatcatctccttagcctcctgtagtggtccactgactcccgctagggctctctatggggttcataccctcagcaggagtagtgctcctgcagttgcagggtaaagcctgccacttcctcttcactgcattgaaattcaaataatttgagaaatagacaaaattcaaatatctttttgcttctctcttcgttttgcacagaatcagctaggcaatcaagtcccaaagatggctctgtatatatcctataattttccaagcaaaatattcaaactgaaccctagaagtgattcagtcatagtcatacacttttaaaatgttaaatgccatttaacacgtgagcattttattatgtagcttttgggtctttcccattaccccaatatagcttaaatccttcaagagtagaaaacatatatctttctgttctctcacatgggctggcatggaactaggatatggatctagtattctagcataaaactaactccatgcaacctattaacatacagtccatagctagttccactagcacttaactaaatctattctgtgggctagcatagagtttagaataaatatttgttaaataaatgaataaatactatataaagtatttattccaaatgctttccaaattcaaaatttcatttttaatttccaaatattacatttataatagttgttaggaaatatatttaattccattagaatgcatttgcatttagttgttttttgttattatttttgtgtatagataggatcatgaggatgcataatgcttttaaacatagacatcatcagagctaatattttatacttaaacagaagttttttaactattttattaagataaaatagcttctaaggatataacttctaccaacttaccaaaataaataggatatatagagtttttatttatgcagatatactgattgagctgtctgtccaaggactagattatacaataggttgtattatataaccagtattatataatactatccaagggctagacgaaaatttattttaatacacattcaaactaaaataaaaaataaaaataaaataaaataaaataaaaacactagtatatttctacagggttgcaaaacatgggaagtcctggacaggtaatattttgaaagcatttactgaaccaaatgtgctttaagactcaagacataaaacatgaagattgatttacttaggacaataagcagaagacctgtccctatatgattttgtaacatttgtagctctctgaagtatactcattaatgttctgctacttcaaatgtatagtgacaaacacaggtcaccatgaagtcattgtaaaatattctgcttaaggctttattatcttgcacaactttaattcacaccttcttttataattgcaaaaggctataaaaatttgaaaaaccttatcacgagtgtatataattgaagcagataatacatatatacaaaggatgaagagaagacctcttactaaatgaccttttatcattttgttgttacactttctaaaagtaacaaaccaagtgaataatctctttcttacagtaggaactggcaggcttcacacttagaatctgaggtaattactatagcctgcagtagtcctttcagacgagaacagatactgtgatttgtgtctcaaatattcattctaatttaaaatgtcattccctaagaagcacattgagttgataactgacttcattttctaatgcatggcagaatttggcagaaaatattttcttaaaattattgcctattaagattacagtatagcacagacaatccaatactttttttaaagtctcatttttacttctttttttttaatctcttaagatgctagaacctactaggcttcataaaagaagtactcactttgatatttaaaacagacaagtagctaaaataacacaacacctattttagttttaaaatatttcttcaactttcttcactattccttccatattaacatcaccttcccttgcctagagtatgatagattgtccaggccctggttagacctgaataattcactagcttgtgcatcatcttgtgtgagcaaaaagctaagtttcaacaaattgattggaaaaaaaaaagcttttccttacttttttcatttttccttcaggttctcccaagacaaacctgtgggcttttcactcacaccattttctacaaagaatatccagggggtcctaaagagctggataagagtatccaaggaggagaacttttcttcactgtcgtcctcaaccctgtaagtactttattctccaaataaatagtgaaaaatgatagggctggcaaaaattaccctggcaaagaggctagggattgggcagtcatcagccaagccaatatgaagttctagctctgaaacagtagtaaaaactaaatggaaccacatctagaaatgggaacaaaccaattctacaagtagcagtaacatgaggaactcatggcagaaccagggaagtgctccagcggatcctcctttgcattgcaaagtgatcagaagctttcatggggaataaaatttttcacctgtaaaactctcctatttccacggggaaccatttttttttccatttagacaacagttacctctattattatttttattttactatttaaagttaacgtagaagcaaaatagtagaggaattaggtaagcaaatctagttatattttctacttcatgttagattcgtcttgctaggtcataggctgaagcagagcaggcctatttaatgggctacttttttttttttgagatggagtctcactctgtcacccaggctcgagtgcagtggcgccatctcggctcactgcaagctccgcctcccgggttcacgccattctcctgcctcagcctcccgagtagctgggaccacaggcacctgccaccacacggggctaattttttgtatttttagtggagacgaggcttcactgtgttagccaggatggtctcaatctcctgaccttgtgatctgcctgcctcagcctcccaaagtgctgggattacaggcgtgagccaccacgcctggccgggctactcttttacttcttcatacttgtgtgtcagctccacaatgaaccatttgcatatatttctgcttgaggcaagtattagaaagttgtgtagagaaagaacaaatggaagtaagctgcataaggaaaagaagggattttatttcccttttgaaaatcactatcataaaaagtaaagctaagtttatttatcagaagatgtatgggtttgcccttggcattggcaatattcaagatggaaaaaaaattattatttccaaatgtaaaaaaaaaaaattatcagtgaaaaaagttggatagggataaattgaataaaatttgcaaaacccctctcttgaccttagttttatagtccctgcaaataaaattgcagatagtgttcaccatctacttgtattcaaggagatttattgtgctcaattctgcttgtattcatcactatacctatgttttaactcctagaaaatgagatagaagaaagagtaactcatctttggacaaaacctgctcgtgtattcaaaaatggggatagtttggaggaatgtgatatttggacttttgaaagtttatcaaccttcagatcccaaaaatacaaataagtctggtttgaacatcagaaatataataactcttctaacttacctattttcacaaatggaagtattttgagtctccttatacagctttcttctcttttttctcaattcagccagtacagtaatatacagtcaaaaagagttaaaccaatgcctggttatgaactgaagaagcagttaaaacactcttaaaatgctaacattttcaccaataattttaagcactttaatctatcatctgtaaaattctgatgtttcacatttactttcatcatagagcaacagaagtattaacaaataatcatgaacttcttaaaagttcacagtaggattttatctccgaatttctaaaccaaatgagtttcatttagtgtggaagaaattcaaagttaaatcattcatgtacaatggatttatactaagaatttcatccattttgtgataagaaatattacattttttattaatttaaaaaccaaactattgtctttgtttttaaaaaccttacagtaaagtttatgttaatcttggacactaattggactaactgagcaaattccttaacaaacctcgctatttttcaggcctttatgaatgatatttggcaattttatgtcttgaggaggagattcataagaataaaggtggcaggttgggggagccgcacaaaacttgttctttcctgattcagaaaactttcagtagacaattactttcagaaaaaaatccctagactcaaaataaatgacaaatcttgtcagatgccacaagacagacaaggaacccaaagctaacgttatctggcacaccaactctaatactggaagcaattctactcacctggaaacaaaaggttaagaagcccacatctggattcagcccacatctagccggaggccggactactataattagttagtgatgtctgtcttggagaacagagtaaggagtagtggcatgtttcccatgaattctccatcctgaaattaagtgcttggacaaagtttgtattgaaactaaggaagatccagatgcagtaaggcatgccagtaatttagcagatgacattttttattaggccaggatggaaatgagaaaaccttgatggaatcaaagtatacattagctgcaggaaagtcatgaattttaattatagtggatttgaaagatagccattgtaagtttaagtaataccccaggcctcaattagaagtgccattttctgagaatgccaagtgaggttatcgtttactacaaaaagatagatgtgtattggaaacatggcacttaaatacattcacatacatttgagctgaaaacaaaaatataaacaggactttaattaatgagggttttaagtttttcccatatgtcaacataatatcaaggtgctatactaacttaccagtactggggtgagaaagggttacaataaggtgcccctcagagttaaactggaaagatcacagcaaaggtaaaaaaaccgttaaacagaataactctctggcctgaaatgttctaatgttaccaaaatatttgtcatgtaaaagaaagaagtatcaatcaagtgaatttaacaaaatagagaattacaaagacaaatgttagcactgtctggggaagagaaaactttggtcatctctaaatgagcttttccaatgtcacaggcctggacaactctcacgtaagctggatgcaggggttttgattaatagactttgaagtttagatccatttgggggaggtggacctagcaggctatctgagcctggaaccattgagatttccatttttctaatactacttttcctgattctaaacccaactgatgacttcctcattatggtttactttcccacgtagatcctactataggaaaagaatatgttaatcataggaacttgtactctctgggacaataatttgcaatataattttataagttttattttaattgatcaatacttcccatgtaaccggactacctggaaagagccctctaattgtatagacagtaattgaagagtatttcagttcctctctaatttataattacccattttaaactaatagatggtatcctgcttttattcattggtttcatgagcttttgctaatctgattctgccccagaaaaatactgactctctctgcaagtgtactgaatcaggttttggagcctgtcggtcagaaacagacctcagagtgttcgttgattaaggatggtaatgagagttacctcatgatataccatgggagagagccactggaagtaccccagagtcactgctagcaacacacaggcatgagatttctacacaaacatgtaatatacctagatacaaacattcttgatcaatttacaattatacagagtactcatatatattttcaaaaattgtgatattctatttactttagatacttatataaaataaaatgcagaagggtactaagaactgaaacttatgaagataacaaaaaggattaattggcaatgactgcatctgccctcaataaataaaactctatatatgacgtatatacttagacaaaaggaactagtacgactatagtgttcattttaacaagtttccagttccacctatcttaggaagatgcagtaatagttaattaatatgctgattggaaaagttccggcttagacaggtttgtacttcttgtgggagccatattatcatctcatatgcactaaacaaaaatgtcacttttttgcttcagggttcttatctctaatcacaagatgttatgagtctttgcttatgcacttgttgaataaatagactccaggtattgagtcattaacaactatagatatagaacactttgcctcccttcaacatgcttgataataaagtcagtgcttacctattaatccaaaaaagcagctgtggattgccacaagattcatgccaatgggccaggcgcagtggctcacgcctgtaatgtcagcactttgggaggccaaggtgggcagatcatgaggtcaggagatcaagaccatcctggctaacacggtgaaaccctgtctctactaaaaatacaaaaaattagccaggcgtggtggcaggcgcctgtagtcccagctactcaggaggctgaggtaggagaatcactggaatccaggaggcagaggttgcagtgagccaagatcacgccactgcactccagcctgggcgacagagcgagactctgtctcaaaaaaaatgcgcgccaatactacacttgcttggaattcaggtgaagcaaatccctgaccatgtaacaatattgtgcctccttcatcaaaccattaaccatcccacagaaccattagctaacccctttatgcacgcattttattaaatgctttttgtctctctgtttctcaatttgatatagcatacttccaccataccctacataccctcctactcaaatccctaaaagttaaatctaaattgtgtttctcttattataaacatggatgtgaatagagtgaatatcttaaactaggattaacacatagattgattacaactaaaataaataaaacagaattcactcaagaagaaagcctttataaaaagaaattaacccacattgaaattgaaaaaaaatactgtaattttatatgtgtatgtgcttttctctaaaattcatctgaaaggaaataatacattgacctaatgggaagttttatgtttctttttttgttcgctagttctggaacacattctaataataggagacccttcgctgaaaaataaataaatgataataactttagacctagaaaagtaattcctggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagcattatttctgagggctctgttctgttccattgatctatatctgtgttttggtaccagtaccatgctgttttggttactgtagccttgtagtatagtttgaagtcaggcagcgtggttcctccagctttgttcttttggcttaggattgacttggcgatgcgggctcttttttggttccatatgaactttaaagtagttttttccaattctgtgaagaaagtcattggtagcttgatggggatgacattgaatctctaaattaccttgggcagtatggccattttcacgatattgattcttcctacccaagagcatggaatgttcttccatttgtttgtatcctcttttatttccttgagcagtggtttgtagttctccttgaagaggtccttcacatcccttgtaagttggattccgaggtattttattctctttgaagcaattgtgaatgggagttcactcatgatttggctctctgtttgtctgttgttggtgtataagaatgcttgtgatttttgtacattgattttgtatcctgagactttgctgaagttgcttatcaacttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgaaagagggcatccctgtcttgtgccaatttttaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattttgtttgccagtattttattgaggatttttgcatcaatgttcatcaaggatattggtctaaaattctcttttttggatgtgtctctgcccggctttggtatcagcatgatgctggcctcataccataaaaaccctagaagaaaacctaggcattaccattcaggacataagcacgggcaaggacttcatgtctaaaacaccaaaagcaatggcaacaaaagacaaaattgacaaatgggatctaattaaactcaagagcttctgcacagcaaaagaaactaccatcagagtgaacaagcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatagcaatcattcaaaagtcaggaaacaacaggtgctggagaggatgtggagaaataggaacacttttacactgttggtgggactgtaaactagttcaaccattgtggaagtcagtgtggcaattcctcaaggatctagaagtagaaataccatttgacccagccatcccattactgggtatatacccaaaggactataaatcatactgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatgcatgaaattggaaatcatcattctcagtaaactatcgcaagaacaaaaaaccaaacaccgcatattctcactcataggtgggaactgaacaatgagaacacatggacacaggaaggggaacattacactctggggactgttgtggggtggagtgagaggggagggatagcattgggagatatacctaatgctagatgacgagttagtgggtgcagcgcaccagcatggtacatgtatacatatgtaactaacctgcatattgtgcacatgtaccctaaaacttaaagtataataataataaaaaaaagaaatattaaaaaacaacaacaacaacaaaaataaaataaaataaaagtaattcctgaacatgcctaatagtgagtactgcctgagatgcttgaattttagaaatcaaacttaatgcatcagaatctctaggattgacctaggggctctacatactcaccatgcgctttaggtaaatgttaggatcaggcaaatagagaaatattgccgaggaagaaaatggagaagtaattttggtaatcaaagattaccaaaaactgttatagaaattgtaaacctagaatcaaggtttcagaatggaaaatggctccaaatctgcaatagaactttaaaaaacagtaagaattaatgttttcctaagtgaccagagaactctaccttaaactggattttaaaatagtgtttactgctgttcatcccaaaaacttagtgtaggggtcaccttcctcaggaaactttttctactctgatttagaggcccctcctgcgtttctatagcatcctctgcagactctttcaaagtatttattatcctgcatcataattgtgggttgtattagcctgtacgcttgtggttgtagagaatgtgtctgtcatttccaaaactatcccagtgtctaaacataatatgttttacctagttttttattttgcatatatttgttaaggaaaagaaattaacttttctaatgaactgatttaaaaagaaaaatgaatctattcataaaaggaaatccgagtcctcgtaagaaaattctcaaatcaaaagcataaggaaaacctgtttcctgaattcactggggctgaattatgtatcgttgtgttctgttctttacacatgcatttgtcttcctgtatagagactcatttgtgttgagttgatatagtttaaagactagaggctcattcaagttacctcaggtaatgggactccagaaagtaatattacttcaagtaatgtgggactccagaaagctacacattcaggaatcataggacctagagggtgttctgagaccaaggtagctgtaaggtccataaaaatcagaatttctttaaaacttatgaattgtttattattgaaatttttcatttaatttttctggaccacagttgacaattggtaaccaaaaccctggaaaaggggcctactgtaaatatttttctgatgaggtcgctttacttacaatagaaataaaactttaaacaaggtaaagaaaaaaatgagaaatgctaatattaatcttgccttagtgctttattttgaacccaacagatgcttttcacatgtctaactttctcttttctgtactcctgactaaattaatattccttcaaaaaaagtgctgcttgtttacggtttctgcagtagttaattaatcttacaaatggcccaatatgaatgcatcagatattctccatatcaagattcagctccagttctaactgctgactgcctcgtccgctggattctcaggtcgaatttccaagcaagggaatccacttgcttcagctcacctttctgagtcagcccatatcagtcctggccttctgtgaaatgtccattcttggttcatatccccacatgccccccacttctaaactatgactgagcaacggctacctgagaaccatccttccagcaaaggcttgcaaaggcaggtgcgatggcagctatctatcttgatctgaatcctgtgagaacagtcattatggtttctagccaatcccacagatttgggagtaaactgaacctctttggagaggctcaaaagattcattttgaagcttgcaaagtctaagtagaataagtagctctcttagatgggaccagctaattttatcattttattatatgtattgctccatacccacttggaatgcaagttccaataggcatttatatcttgtgttttgtttactctaaacctcaacactaggaagagttatggcattataaggtacttaaaaaatattttataaatgaatgaatgaacttaaatgtccaaaagggagcagcggagtggccagtagcaaaataaattatgttcacccttatgtaataaaatacattatgtaataaaatacgctatataataaggtacattcaggcatttaaaacatgttgtgtaataagtttggctgggtgtggtggctcatgcctttaataccagcactttgggatgccaaagcgggtggatcacctgagttcaggagttccctgaccagcctggccaacactgtgaaacccagtctatactaaaaatacaaaaattagccgggcgtggtggtgcatgcctgtaatcccagctacttgggaggctgaggcaggagaattgcttgaacccgggaggcggaggttgcagtgagccgaaatcgcaccactgcactccagcctgggcgacagagagagactccatctaaaataataataataataataattttaatgacgtgaaatattcatgatcttctcaatgggaaaagtaaattacaagaaaatgagatatgagtatggaaataaactagaaagaactcagcagattgttagcagtagttatcctagatcacacaattgaagatgatttccattatcttcctctaatttttataaaatatctatagtgaacacctattagtgttataaccagaaacttcatacacatgtacacacacagagacacaacacacacagagttacacaataaatgctacactaaaaataataataatcacttaatagtgatgtacataaaatggaattattttgtgttgttggtatatcaggaatagaatttctatttactcagttccaattgttctgtatctgtaagtcacatatgttgcctaacacctgccccacagtgtgattatttgtgtgtgcatcttttctactgtataatggggcattcttattacagaggtaatctgtgtgtgtttcatctttgtgctttccattgtgtctagatcaatgtttgaatctaataagaggttgctaaatgtattttaatgattgactaaacgcatgaagagttatatttcaggggcatgacttgctttaaggtatatccaaatgtgaatagcaagcctagttttaataaaactacatttggcagagtctctgcttgcaagtaaatgaaatttagacttcagaaaatgtttgaatggccctaaatctttagcaggttttcataagtgatgatgaaatttacctgacacagaacaaaggactattaaactggaaaagaccaggaaggttatctatcaatcttttaatttttgatggagaactagaattccaaaaagattatttagttcactgcaggtcacttctatagtattccgaccagaactctgttcttcctgactctcagttcaccacttcacccgctacaacacactgtttctgcacgcctggctaaattggtcttgacgtgatgtacattccttcttaatatgagtcagtgacctggtactgggaaaatctgtgagtggtttaacatgtcaggctattgtctaagaaaaagcaaaccatctccatgtagggttaaaaagcaaaaaaatagtgcttttgagaaaagctgtaataagcacttgcagttaaggaaaaatgtctaatgtacttttaaagaactacgaataaagaactatgttctctttatcttaatacattgtattgatattacttataaaatggtaagacttttaaatttataaagccaaaacattttatttcatctttttgctatcctccatattagccctatttttctattattaatgttcttcatcactaactgtggtgttagatacagcaggtccttaaataatgttgtttcatttaatatcatttagttataatgttgataaggaaaacatcagttcccatccagggccaatctgtgtgtagtttgcacattcaccccatgtctatgtgggttttctcctgatactctggtttcttcctacatcccaaaaatgtgcacatcaggttaattgtcctgtataaattgtgatggaataccatattgtccagggttggttcttgccttgtgccctgaactgccaggataggccctggcccccaagcaatcctaaactggaataactgggtaaatgattatcttacttgtttttattactctttcctaaatatatgtagagctaacatttatttcaatgtttaatattaaagttctttggttcctatttagaagctgggtgatgttttgggggccagaaatatgtcataggaaattaactcttgtttagattatttaaccaatggtaaaattggttttgttatatgtcatttggtttacagtttcagtttccaagaacctaccaataacattaagtgagaacttactgtaattacttgtcactctgagattaagaaaaccacaagaaagcatgattaagttgtgctttttatttgacctccatagttaagaaaaataggagtttttggaatggatattatcttaaaatgtaagaaaatagatattaagttggagaaatgaatattatgttattctttgttcaatcctttgatagtttcccatagcaatcaatgacacccagtagcaaagattttaattcctacatactaaatacaaagtgctcagattttaattcctaaatactatttctagcattcaggatagacagaaaatttcttcacttgaaaaaaatcaaatctggctcctgtccacttttctcatcctttttttcaataatttcttatatgcacctttcactccacccatacagaataattcatagtaccttgaacaaaactttgtactatctcactctatgtcttaaagtgctatcacctcaagctggaatgccctcctgcaaatttgaactcatacatcatttttttaaagaagacatccccaaccctccagcttgatttctaaggtttctcctctgtgttctcatggtactcaggcataacccaattataatttgcctacagtcctataatcaattatctttaccttccagtaatttttgacttccttgatggaagacatcatgccttattctattttacattcacagtacactgcaaaagttttggcacatagtaggttctaaataaaagacaatgtgtttcccatgacttcccatgactacatacatactatctttggaatttgaaagaaatttggttgccttggaagtacctcaccacagaattcacttgattacagagggtttgagtaactggtttttattgtctcccaacatggcattttattgaagtcattgagtttatgagaatatgctcagtttcactcataataagaaaaatgcaaagtaagattatattgagacactatttcttacctaccagattaacaaaaattcaaatgattgctaagatattctgttagcaagtctgtgggaaaacaggtactctcatacatcctagtgcgtgagcaaatggtacaaccctaatggaagaaatttaacaacatctaacaaatctacatagcacttgctctttgctgcagaaattctacctttaggactctaccttaaagaaggaattaccacaaagtcaattttttaatgaacaatctgagtgcaaaccattttttcagttattcattaccggattatttgtacatcaaatagtgggaacaacctaaacatccatccataagagactagttaaaaaaatctgtggtatagccatacaagagactactatacaaataaaattaagaagattttgatgtgctatgatttccacaatacattaagggaggaaaaagtgggcaatctgaatacatattgatatttacctacttgtacgaaaagaaatacaggaaaaacacaccaaaaataataaaagtgttttgttaattattaatagaaattttaaaaatttaaattattaataaaaagaaaactacatttaaaatggggggatggtgggatgagagcagaaaagtaagggggtgagtgggagaaacacttcactacgtacattttttacacagttttgtttttgtttttttttttttttgagacagagtctcactctgttaccaaggctggagtgcagtggcgtgatctcagctcactgcctccgcctcccaggtagcagcgattctcctgcctcagcctcccgagtagttaggactacaggtaggtgccaccatgcccggctaattttttgtatttttagtagagacagggtctcactgtgttagccaggatggtctcgatctcctgacctcatgatccacccacctcaacctcctaaagtgctgggattgcaggcatgagccacctagcccagcctatagctttgattttgaaccatgaaatgttttacatatagtcaaaataataaatgaaaaggatgagggagagataagcaaacctgaaaattgaagacaaatgaacaaataaacctaacatggatgtgtatgtaatatattacacaaaataattaattaaaataattttgagtacagtattctaactgcatacgtttagtgaaatataggacaaaagtctgcatggaaaatataaactttattaataaatttttgttgaattatgaaacatttctcatgtattgtcagatagaaaaaaataaatgaatatattgatgctgttgggaactgagttttcgccataaaacgaataaaaatatggaaagaaggataataagagagaattagagtatttaaatttgaaatgaggagattaataagaacttaaggtttcctacctctatctagaatcaatgacacttagtagcaaagagctcagctagtgctcaaattttaatttctaaatactatttctccccaaaagtaagtgggctttttggagaaaaggctaaattcaagtcagatacatggaaagtacaaattgagtctggaacaccttgtaccagaaaaaagggaaacagtcactcaaagactaacaagcttgtattaaacaggacagaaatcagctaaaagtgctcttgatatgagataattttagcatgaaaaaaatggaggttatagacatactcaaagtatgaaaaaagaaggagagttcttctgtagaaaagacaccagtgccagctgatgaattcaggtagaatgatggaattcaaagatcatcattttgcagacaccaatgaaaacaattgattgaaaaaagaaacatcaatagttgctgaaacttttgggtgaaagattacacagccttaaggtttaattccatagattacttattaattacaaagagaaaaatcattcttcacaatagagaaatctgacagtttcttactgtacccaagtgatcagacttaacatcaccaaaggtggagtaacttaacaagataagctgatattatgcacctcctgtgattcaatacaaaataaagtagggtgacatcagcaaaatgatgaaatagaaagtcccatatcctccttccttccatagagtcatcaactgaacaacaatacatgaattaattccctttgtgaaaaatccagaaacaaattaagacactgctggaccccaggcaagcgcaaaaccagctgcatagaggccagtaaaaaaattcacaacactcacttgccatagtccctttcactgactcagcagagagcaactggaagaaaactcccagcttctagcttctcccacagtcccataggaggaaaagatttggcttgtacatttttgtacattgaacatttaggcttttggcaggggacagaggggcagaagggtgggtggatggttgcccgagaaactagtttttatcttatctgtctccaagtgctgacaggacccaatatattctagaagccaggggctgctgacaacaaaagacagcttggcagcttatagcagctccagagaacaccagaaggagtaatagattacaaggtcttggaagaaaatcaaccagtaaatccctctaattgagaatttacacacacaagtctattgcagatgtatccacagactagaggtgagaggacctcagaatctcttacttggctgattggtgaaggtttgttcctatacaaaccctgttttttacagagtgagagaggaagctattttttgaaatgcacagaccacaacaaaaggtaacaaggcgcattaagaaaaaggaaaatatagaccaatccaaggaacaaaataagtctccagaaaccaacttaatgaaatggagagattaaattacctgacgagaattcaaaataatcatcataaagatgttcaataaactcaggagaaaaatggatgaacaaagtgagaatttcaacaaagaaatagaaaatattaaaaatggaatcaaatagaaatctcagacctgaagaataaaataactgaagtgaaaaaatcactacctagttttaatagcaaacatgattaagctgaagaaagaatcagggaacttgaagacaggtcatttgaaattgcccagggagcaaaataaaataaaacaaaataaacagtgaagaaagtctaagggacttaggaaacaacatcaagtttgcaaatatttgtattatgggagtctcaaaaagagaagaaagagagaacaatgcagaaagcttattcgaagaaataatggccaaaacttcccaaatacggaaaaggaagtagagatccaagttcaagaaggccaacaaactccaactaggaagaactcaaagataaccacaccagaaaaggttataataaaaatgccaaaattcaaaggatgttaaaagcagaaaaagaaaactgattcatcacataaaagggagcctccataacactatgaggagatatctagcagaaacctttcaggacaaaatggagaagggagatatattcaaaatgctgaaagaaaaaataattgccaactgagaatactatagcctgcaaaattgtccttcaataatgaaggaggagcttctgcacaacaacaaaactgtcaacagagtaaatagacagcctacaaaatgggagaaaatatttgcaaactatacatctgacaaaggtccaatagccagtatctataaggaacttaaacaaatttacaagaaaaaaaaaaaacaactttatttaaaaagtgagcaagggacatgaacagacacttttcaaaagaagacatacatgtggccaataagcatattaaaaaagctcagtatcactgatcattagaaaaatgtaaatcgcttcatttcattcatttcatcttccatcactaatatcctttcctccagttgatcgcatcggctcctgaggcttctgcattcttcacgtagttctcgagccttggctttcagctccatgagctcctttaagcacttctctgtattggttactctagttatacattcgtctaaatttttttcaaagtttttaacttctttgcctttggtttgaatttcctcctgtagctcggagtagtttgatcgtctgaagccttcttctctcaactcgtcaaagtcattctccgtccagctttgttccattgctggtgaggaactgcattcctttggaggaggagaggtgctctgctttttagagtttccagtttttctgctctgtttttcccccatcttcgtggttttatctacttttggtctttgatgatggtgatgtacagatgggtttttggtgtggatgtcctttctgtttgttagttttccttctaacagacaggaccctcagctagaggtctgttggagtttgctagaggtccactccagaccctgtttgcctgcgtatccacagcggcagctgcagaacagcagattttcgtgaactgcgaatgctgctgtctgatcattcctctggaagctttgtctcagaggagtacccggccgtgtgaggtgtcagtctgcccctactgggggatgcctcccagttaggctgctcgggggtcagggtcagggacccacttgaggaggcagtctacccattctcagatatccagctgtgtgctgggagaaccactgctctcttcaaagctgtcagacagggacatttaagtctgcagaggttactgctgtctttttgtttgtctgtgccctgcccccagaggtggagtctacagaggcaagcaggcctccttgagctgtggtgggctccacccagttcgagtttcccagatgctttgtttacctaagcaagcctgggcgatggtgggcgcctatcccccagcctcgctgccgccttgcagtttgatctcagactgctttgctagcaatcagcgagactccatgggtgtaggaccctccgagccatgtgagggatataatctcctggtgtgccgttttttaagcccgtcggaaaagtgcagtattagggtgggagtgacctgattttccaggtgccatctgtcaaccctttctttgactaggaaagggaactccctgatcccttgagcttcccgagtgaggcaatgcttcaccctgcttctgctcacacacggtgcactgcacccactgtcctgcgcccactgtctggcactccctagtgagatgaacccggtacctcagatgaaatgcagaaatcacccgtcttctgcatcgctcacgctgggagctgtagaccggagctgttcctattcagccatcttgggtaaaatacctaggaacccagcttacaagggacgcgaaggacctcttcaaggagaactacaaaccactgctcagtgaaataaaagaggatacaaagaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagccctcattgccaagtcaatcctaagccaaagaacaaagctggaggcatcacgctacctgacttcaaactatactacaaggctacagtaaccaaaacagcatggtactggtaccaaaacacagatatagatcaatggaacagaacagagccctcagaaataatgctgcgtatctacaactatctgatctttgaaaaacctgagaaaaacaagcaatggggaaaggattccttatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccattcaggacataggcatgggaaaggacttcatgtctaaaacaccaaaagcaatggcaacaaaagacaaaattgacaaatgggatctaattaaactaaagagcttctgcacagcaaaagaaactaccatcagcgtgaacaggcaacctacaaaatgggagaaaattttcacaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcagtcattcaaaagtcaggaaacaacaggtgctggagaggatgtggagaaattggaacacttctacactgttggtgggactgtaaactagttcaaccattgtggaagtcaatgtggcaattcctcagggatctagaactagaaataccatttgacccagccatcccattactgggtatatacccaaaggactataaatcatgctgctataaagacacatgcacacatatgtttactgtggctctgttcacaatagcaaagacttggaaccaacccaaatgtccaataatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaactgaacaatgagaacacatggacacaggaaggggaacattacactctggggactgttgtggggtcgggggagaggggagggatagcatgaggagatatacctaatgctaaatgatgagttaatgggtgcagcacaccagcatggcacatgtatacatatgtaactaacctgcacattgtgaacatataccctaaaacttaaagtataataataataaaataaaataaaataagaaaaatgtaaatcaaaaccacagtgagatacataccagtcagaatggctattactaaaaagtcaaaaaataacagatgctggtgaggttgcagagaaaagggaatgcttgtacactgttggtggtaatgtaaattagttcaaccattgtggaaagcagtttggcaattcctcaaacacctaaagacagaactaccatttgatccagcaatcccattactagatacatacccaaaggaatataaattgttctatcataaacacacatgcatatgtttgttgcagcactatttacaatagcagacatggaaccagcctaaatgcccatcagtggtaggctggataaagaaaatgtggtacatatacaccatggaatacaatgcagccatagaaagaacaaaatcacatcctttgcaagaacatggatggagctagaggccattatccttagcaagctaccacaggaacagaaaaccaaataccacatgttctcacttataagtgggaactaaatgatgagaacacatggacacaaagaggggaacaacagacacttgggctgaccacagggttgaggctgggaggagggagaagaacagaaaaaataactcttgggtaccagtcttgggtacgtgggtgatgaaataatctgtacatctaaccgctgtgacatgagagtacctatataagaaagctgcacgtgtaaccctgaatctaaaattaaaagttagaagaaataaagacctatataagcaaatactgagggagtttattaccactatatcgcctttacaagaaatgctaaaaggagtccttcaagttgaaatgaaaacaccctaggcagcagcagaaattattatgagaccataaagctcactggtaaaggtaaatatacagaaaaatagataatactgtaatattttagtggctgtgtataaatcacctttaattctgatactcaagttaaaaggcaaaagtataaaaaacactataactatatgacaataataaaaagggcaagggaggtgaaagaatagagttttatatccaattgaagttaaagttgttatcagcttaaaatatcaactttatatttgttacaactataagatgttttatgtaagccccacagtaccacaaagaaaatactttttaaaaactaccaaataaatgagaaagaaatcaaagcctatcactatacaaaaatcaacaaaacacaaaggaagacagcaagagaagaaaagatggacagaaaagcctcaagacaaaacaattaacaaaatggtaatagtaagtgcttccctatcagtagttacattacatgtaaataaattaaactcctcaatcaaaatggatatagtagctgaatggataacaaaaacaagatccagctattgttgtctacagaacactagctttagatttaaagacactcacaggctgaaagtgaaagcatggaaaatttattccatccaaatgttaaccgagagagcaaaagtagccatattcatatcagaaaaaatggactttaagtccaaaactgtcacacaaaaaaagaaggacataatctagtgattaaaaagtcaattaaccaggaagatataacaattataaatataaacgcatgcaaattcaaagcacccaaatatgtgtaataatcattgagataactgaagggagaaatagacagtaacacaataatagtagaagatagcatcctactttcaacaatagaacacttagaccaaaaatcaataagaaaacaatacttgaacaacactatagacccaattgacctggccaactgatacagaacattttactcaacagcagcagaatgcacatgcttctcaaactcacacaaaatacattccaggatagattacatgttggatcacaaaataagtctcttttcagaacattgatatcataccaagtatcaattcctaccacagggaatgaaactaaaaatcaatagcagaaggaaaaatgggaaattaacaaatatgtggaaattaaataaaacactcttcaataacaatttgggtacaagaaaaaaatcaaaagagaaatttaaaaataccttgatataagtaaaaacaaaacacctaccaaaacttatggaatgcaacaaaagcagtattatgagggaagtttatagtgataaatgtctacatttttaaaaacagaaagaattaaaataaatagtttaattctacctcagggaaactcaagaaactagaaaaaaaagagcaaactaaactcaaaattagtagaaaggaaacaataaagattagagcaaaaataaatgaaatagaaaatataaaaataagagaaaaaatcaatgaaattggttttttgaaatgattaacatcattggcaaacctttagttactaacaaaaaaggaagaagactcaaataaataaaattggaaatgaaagagaagacattacaactgatcactggaataaagatgatcataatagtctataatgtacaattatacactgataaattggaataacctagaaaaaatggatatatttctaaacacatacaacccccaagacttcatcttgaagaaatagaaaatctgagcaggcttgtaactagtaaggagactgagtcactaaccaaaagccttccaacaaagaaacttccaggaacagatgtctttactggtgacttatatcaaacatttaaagaactaatgccaatccttatcaaactctccaaaaaaacggaatagaagggaactcttccaaactcagtctatgaggtcagcaatagcctgataccaaagccagacaaatatactatgagaagagaaactataggacaatattcttgatgaacatagatacaaaaatcctcaaaaaaatagtgcaaactaaattcaacagcacattaaaaggttatacaccatgactaagtggcattgattcttgggatgcaaggatgtttccacatacaaaaatcagttaatgtaatataccaaaataacataattaaggataaaaatgttatgatcatcccaatagatacagaaaaattgtttgacaaaatgcaatatgatttcatgataaaaacttgcaacaaagtaggaataaaaggaaattacctcaacgtaataaaagccatatatgaaaaaccccacaagtaacctcattcttcatggtaaaaacctgaaaacttgcgtgaggaacaaggcaaggactcccactgtgatcatttctattcaacattgtactggaagtactagccatagcagttaggcaagaaaaaaaaaaagacatccaaattgtaaataaaagagtaaaattatctctgtttggaaatgacatgatcttatatttagaaaaccctaaagatttcacacagaaacatacacacgcaggcacacatgcatgcacacacacaaaaacaactgttagaattaacagttccaggatacaaaatcaacatacaaaaatgagttatgtttcactaaccacaaactatccaaaaagaaaattaagaaaacaatcccatttataatagcataaaaaagaataaaatacatagaaataaactgtcccaagtcagtaagcaacttgtacactgaaaactgcaaaatattcccaaaagaaattaaagaagatacaaataaatggaaagatactccatggtcatagattggaaggttaatattattaaaatgtccatactactcaaagtaatctacagattaaatgcaaacctcatcaaaatcccagtggcattttttaccgaaatagaaaaaacaatcctaaaattcacatggaaccacaaagggccccaaaaatccaaaacaattttgagacaggagaacaaagctggaagcatcctacttcctgatttgaaaatatattacaaagatatagtaattaaagcagtatggtgatgttacaaagatagacacatagaccaatggaacagaatacagagcccagaaataaatctatgcatatgttgtcaactgacctttgacaagggcatcaagaatacccaatgaggaaaagatggtctcttccacaaatggggttgagaaaactgaatattcacatataaaaaattaaaatggacccttatcatacaccatacacaaaaatctatttaaaatggattaaagacttaaaagtaagacctgacactgtaaaatattccaataaaaacataaaggaaaaacttcattacattagtcttggcaatgattcttgaatatgacaccaaaagcacatgccacaaaagcaaaaatagacaagtggtggaattacatcaaattaaaaagcttctgcacattaaaaaaaataaaataaccaactgagggaaaatgcaacctatggaatgggagaaaataccctcatattgtatgtctaataaggagttaatattcaaaatataaaaggaactgctacaactcaatagcaaaaaacaaaaacaaataatccaattagaaagtaaacaaagaacttgaatagtcctttctccaaagacgacatgaccaacaggcatatgaaaagaaattataggtcaatgctcctgatgaatatagatgtttaaaaaagtcactaatcatcaatttttatataaattcatatatataaatataagtaagtgctagtgagaatgtagagaaatttacatacatacaaaagtcactaatctcatatatatacacacaagtgctagtgagaatgtggagaaattagaactcttgtacacagttggtaagaatgtaaaatggtacggctgctatggaaaactatggaggttcctcaaaaaattaaaaatagaactaccatatgattcaacaatttgacttccgggtatacatccaaaaaaactgaaattgggatcttgaagagatacatgcactctcatattcactgcagtattattcacacagccaagatgaggaaacaacctaaatgtccatcaatcggcaaacgggtaaaaaacgtagtatattcatacaataaaacgttattcagccttgaaaagaacagggaaatcctgctatgtgtgacaacatggatcaacattgaggacattatgctaagtgaaataagtcagtcacagaagaacaaatactgcttgattccacttaacatgagatatctgaaacagtcgaactcataaaagcagatagtagatttatgattgccaggagcttggggagggttcaatggatataaattttcaattatgcaagatgaataccctctagagatccagtgtacaacacacacacctataattaacaatactgtactgtatatttaaatttttaagagggtaaatttcatgttatattgttgtatttttttaccacaatttttaaaaagaaaaaaagaaagaacttttaaaatatctttttgtattcttaatctaatgaagaaataatcagacaaatgcaaacactgatatattctataaaacaaatagtctggacttttctaaaaaggacaatatagtgttttttaaaaataggaagaaagaggattattctagcttaaaagaaactaaaaggcataataatgtaatgtaatttataagcctaagctttcattggatctggaatttttaaaaatatacatctataaaagtcacttttaagttattttttagccccaaaataaagaggcttaaaaaaacattaatcattttacaatctctcatgatttctgtaggtcagaaatcagaaaaacctgaagtgggccgggcacagtggctcacgcctgtaatcctagcactttgtgaggctgaggcaggcggatcacctgaggtcaggagtttgaaactagcctggccaacatggcaaaaccccgtctttactaaaaataaaagaattagcctggcatggtggctggtgcctgtaatcccagctactcaggaggctgaggcacaagaatcgcttgaacccaggaggcggaggttgcagtcagccaagatcaggccactgcactccagcctgggtgacagagcaagactccatctcaaaaaaaaaaaaaaaagagagctgaactgggtgatcctggctccaggtttctcatgaggttgcagtcagatggtaactagagctggaaaaccaggtggcagtgactagagcatctgtgagctggtgggcatctcttcatgtagtcccagggcttttccatgtgatctttaccggggggcttatctgggtctcttcccagaacaatcagacagctttaaggctccatcaagtgttgcagcaagtaaggcagaagcagaattgccttggattcagaagtcacagcatcacttttgctgtcacaaaagcctgcccacattcaaacacagaataaataaattatctctctttataggagactgacaacattctggaagaaagagaaattgtggtagtcatttttggaaaatagaatttaccacagacaacaatgaggcagttggggaaatttaaatctggactgtataatagatgatactgaattaataaccagttttcttaggtgtgatgatgagattcagttatataaaaaatgtacttattcttacatgatacatgccaaaagatttaatggcagtgtcttgatatctgcaacttgttttcaaatgattcagcaaaataaaaaataaagagagagaccgggcaccatggctcacgcctgtaatcccagcactttgggaggcagacccagcactttgggagacagaggtcggcagatcacgaggtcaggagttcgagaccagcctggccaatatggtgaaaccccatctctactaaaaatacaaaaaattagccaggtttggtggtgcacacctgcagtcccagctacttgggaggctgaggcagaagaatcgcttgaatccgggtggtggagattgcagtgagccgagatcgcaccactgcactccagcctgggcgacagagtgagaccccatctcaaaaaaagaaacaaagaaaaaataagtgtggtgaactgtaagtaatcagagaataggtaaaggttacacagatgttcactctactaattatttgccttttctatagatttaggatatttttctcaattaaatgaagagaaagtaaaatataagtcagatagcattatttttctgctcacaaccctccaatcttctctcttcggagtagaaggcaggctgcttaccaaggcctgcaagatcctgtgtgattcccaaagcttacctctctgatttcatctccaggcaaaggaaacagcaagtacaaaacccccatgagtgtgcttggggtgttttagaaacagcaagttgtttacaatttcctacttttaattgatgtttcaaatatcttctacttaaacctttgtgtacacttcttagagaattcctattttgacctcaagtccctgcctactcatttctttctttgtagtagaaacttcagccctaaaagaactcagtcaaagccaaatcatttctcactacccccaaaaaggcctacaaatttgggccaggagaggcaatcctggcaaggaaatttttttaaaaaggtcccagttacactcaaattgggagtttcactaaattgatatcccccttaggatgcttaatgctcagcttcaatcttacctccagggcatatgatattgtatcatatctgagatttagattgctgaggcatttcctatcataactcagtaggttcttaagattttactttgcagagtttaatccactggggtttttttgtctggttgcttaggctaatgctgcttggtgttctgagcgacctcacttccctgtggccctagagtgtggggtgacctgttgcagatgttagtaatttcctatcttgggtggaggccctcacagaagctttatttgcatatgagtgtatttgcccctgatgttttggtcttggatgtcagcggaattgtccgtccttctgaaggtcatacaataccgctttccagggaggtattataacacagataattgaataattgggccctctctgttttccaaaaggagtgggtttgccacatcttttcttgcaaactagcaaacctagggttaagtagggcttgttggtaaatgtagcgtgtcaggagctcacagccagatatgagccagtaagcaacgtaggtgtcctgggatgacaaaggaggaacatacacacctcagttgtcttgctgattctactctgtgcttccatgtccccttctgtaaaaatgtcaataacactacaataataatagaggtctctcttatgagaaattggttatttagtagacattataaatcaaggtttcaaaaagtattatcgggccatctcaatgttcattgcagttggcatcagtaaagtgaacatggtcaaggtgatattctctaaccatagtaaaataaagggctgaggcattcatttggtgtaaataggacaaacaccagggaggcttggccaggtgtcttttgtagtaaaattgggattctgagattgctgttttccaacttggcaacagccttaaacatcttggtatcctttaatgttatgattccacttctagggatgtctcctaaggaaagagtgctaaatagagaaaaagtgtaaattgtaatggcgacagaaaatagaaacaacctgaatgtccaactgaagggaaaatgtgtaaataaatcatattcactttatagatgattgtacagacttaaaaatttatgcttatgaataatttggtgataacatgaggtatgagagatatgtataaaaagaatacaaaattatacataaatggcaaagttttaaaacaaaatgtcattaaaataacaaaaagatatggatctttgaatgttgaggattgggcatatttttctttctgctcttccatattttttaatttttctttaatgattttatgtcactttttctaacaagaaggataaagcactgattaaaagtgctaagatgagttcttagcaaagaatgattattcctatctaattatgtattaacatttatatgaatcatactaacattatatgactcattttaagataatatattaagaggttcattaaaatgatactttttgagtatataaggaatctttttcttcacatttcaaaacattaactctttctaaaagtccatagtgtgagaggtaaaacactaataatatgtaaactatcagcaattgtacttctcgccataacaactgtatggattgcagacaagaacaaggaaataaataagaaagtccccttgagaagggagagaagacaaaaggaatctactttgtgccaggcaatgtgctacatgctttcataaatgaccttatttaatcctcacaacaactctatgaggcatatatatgtgtgtgtgtgtgtgtgtgtatatatatatatgataaaataagatatatacacatcttattttaccctagcagcaattctgttagatgaggaaactgaaaattctaatagatgaagaaactgaggttcaaagaagttgcataattggaccaaaggaaaacaactaagaaacaagcccacattctttccactgtcattgtgctttgttgatagactacccctggcccatgctcatagccttagatagcctcatttttaaacagaatttggtcacacttcttagtctggtttcttatcctaagggatgtagtatacacaaacattagaacatgacagaaagaagagaaggaatgctagagcaatagcaatggggaatgaaagctgacaaaagagtaaaccaccaaaacaaaaaaacaaaaacaaaactcaaccctattaaaaagcagcccaggaactcaaaaagcatagctatatagcagtatggaactattttatgacagaatatacaactctatgtcatgctgaggtaatcatcatattcagtactttattttccatatactctgtatgtacacactctgtatacagtatgtatatgtattagggggaatgtaatatataaaaattttttgaacaatgggtattgccactctttcctttaagggttctggcttgatgaagttttgttcattggtttgtcttgctttgctattgtaatacatagaattccagtagaagatctacaaacacaagctgattcttaaactgagaaagcaatatccagagtcagaacttgctttttgcttatctacctaactaaaagctgaagaataaatgaagcagtgactggttattgatacactttgcaacatttcactagaacaacttaaaactggaattgaagcatcaactgaagatttctgtgcaactgtggtttaaattgaatgctgcgctttgtataaacataattttttgtggtttaactttaggctgttctctgcggtcttcccatataatgggaatgcgtcagaagcacagcttcgtttcctgtgtaggctggaaactgttaactgcaaagtttggagacagtctcagagagctcactgccatatgttaaactaaacttgatatgaaaaatcatatcagtttccagtttcccagaacattaaaaagaaaaataaaaaaggagctcaagctttataaatataaaaagcatctgtctgcacaggaaattctactctgttattttgcaaatgatccctacttatatttacaagagaaatcagatctgatgaactatatggaagtaacacattattttgttcaaaattttgaaatatatatttataattctgtacagctggctggactgtgaactaactatcattgtacagagatctcaacagtgctgcccagcatgatcttaaagcatgtatgtttccaagtgaaaggtgatggaatattttgacagcatgctgctaacttaaacatttttgtttaatgtaatttttgtgtctaagtgctcccaaccaccatttccaagacaagaagactcatgagcattcagaaaacatttggcactgtttcattttaattttttacttctccttgactctttgagcctagaaagaattttctctgtagttgctcacccaggtacaagtgtccttgagttaatcttcggtagctcattttagaatccgactgtgactaaagttggattctgtgactgccttcttgcctgcctctccactgtcacctataattttgtcatttcttttgctctgaaccagcttgctatgctaaaagccatcccttcctttcacattttataatcctcataagattaacagccaaaatccatgaccagaactctgaccacgtacagtctacagaggacttcatgctaccttgataataccccgtattttaccagcaaccatctctcagacttgactataaccctctggtgtacctcatcaattcaatgctccagtgtttatccttgatttcattgttttcttgcctcacagaggtacctagagattttttccaacagaatctttctgcctttttcacttaatagcctatctatgccagtattcccaagtaaactccctttaactgtaaagccattaattttttcttctgatttcttcttttctctttcccacctttgtcttgcccagtttttacttattttcattcctctagtaacttaggcctcctcttactctcagttccttttattaccattattttctctaaaatcagattaatatcatatattaataataattagtcatccatcactaagtagtgcccacatttactaacttctctgacttaaaagttgctgtcttatctatgttcttttctttcctagacaacactttggaatagtatcttttctccccctaccttatcacaagaagattaaaatgactcttctagtaacaattacacctaccctctcttatctcgcacactgggaggcacacgccatgggccctccttgatagaggtgaagctaaaccatatccttgtggcaacttataaaaacctcaattgtgtggtttgcctctgcctgttcctgagggcatgcagacataacgaacttctctctcagcctggacctgtgctggaaaagagtttgacgcccactaaaacaggcatttcactgtgaattagaaagcctctggagaagagactttatgtaaatgtgtgttctcagtgtggaattgttcttccatgtttacaattgtttgtgtgtctttttctctgtgccaaatttcaggtgactggagactgattagctggtctgtgctatccttactccactttagccaacacattgcacattcttacctccaaagtggcaaaaaatgcaaatgtgtatcattatgctttattagctttagtaaaaagtttgccatattaaaggttaaaatttttggcaattttttgtactcctcgaatatctaattatttagattaaaataattatataattattctagttacctttcttgaatttaagtcttaaaaaaaaccctgcaagcaaacatttacctatgtaacaaacctgcacatcttgcacatgtaccccagaacttaaaatttaaaaaaaaacctgcaagcaaacctatcccctacatattttctcatacttcatccatacatttaacattataaattcttttaactgtttcttcttaaattactttgcactatgccttcataacattatatgcagatagaaagttgcatattattatgaccaaaggtcatttattatctaacctttcatcttggtgttgatgatggtcagctcattaaattgttcttctcaacctgggagaattaagccctaatgctcttatgaatccattgcacgtgatgagttcacttctctagctttgtacccttgttgtgagaattatgaaaataggcagttgaattattttctccataatgatatagagaaataataatacagagaatgtggaatgttctcaaaaactggttaagaaaggctacattaagaaatatttattaaacttctaatatgagacacccactacactaattgatagaacaaaaaagctttgtaagccataaccctttctcttaaagaatttacattttactttatgagatatgaaataatctgatgaaagatctggaaaataatcaatggaatttgagattgaattatgcagcatcaacttgaaatttgaaagtaaaaaaaactatgtgaacttcatcaataatagaggtcttcaaggagaaggtagatttaagttgaaaccttaatttagatttaaatgaaaattgaaaatagacaatgaattatctatgaattgtgaggaagtgaggaggcattcaggacaaggaagaggaaagccataagacagtaataagcaaatcaggtgatagaaccaagagtcacaagcaaatcatttaaataatccaaatatcaaatttcttaactattaaaaaaatagggaaaatgtcagtctcacagggttgtggcaaagaacaagtttgtgaagataatgtatgtgaaggtactgggaaatatagagacagtaagggctcctggtaaataggataggattcttaggataaagacagcttaggaaggtttttgccatttgcctctttctcattaaaatggcatgcagattattcagcatcctctatgctgtacagcatgaattatttctagaagattaatcaccaaatcaaatgcaaaagcatccttctaccaagttttttcttgtctttgatgaaatcactgggttcactgcttttatcagttttcatttggataatatttaaaatgctcttttatcccaatttgaataccctcaatcaatgtcagcctcttttaatttggtttaagattacaggaaaacatcatgaccctatagatttttccaccacaactattaagaacaatggagccagacatattttaacaacaaaagaacatgaatggagtttgccttttgacttatcatttaagtcctgggtttcagatcatgataaatatttcagaatggggtaatcctggatcatgattataaagtatatcaaggctgcaacacaagtgctgctgggattttttaaagggaaacattcttatgagtcttgaagtctcaatgaagaatggaagatttgaatgagttttcctggatgatcatgattcggttaggtgaaggagtggagaaggcaacaatctgcaggaagaataatcctggaatgtttagaaaatccaggaggggctttactgaaatggaaatctaatactggagaacaatgagaaataaagttggatagttacagttaagttgaatgagtaactaattcagtcaccacacacaccctattttaatttcttaagcatattctgagggtctcaaggacccacaggaaaaaaaaaagcataagtccttttaaaaattgtattatatctacgacatccatataacaaggctgaaattagaatctggatgtgttattttaatatttttaattgtgataaaatacacataatgtaaaatttatcatcttaattatttttaagtacagaactcagtagtgtcaagcacattcacattgttgtgacacaggtctccaaaacattttcatattgcaaatctgcatctctatatccatcaaacagcaattccgtattcctcctgccccgaatccttagcaactactattctgttttatgtctctataaacttgactattccaggtacctcacttaagtggaaccaaacagtatttttcttattgttactggcttatttcacttagcataatatcctcaaggttcattgatgttatcgcatgtgtcagaattttcttcctttttaagactgagtaatattccattgtatgtatatatcacatttggtgtattcattcattcattgatgaacacttaaattgcttccaccttgtggccattgtgaataaaagctgcagtgaacatgggtgtacaaacatctcttcaagaccctgttttcagttgttttaggtatatacccagaagcagaattgctggatcatatggtaattctatcttcaattttttgaagaatcattatactgttttccatagcagctataccactatacattcccaccatcagtgcacagggattccaactttctcacaaccttgccaacacattatttcctgttgctttgatactagctatcctaataagtttgagattattttagtattgccaaatattgtgatttatcctacttgcaagctaaaagttggccagctacaattcatggatgctggaagaaggcatgaggttaaatataaaggacagcaatagcaatagccagaatatcagatatattacctaagaggaactccaactttagagaacccaaatctcacataataggcaataaacctgtctgacttttgccctagaaagtcataatttttattatggtggacaatagacaaacctgacctttgccctggggggagacactatttctgtcttccaaggctgtttactttacaaatatctttaaaaagatagtccagggaaaaaaaggcagtcagtatatttgcttgtaagatttacctaaatgagagacccattgaaagcgtgccataatgagtaacttcacatatttttaacattagtactgcataagaaaacatttattcctataaatcagatatgaatagtaatctataaattgaggtttgcaaaaattaggtttttttaattaaattagatcataatgcaagccctcattctgccataattactagaaatctaacttcagttatctgatcaatggtgagaatttggaagtggtaagggagggaaggtggaggtccactcccaattaaacttttttaaaaactagaaaagttttagtgtctggaaaatgaagtaatatcctgtagccttaaacctattattgtgtttaatatatatgtatccttggcttaaatgagcaagactaataaaatccagaaacagcctcattatttttcctgtgcccatccctataagccaatctgtagggctagttcctcccatctccccagaaaaaaaactcaagtaagcctcaacattttttggttattctcagatactaaaaagttctccagtcactttagttgtgaataagtctcaatttagtaagtaatgtatccaatattatataataatcaaagtactaaatgtaatttaaggttgaaacttttaacccctgccctcatcctacagctctactttactacaaggaaggctcttcaatgggaaaatgaggatgatagactttgtctctatttcctaccttacgcctccagttaacatggttcttaacacatctagggtgaaaatagagggggagtggaggaagaggagaggtaagagccaaagacaaagaaatagggtttgtttgtttttttaacctttattttagattcaggggatatatgtacaagtttgttaactgagtgtatttcctgatgctgaagtttggggttcaaatgatcccatcaaccaggtactgagaataggacccaacagctagtttttcaactcttgcctctctcccttcctcccctctctggcagtccccagtgtctactgctgccatctttatgaccatgagtatccaacgtttagcttccacttataagtgagaatatgtggtatttggttttttgttcctgcattaattcacgtaggataatagcctccagctgcatctatgttgctgcaaaggatatgatttcattgctttccatggctgtgtaatattctgtggtgtccctctttgagtggtacaaagaagtacacagatcaacttaggagacaattcagtagcctgttcaaaataacccactaaatgccaggaagtaacagtttggagacaaatttggttagataggtgacttttcaatttagctttggtttaatcttgagtcttctcagagcctagataaaagcctaagaagaaagcaccacaggattgggtcatgtagtgcatctacagtgtacctagttgtacagacattttctagaggctggtgggtgacctaaggtcaagtagcccatttcttgaccagcttatacttttacagtcatcttatttttcagtgatgaacactctaatatctcctaagtgccctcacctaaccacacaggaaaaagaggaaagaaacgaaatacctgtgaattccaacagccagagtttgtgtcccctgcagtaataaccatttactgtaaccactgtcagttacctttaaaactacagctcttgccaatgactcatcaggcaaagtgccacctcatagcacaaactaatccttggtacccaaaatgccaaagaaatcagatatctcaatgtaaaggagagcaaagcttcagacttgaggggaacctactcacgattctcagggctccatgaggaagacagagtactccaaaaaagaaatcagtggcaccttccctgtgttgttcctcaaagggtatcagagtcaccagaagtctcctttaggtctcttcaggtagccacgagaactctattccctcttagtaatttcccatctcctgaccaccaaatgaaggaggtaggggctagaagagaaacgtatcaagaatgcaaggaaactggatggaagataaacgatggttaaaaggaagaaggaggagcaggaaatggaaagaacagatctgagaggagccagtttgagatcttgttttccaaaaaggccagggaagttccacattatcttcagcaaaaataatgccgacaagaaaggaagcaaacagaagggctgagcatttagttagcatgagtttgagaagcttcaattaactgagaagctcccatgggagaagcaagatccaatacagagaccagagaggccttaaataaattataccctgaatatcaacttccaattaagctcacttctgaccatagagctcttttaaatatcttttcaaaaattatcagatttcggctgggacaaacagcaaatattcttggctctattttctcccattaagccaacaatattgaactaatcttatttaccagagattcacctaagtcacatgaaagtgaaaaacatttgggtttgttactatattttcagcagttttaggtatatttagttaatatgagtgtccatttatctataaggcaatttgaaactcatttaagggattcaacaaataaaataaaccaaaattttaaaccaaaggtatacctaataggtgactcaggacaaaaattaataagccttttatgatttaaccaaggattcacaagtcatctctgcagaggtgcaaaaatgcagccctctcaaggtccagagccacttcccaaagacagccaaaagagaaaaagattcagacaatgctttgagagctggcaatagtaggtatgctagctacacatggggttcaagccacatttttgtctggccatattttgggggccagaccacttttcagttggttcatcatggaagcaggcccaataaaatgcatgccctgacaggcaggaagccaagccaagttctcgggacacgaattgaaacaaacaggaaaacaaaagctgttcatgggagggaaggattagtaacaaattggtaccccaagaccaaaaggcacaattcaaacatttttcgtatagtgactcaaaccaataatactatggaaagttcaattccagagactaagacagcaaagacttccattgccacaggtagtaatgacagtatttatgtaaatggtatctccagtctcccacaaaaaatctgggatgcctccagtcacaaatacagtaatctgtgacaacaggcaaatgatactgggatgggagtttccctttactaaccaagcaatgaggacaaggacttcttataagacaaactcccctgagaattgaaatgatcaaaggaaacctctgggttctaggccattcagctggctgcctgacacaagccaacactttgcactttcctaaaatggaacagagagaatgtcttcaatggtcacaaagccaagatctcaggatataaaacaaaagagaatctcaggatataagacaaaaggagaatctcatccagtttttgactcagttacctacagcaaagttagtttaactaaacagaagtctggtaagaactacaaatccaccagcctgtcaggccagtttgagcaacaaccttagaaagcctatgcctgtgctccttgccctgtgattctgctgtttatgataaacaatacaaaagacagacaacagaaaacaaggcagcatctctgcaagggaagggatcagaaaataagactactcataccaaacaaacaaacaaacaatcaccagattcactatacccagcaactcgtacatacggatgattttctcctgctaacctgaattttggaaagaagagatgagaaaattttaccttccattctccaccagacgacactacaggcagagatccaggagggctgtccttggaaaacaatgtttaccatttctttgctggcttttcatctgttgttccagaatctcatctgcaggctctggagcaagtcaagtgtcccagctgccccacattgggcaccagaactataggaataattgactaaatcactgggcacatgattgagctcggtttccagcccttctcttctttctcatccttctgaggattcaaggatactggtgatatcatttgattcaaagctccaccagtctaatcaaatggtcggtctttctggcagggcctatccccatcccaaatcatttcattagtataagctatctagggccccaccatgaatcatctcactagtataagctatctggacccaccatgaataacaaagaactcctatcatttgggaaatttcagagaactagttttcctctcaagaactagagacaaacactaatcaaattctccattacacaacaatcttcaagtggatgaatgaccaaaggttttttaccacctcccttgcaagacaagtggttcaggatctcactctggaatttaggataattgctattgtcttctggcctcggatgaaaactcagtctaaaacatatttacatatgttgcatatttacatcctcttaatcgtaaattggctaagcctgcatgactgcagaagggccagcagatctgtggcttctatgtgcgtcaggctgggaaaagggcaccttgactaagtttggaaacccagaaatcttggctgtagcctgcacagatgtaccacggggcactcactcaaatgcaaagtcctaccacttactcacggtgctagaagggtggctcaggccacccctcactcacagaactcctgttccaattttagttttacagagtctcacttctctctcctcttcttacctagcaaaataatgtcaaaaaactagatgtaaggagaatgaagttgacaaaacagtttaaagaatcatttcattgcacatggcactgaagaacaaaatgaaatcatttctttaaaaagtattcatcctctgccatggttaatcttacgtgtcagtttggtaaggccatggtactcagatatttgttcaaatattattctaggtgtttctgtgcaggtatttctttagatgagataacatttaaatcagtagcctatgagtaaagcagattaccctccataatgtgggtgggcctcatccaaatacttaaaagccttaatagaaaaagactgacctccccagaagaggaaattctcccagcagattgtgcttggactcaaactgcaactcttctctgtgtctccagccctgcaaatctggggcttaccaagtctctatagtcacaagccaattcctcaaaataaatctctgtctgtctgtctctcattttctctctgtctccctttgtctctctctctctctctacacacacacacacacacacacacacacacacacacacacatattctctgtctctgttggttctgtttctctagagaaccctaagacatttttaatattgtataacaatatgcaatattaagtatacataatttattagtagaaatgtgctttcattctatgcatcaaaggaatactctgtactatgtacttacttgctgtaagcatgtttgtggtctgcattttcacatgtgccctctgactatgaaagctgcataattacaaactatctccaggcctttccattttccatgaagtggctttttctttattacttaccttttatttctgcattcctactcaactggcaaataaattgaggcacaaatgaataagactttctactttaatttaaggataataaatatgagtcactaaatttttgtacaacatatcctattagtttcttatatttcgttaagagacaccaatgctaaagagacatgtaacagggaatagctgtttaataacatcaaagaatgttaaaatataattgaaatgatgggtacatatgctactgtacattttttaaatgtatattgaatttcaaagaaatatttgatatatgttaccattaattatttaatatggaagaaagcattttacttcatgctgtgtgtatatacaaactaaacacatttttaattgtctatgcatttaaattatttatgaacataagggaagcttaccaaatttagttcactttaacaggaaatcaaatgcactggtgtaataaaatttgtgatgataaatgcttgtaaattaaagccaataagtataagataaagtggtatctaataatatgtatattatacatttattataaattatatatattaattttataacatacatatgatatatgtagatatcattaaaagaaaaaccttagacaaattaaatttaacagtttaattgagcaaagaacaatttgcaaatcaggcagcctcttgagccagggtacattcagagagattccagtgcagccacatggttgaagatttatggacagaaaaaggaaagtgatgtacagaacatggaagtggggtacagaaacagccagattggttggttacagttcagcatttgcctaatttggacatggcttgaatagttggctacctttcattggccaaaactcagtgattgacacaagaatgggtttatttatttacatctccatttacattatagttcactatgtatagagaaccctttaggctgcacttaaagtatgtaaggaggcatatgctttatgctaaacttaacaatttcccctctaaaattaagaggatgaccaaaactttagtcattgatgtcactattaccatcataattttacttatttggtcttgaaacccagtgggaaaacagtgggttttataaagtagaaacaagcacttcaggttattttttgggtaacggtcagaggagagggtacctccttgttttggaatcttctgcttacaggagaaaaacaaaatctggtctgttttaggacctatctacttccttaaagtttcagtttgattgtgtcatatttagcatgagtgactccattttagtttggtctggtctgctggggcctactgtacaaactcagtctaaaacaatggctcccataattttctttaaaaaaattcctccattttgattaacttctctgtattagtcagagttctctagagggacagaactaataagatagatgcatataaaaagggaagtttattaagcagtattaatgcacacgatcacaaggtctcacaataggccgtctgcaagccaaggagcaaggaagccagtttgagtcccaaagctgaaggacttggagtctaatgttcgaggacaggaggcgtccagcacagaaaaaaatgtaggctgagaggctaagccagtctgatctctccacgttgttctgcctgcttttattctgatcacattggcagctgattagattgtgcccactcagattaaagtgggtctgcctttcccagcccactgacttaaatgttaatctcctttggcaacaccttcacagacacacccaggatcaatactttgcatccttcaatccagtcaagttgacactcagtattaaccatcacattctcacttaggtaacggtgtgacaaaacttagggccttagtgccacttcagttaccatcattttgggtttctagtttcagcacatcattcataagtcatcatgtcctcatggtcacacatttctttaagcttttgtcattacagttcaggagagaccatttgacattcttgagatggctgcatgcaaacattcaaaactttttaaagaaaacagcacatgagggagactactattatgaccatgaggaggataataccaagagtttggagtatgctttttagccagagtccccatgaaccaatccaactacaattaaatagatcaaagaattagctagacaaagagtctactcatttcaaccaggtagcctgttcattaatcccctagaaatgaatctctataatacccaatgtattccttcacgtacaactagaagtaccagcaactatacagatacttctgtttagccagcaagtaatctagagcaattcaattatttagcataactttcacaagagaattttaagtctgttgtgtagccagagcttttgcagtagaatctgctacagagcctatcatgagggataaatttctaatcattgcctcatctactcccaaccacagaaagagcgatctaacaaatgatatccatccaaaagagagaagatctcctgtaaaggttttctttaatccatgatgtaccttaagaggagtggaccaatgttctgtttttgattgactatgaaggaacaaggctaacatttgttgttcgtattggtccttcatctttcatctctcaaggcataaggttgtccatgtggaagtttggctgcgaaatcttccacaaataaaagtataccccaagagggcacataagagaccccctttttagctctattgttgttagagacataagcaagaaaaaatgagagattaagagtttcataacagcagacaattcttgatccatgatcttgggaaaaagccatccacatcaatgatgccatcttcttggggagaaacctccctggttagctttaccttaagagttccaatgggcatacatttccaagactgtggaatgacccttctcagttgtgagattatgaagccaagactcaagttcccaaagttttgctgcagtgtggatggcaagagcaatctttctctgatgttgctcccagaagacccagtcttcatattctagattattaaggggttgattgtcctcagtcagtggaccataaaaagctttctttaactggtgaaaatacactttggcctaatgagctactgttacaacatcagccctcttgcctaggaaagcttttatacaaccagaaaacatacattgaaaatgaaaattgaatgaaatccctctataaatgtttaaatggcccatcaggtaacagaaatgtacctgaagtttagattatcttcctaggaatatgggtttaacaaaccaaacattgatcataaactattttagcaatttaggacagttacaccacctataaatatcattaatatatgatatatttattatatattattaatatataatatattaataatttatatattaatttggattcctttatcatttccatgatgaatcatggattgtacagcttttaataatgaaaactttaaagactcagaaaagacaaagcagccatctaagttctccctgagtccacatttaacattggacttatgtcctcttaaatccagttgtttctccgatttaggtgcagagcactgataactaataggctatcgcagataatttgacttgcaccatggagtttattcaaattgcatatctaaacagtagtggctgatttagcatgaaaatctgagaaagtattttcttgatattcaattaatttttgtcttgcttgggttagcagttttaaaaaccagtcagtttctcattagatttctgggaattcttatccaggcttcataatatgatccaaaagttatcacaaacctatatccaagagtgcttaccagggtgctttgaatcctttcatgaacctccttaaaaacacagtaccctaagattctatgtgcttgtgaagttttcaaaaactgcatcagaattaagcaattaactgtagaaatgactttaaatggtcatagttaaagacaattgacaaggaaatttggttatttctttgacctataaaataacttcacataataaccataactgtgtagcatatactgagatatattagaattttagaaatctgatataattttagaacatatattaataatatattcattaaaatataacttttttttgagataagtctcactctgttacccagactagagtgcagtgccacaatcttggctcactgcaacctctgcatcccaggctcaagtgaccctcccaccccagcttcccaagtagctgggaccacaggtacacgccagcatgcctggctaagtttttgtatttttagtagagatggggtttgcccatgttgcccaggctggtcttgaactcctgagctcaggtgctctgcctgtctcagcctctcaaagtgctgggattacaggcatgagccacagcatccagccaataacttgaagaaagttaaacatttcttatttgtcactgcttcccatgtaattcaacatgtcaaataatcctatttatgtcttttttggatgtttcaggagccctctgtagcatcccaaaattgaaggtcaaaaaacacaatactgaagctgaaatttgatttggggaagcctgtcaaatatgtcaaaggtttaaaatacttaacacaaatatgattataagtaaccataaaataatagtcatttttttagccaatgtaataattaaaagattttttaaaaccaaaacctttactctttgatagaggagactcagttttccaaccaaacgacctaagaaagatagcctgagacagaatgtctctcctctcttctattttttatagtttactcaaaggcgaacaaagatattttactgtcatttattaatactccattgaaattttcctcaaaagagaaaaccaaattttatttttagattactgtattatcaatgctaaagctaattgtaataaaacttataactaaatctatgaaatttgtcatctttcgaccacacaagatttccataggtcttttatgttttacatttttccccaacttcctaggtttatgtaattttgcctattttttagtccttcaatttgaaatgtttaaataacttcaaactagataaaaaaaattttaaatacacattttatgtctttattagtttcctcatcaaaagcatatcttgcttttgtttatacattctgtatacagaattgtttcatatctagtagtagtaatataattatatataaactctaatttaactattagaaccctaatttatagtgaaaactctgaaagtaattttgaactgttttatatcagtatttacaaataaaaaccattttataatttttttcaaaagatggttcaagttattgttttttaacagacctaaatatatttagcttttctgtacaatataaaaaaagtcaaggtatatagaattaaactcatgtttaataagtaatatttcagtttttaacttacaaatgattcagatattttatgtctatgtgttaattaatttagcatagtatgtaagatttgaaatgactgaaataaattttgaaactatgacacaggtaccttccctaatgtcttccccagtcatcttgggtcccaagtagccatgtggcatccaggaggactatgaagggtagggcctgtctgagtcctgaatttgcataccaggtatagaggtcaggacagaagacagagctgtgaagactatacctggagaatctaaccactcccgaagtaaccaggaggcaaagctggggcagggaagaaagggccatattgggtttgactttgctgcatagttgctggtctaggcactgaaaacatgtctccagacctcaccatggccacctatgcagacccccaaacccagaggctctgaaccaaaacataagctccacagtcaaatcaagcaagtatcaaattatattcaattgtattttgaagtcattcctattttaccaagaattttaaaacaagttttatttatcaaatattatcacatacgcataatacatatagacctacaaacacacagacagaagcagattttatacctttcttaaaggattctcatttgccagtttttaaagagtttttcttttccccattcagcctatcaatcttccaattacctattttgtcaccctaagccattgttaactaggcaacaaatttgcatttctaaagggaaaactcttaggtgaagcaagaaaatttctatttcaaaagcacagagctaacactttaggcctaaatacagtaccatttgctcaaaccaaggggaaagtggtgtaagtaaaagttaagttagataagacggccagaaaagcaccttaaacagatatatgacttgtgcaaattaaaacaatgggaagagtttctaatgtacataggcagacatcttacaaatggagatttcctttataggtgtgaatttcttttacaaaagggtttcaggaaagccagttaaattccagaaaggtgtattccagtttgataggtggtgatcttttaaacttagctattgtttcttagctaaaattactgagttcaggatggagtccattaaggaatagagcaaagaaagcattctctaggcctggactcagcatggatgggtctgaaaaagcaaggctacttttcccaagggcctacttaatttttgtgggtatatagtaggtgtatatggggtacatgagatgtattgaaacaggaatgcaatgtgtaataattacataatggaaaatgggaattgcatcccctcaagcatttgtgtaaaaaacaattcaattatgctcttttagtaatttaaaaacatacaattaaaatattattgactattgtcaccttgctgtactatcaaatactagtttgatagtaggattgctgaatcatacggtaagcctattttaagttttctgaggaatctccaaactgttctccacagtagttgtactaatttacattcccaccaataatgtatgagggttctcttttctccaattcctcaccagcatttattattgactgtcttttggatataagccattttaactagggtcagataatatctcactgtagttttgatttgcacttctctgatgatcaatgatgttgagcactttttcatatgcctatttgctgtttctataccttcctttgagaaatgtcttttcaaatcctttgcacattttttatcaaattattatattttttcctacagtgctgtttgagctacttatacattccgcttattaatcccttgtcagatggggagtttacaaatattttctcccattctgtgggtagtctcttcactttgttgattgtttccttcactgtgcagaagctttttagcttaatgtgatcccatttgtctatttttggttggttgcctgtgcttgtggggtattactcaagaaattttgcccagatcaatgtcttagagagttccccaatgttttcttgtagtagtttcacagtttgaggtctcaggtttaagtctttaatccattttgatttgatttttttatgtggcgagagataggcatctagtttcattcttctgcatatggatatccagtttttccagcactatttattgaagagattgtcttttccccagtgtatgttcttgacacctttgtcaaaaatgagtttactgtaggtgtatgaatttgtttctgggttctctattctgtttcattgatgtatttgtctgttttaatgccaacaacatgctgttttggttactacagatctgtagtataatttgttttttgtgggtttttttttttgtttttattgtttccactttattgctctagcatggaacttcaggcaagcctggaccttcatcaacatgcaaagaagaggctgagggggtttggggacacaacctggctgagagggaaaactgacaggggaaataccagaacgggggacagggggtggtcaccatgacaccaggagacagcatcagccatgccatctggggtgaggaagggaacagagaagaaatggtgtttcttcccatgtccctaacacccacatggaggccacatttggaaatggactgggagagggaaaggatgaggaaaacagctgcccaggagtctccttctccaccctgggttcatatcagaccccatccctaccacttgcctcttctacccctggaaaatggacctaacaaacagaaggagcaaaataaattaacactctaatgagcatgtatggatggacatatgttcatgtgcaatgggggaagggaagagggggtgacaccacctaaaatgattccccacctcaatctcccagcctactcctttcccccttccccctaaagccaccatccaaccagatagaaaaataaaggtctaattcactcaaaattcttcagtttttacaaaactaacagggcagagtagggagacggggggcaggcagccacaggagtagggctggtggagaggggctatgcttctgtctccacttgagactggctctctgtggtgttgctcttctgctcctccatctctgtgtcagtgagattgtctcctgaggaagcctctgccttggccttgttctcttcctcagccagcctctcaaacgtgttggcgtagagcgtcttctcccaggcaagctgcctgcagatctgctgctggcacacagccagctgggccttggcggcttcgttgttggggtagagctgcaagaccttctggaagtcagcctgtgccagttcaaagtcattcacagccaggtgggcctctccccaatggaagaggcccttctcgttgttgctgcccagttccagggccttgttacagctttcagtggcagcagagaaggcctgtagtttcagatgacacatggccaggttgaggtaagaggccagttgaagggcctgtgccttctgtgtttcctcattggaaaaactagactcatattctacccaggacacaatcctcttatattatagtaaagcttgcttgtatttgccttccttgaagtacacagtgtcccactctttcactgtggtgctctgctccagcttctcttctgaattcatctcccaagactccttggtcttttcaaaactcttgaggtgtaattcatatttcagctaggcatttggtgggatttggaacttttccttcctaacactgccaaaagcatagctgggtttgaggtacacaatggaatgttctcctttctacatgcactgaatggccctctccagaccataaggcagatccagattctcctgatgttcaaagaactagtccttgtagcacccttccagtgcaatctccatgatagcaccctcattgggcctgggatagccttcaccgcaagtctgtaattctgtagatgattccgccatcttcttcttccgtcagatcttctcccttaaactcaaacaactccacctcaaacacgagtgtggcattggggagatctttggaggactgcctgctgcaccgaaggcatattctggtttgcaggtgatatggcacacctcccctgccttcatggctgctatggcaatgtcccaagccttgttgacctccccttttcccaggtcaaaggagaatttgtccttgtgatccagactggggtcaaagtttgtgccatctaacagccagccagtgtagtggacaaagattcagtccccaatcatgggcatctctgtacctgtgccctctctcgatgaccttcagcatgccttcctcctgtttgggcgaatgtccactccctccatgggaagaggcgccaactgtgtcccattctcagtctccttcatctcctcaactgtcatctccacgcagcgcaccctttctgggagctggcaccggcaccagcatactctgagccaaaggcaggggtgctaccttcagggtgtgcaggaggccaggtgctgtggtgctgactgcggaccacatggaggctggagcacctctgccagtctgtagtatgatttgaagtcaggtaatgtgattctctccagttttgttctttttgctcaggatagctttgactattctggatcttttgttgtaccatgtaaattttaggatagttttttattattaatatttctgtgaagaatgtcattggtattttgaaagggactgcaatgaatatgtagattgctttgggtgatattgacattttaacaaaattgattcttcccatccatgaacatggaatgtatttctcttttttggtgtcctcttcaatctcttttatcagtgttttatagttttcattgtagagatcatttctttggttaaatcctaggtgatatggtttggctgtgtccctacccaaatctcaccttgaattgtaatagtctccacttgtcaagggtggggccaggtggagataattgtataatgggggcagttcccccatactgttctcatggtagtgaataagtctcatgggatctaatagttttataaatgggagttcccctgtacaagctctcttgcctgccaccatgtaagacatgcctttgcttcttctttgccttctgccatgattgtgaggccttcccagccttgtggaactgtatgtccattaaacctttttcctttataatttacccagtctggggtatgactttattagctgcatgagaacagactaatatgctacatatctaattttatttgtggctattataattaggattactttcttgatttctttttcacactgttcactattagcatatacaaatgctactgatttttgtatgttggttttgtatcctgcaactttacaaaatttatcagttctaatagttttttggtggcgtctttgggttttcccaaatataagataccatctgcaaacaaggataacgtgacttcttcctttccagttggatgccctttatttcttcctcttgtctgattgctgtagctaggacttctagtactatgttgaataacagtggtgaaagtgggcatccttgtcatgatccagatgggagagggaaggttttcaggttttccccattcagtatggttttagctatgggtctgtcacatatggttttaattatgttaaggtatgctccttctatacgcagttttttgagggtttttcatgaagggatgttgaattgtatcaaatgcttttttaacatctactgacatgatcatacggatttgtccatcattctactgatatgatgtatcacattgattgatttgtgtatgttggaacatccttgcaagccagagataaatcccacttggtcatgatgaatgaccttttttaccatattagtgaatttggtttgctaataccttgttgaggccttttgcatcaagattcatcagagatactggcctgtagttttctttttttgatgtgtctatgtctggttttggtatcagagtaatactggcttcatagtatgtgctgggaagtagtccctcctcctctattttttcagaattgtttcagtaggattgctattagttattttttaaatgtttagcataattcagtattgaagtcattgggtcctgggcttttatttacagggagatttttaattacaacttcaatcatgttacttgttattggtctgttcaagttttggatttcttcatggttcaatcttggtaggttgtatgcatctaggaatttgcccatttcttctagattttccaattttttggcatacagttgctcacagtagccagaaattatcatatgaatttctgcattatcagttataatatctcctttttcatctctgattttacatatttggatcttctttttttttcttaggcaagctaaaagtttctcaattttctttatctttaaaaaaacttttcgattcattgatcttttgtattgtcttcttcatttcaatttgatttatttctgctctgatctttattattccttttcttctactaattttggatttggtttgctcttgcttttctacttctttgaggtgcatcattaggttgtttatttgaagttttttttttttttaatgtaggcacttatagctataagcttccctattagtactgcttttgctgtattccatacaacaaaatggtatgttgtgtttccattatcattttttccaagaaatttttcaatttccatcttaatttcttcatttacccactggttgttcaggggcatattgtttactttccatgtgtttgtatagttttcaaaattcctcttgttattgatttctagttttattccattgtggtcagagaatgtgcttgatatgattaacatttttttgaatgttttaagacttgttttgtgacctaacatatgatctgtccttcagaataatctatatgctggggaaaagaatgtgtattctgcagtctttgaaggaaatgttctgtaactatctattagatgtttctttgttgattttctgtctagaagattgatgcagtgttgaaagtgggatgttgaaatctccagctattattatattggggtctacttctctctttagctctaataatattttctttatacatctaggtgctccagcattcagtgcatatatatttaaaatcgttatatcctcttgctgaattgaaccccttatcattatatagtgaccttctttgtctattcttacagtttttgtcttgaaatctattttgtctgatatgaatatagctgcttctgctcttttttggtttccatggacttggaatatcttttccatccctttattttccatgtgtgttttataggtgaagtctgtttcttgtgggcaacagatcattgggtctcagtttttggggggttttttggtgtgttttgttttgttttttgtttattttttggcttttggctttttttttttttttgagatggagtctcactctgtcaccaggctggagtacggtggcacgatctcggcttgctgcaacctccgcctcctggattcaagcaattctcctgcctcagcctcctgagtagctgagactacagacacacaccaccacgcccagctaatttttgtatttttagtagagacagggtttcaccatgttggccaggatggtcttgatctcttgaccaagtgatatgcccacctcagcctcccaaagtgctgggattacaggcgtgagccaccacacctggcctcattgtttttttattccttcagctactctgtgtcctttgaagaactgtgtccatttacattcaatttatagataagtaaggacttacccctgccattttgtgatttgttttctggctgttttgtggtcttctcttccttctttctttccttcatgtctttctttttgcgaaggtaattttcattggtgatatgatttagttagttgctttttattttttgtgtctccattgtatgttttttgatttgagggtatcatgaagcttgcaaatactacgttataacccattattttaagctgataataacactgtttgcataaacaaactaacaaaaagaaaatttacaaagacttcctgcattaactttgtgcccctgctttaagtttttgttactatttatatcttattgtaatatgtcttgaaaagttgttgtagttactatgtttgattggtaagtcatttaatctttctccttaaataacagtagtttacacaccacatttacagtgctataatattctgtttttctgcagactattactagtggattttgtaccttcaggtgattatttattgctcattaatgtccttttctttcttattaaagtactccctttagcatttcttgtaaaaaaaaaagtctgatgttgatgaaatccctcaactttttttttgtctaggaaagtctttattttttcttcattcttgaaggatattttcaccagatatactattctagcataaaagttctcttcccttcagcactttaaatatttcattccactctctcttggcctgtaaggtttccactgaaaaggctgccactagatgtgttggagctccattatttgtttcttttctcttgctgctttttggaacctttttttatccttgacctttgcaagttgaattaccagatgccttgagttagtcttctttgcatgaaatctgcttggtgttctgtaaccttcttgtacttggatactgatatctttctctaggtttaggaagctctctgttattatccctttgaataaagtttctatgcatatctctttctctacatactctttaaagccaataactcttagatttgcccttttgaggctattttctagatcctgtaggcatgcttcatggttttttattctttttgcttttgtctcctctgactgtattttcaaatagcctgttttcaagcttgctgattcttttttctgcttgatcaactctgctattgaacgagtctgatgatttcttcagcatgccagctgcatttttcaactccagaatttctgcatgatcctttttaattattttaatctctttgtcaaattcatctgatagaatcctgaatttcttctctgtgttatcttgaatttctttgggtttcctcaaacagctattttgagttctctgtctgaaaggtcacatatccctgtttctccaggcttggtttctggtgccttatttagtttattcattgaagtcatgttttcctggattgtctggatacttgtaggtgttcatttgtgtctggccattgaagagttaggtatttattgtagtctttgcagtctgggctctttatacccattcttcctgggaaggctttccagatattcaaaaggacttgggtgttatgatctaagctatatctgctttagagaggacccccaagaccagtaacactatgattcttgcagactcatagaggtactgccttgatagtcttggacaagatccagaagaattatctggattaccggagactctggttctcttcctttactttgtcccagtctctctctgtgctgagccacctggagctagaggtggaatgacacaagcacccctgtagccatcacccctagaactgtgctgggtcagacctgaaaccagcagagcactgggtcttgcccaagccctgctgtaaccactctttggctaccagctatgttcattcaaggccctgaagatctgcaattagctggtgacagagccagccaggcctatgttcttcccttgagggtgatgagtttctccaagcccaagctccaggagggtccagaggtgccattcaggagccagaaactagagtcaaaaatcttagaagtctacctggtgttctattgtactgtggctaagctggcactcaaaccacaagacgcagcgcttcccatgcttccctcccctttccaaatgcagcgagcctcacctcatggccacggccacctcaggcccacagggagtactgccagactaccaccatgttccctttaggctcaagggctcttcagtcagcttgtgttgaatgctgcctggcctgggactcaccctttagagcagtgaggtcccttctggcctaaggcaagtccagaaatgccatctaaaaaccaagtcctgaaatcaggtaccgtgagagcctacttggttttctacccagctgtagggcctaccttatataaactttttatccaggatagctttcttttttgtctttgggacagtattgtaactaagcaaaaagataagcggatttaatttttcttattagtcatttaagatttttatttgccttttataaggagtctttaatttaaaatactgaaatactttagaagcttctgcatatcagtaggcatccatagatgagagtaatttggaaagcttcattttcttttctttttttttaatttcaacttttattttaaatacagggtacatgtacagatttgttacataggaatattgtatgatgctgaagtttggagtacaggttccctcaccctggtagtaagcataatatagtactcaataggtagtttttcaacccacccactcccaagctcgagtagtccacagtgtctatcgttctaatatttatgtccatgtgttctcaatgcttagctcccaattagaaggaagaacatgcagttttgaattttctgtttctgcattaatttgctgaggattatggcctccagctccatccatgttgctgcaaaggccatgatttcatttttttataactgtgtactattccgtggtgtgtatatacagcattttctttattcaatccaccactgatgggcagctaggttgatcccatgtctttgctagtgtgaatagtgcaacaatgaacagaaaagtgcatgtgtctttttggtagaatgatttattttcttctgggtgtaaacctagtaatggtatggctgagatgaatggtagccctgttttaggttctttgagaaatctccagattgctttccacagtggctaaactaatttaaattcccactaacaatgtataagtgtccacttttctccacatcttcaccagcatctgttgttttttggatttttagtaacagccattctgactggtgtgagattttatctcactgtcagtttgatttgcatttctctgatgattagtgatgctgagcattttttcatgtttgttggtgacttgtatgacgtcttttgagaagtatgtgttcatgtcctttgcccattttttaatgaagttatttggtgttttgcctgttgatttgttcaagctccctatagattctggatactaggccattgttggatgcatagtttgcagatatcgtctctcattctgcaggttgtctgtttgctttgttcatagtttcttttgttgtgcagaagctttttagtttaattagatcctttttgtcttgttgttgttgttgttgcaatggcttttcatacttagctaaaaattttttaccaaggctgactttgagataagtatttcctaggttgtcttccaggatctttacagtttgaggaccttcattgaaatctttaattcattttgagttaatttttgtatatggtgaaaggtaggggtctggtttcattcttctgcatacggctaactagttatctcagcaacatttattgaatgggaagtgctttccccatggcttgtttttctcagccttgttgaagatcagattgtggtaggtgtgcatctttatttctgagttttctattctcttccatttgtctttgtctgtttctgtaccagtactaagttgttttggttactgtagccttatagtagtagtgtagtagtaggagtagtagtgtagccttatatagtgtagccttgaagttgggtaatgtgatacctctggcttcattcttttgcttaggatagctttggctattggggctctttttcagttccatatttattttagaatcatttgttctgtgaaaaatggctttggtagtttgataggaatagtgttgaatctttaacttgctttggacagtatggccatttttacgaaactgattcttccaattcatcggcatggaatgtttccccatttatgtcatctctgatctccttctgcaatgttttgtagttctctttgtagagatctttcacctccttggctacctgtattcctagatatttcattttcttttggctattgtaaatgggattatgttcttgatttcactctcagcctggactttgttggcatatagaaaatgctactgatttttatacaatgattttgtaacctgaaactttactaaaggtgtttatctattctaggagactattggcaaagtctttaggattttctaggtatagaattatgttatcagcaaacagggagagtttgacttcctttcctatttggatgccttttatttctttctcttgcctgattgttccagctatgacttccagtactgtgttgaacatgagtggtaagagtgtgcatcttggttctgttccagttctcaaagggaatgcttcaagctattgtccacttagtatgatgttggctgtgggtttgtcatagatggctcttattattttgaagtatgttccttcattgcctagtctgttgagggtttttaacatgaagggatgttggatttcatcaaaagctttttctgcatctattgagaagataatttcatttttgcttttgattctgcttatgtagtgaatcacatttattcatttgcatatgttgaaccagccttgcattccaggaataaagcttacttgatcatgttttactaacttttcaatatgctgctggatttgattttctagtattttgttgaggattttcaggtctatattcatgagagatattggtctaaagtttcctttattaattgtgtctctgccagatttgggtaccaggctgatgctggcttcatagaatatattagaaaggaacccctcctctttgattttttgaataatttcagtaggattggtatcagttctttgtatgtctggtagaattcagctgtgaatccatctgagccagggctttttttggttagtaggttcttaattactgattcaatttcagaagtcgatagtggtctattcaggttttcaatctcttcctgattcagtcttggaagattgtgtccttccaggaatttacctacttcctctagattttctaatttgtgtgcatagggttgtgagccctcattttcaactgcacttcttcaagtgcagtgttgtttctttggaatgttccattgtaattttaaattacctttagtaagattttgctatttctaaaagtgtttgctgtttccagaacctaatacttacacatgtaagtgtgggcataatcagaagatacattactcagttcttaagaaaataaggatcccatttttatcttgaatcttagctttaattctcagatcctcttaatcaacttagccaataattttttcctacctcagcacacaagaaaaacaaaggaggtagaacacaaaaatccctataaatttccaaaaccaaagtttgcatcccctgaaatattgccattttctactggtttctgtctgaaccattcagacataagaggcctgtaactagatccaagccagttaattatcagattctggacccaattcagtttttttgtgacttccaaacctagtttcgatcagaaatttgctcaaacaaactcagaaagctcaaaacacaaatatgtggagctttgaattctgagagagaacttaccatcatccccagttgctgtgaaagagcaatggacacaatgggccctgcaggtacctcgcttggtcacttgatgctcctgggggtcactgaaagctctaattcggatcccacttctgacaccatctgtttaaaaaaaaaaaaaagccttagacaaattaaacttcacagagtttaactgagcaaagaatgatctgtgaatctggcatctggcagcctccttagccagagtaagctcagagagactccagtgcagccacgtggtggaagatttacggtcacaaaaaggaaagtgacatacagaaaatggaagtgaggtacacaaacagccagattggttacagctcaacatttgccttatttgaacatgttttgaacagttggctgcctctgactggccaaaacttggtgactggcacaagagtaggttactgtctatttaaacttccattgaggttactgttcactatgtacagagaaatctttatgccaaacttaaagtatgtaaggaagcaactttaggataaacttgatttaacaatattacatgtgaatatgtgtatatacacatgtgtctttgtgaatataaatataaatctatctatatatattctctaagatattggcacttctaataaagtggttattaaataatatttaaagataaaaacaatgaatttgattagtttagaaagcagagaaagttaacagagcaattctaacacaaatatagttgcttatcattttcagtgtgaaattagagtcaacaaacccatgattttcttagtattcactcactctatatctgtgtacaagtaattggcttattatattaaagttgctttttacttcattttatgttaactctaaaaaactgttaattgtggagtttttaaatgttgttcaatttcttttcattttaataataatattgttaatgttatcattgcttctattttctatgtgcctaacatttctctagagttgagcaggccttatcttccactttatagtgacagtaaattcatttgtgaatggggaagattttcatttatgcagatgggcttgagatagacaaatagatactcaaagagaacaacagagaaatacacaagaatatacacaatatttatactaatttatcatctatttacagaatgatagacattgccattgagttcatatgctagatacattgagtttatctatttatatatcatttaaaaaacagaatggaaatcttcctatatacagtaaacctttccctgccctctaaatcaggatattccacccataatttgcttatctcattgtgctctaatacattgacactcacagaatataggacagttgtatctacattagatggttccagttagtgatgctaatgttcttgttcagcttttcataggtgtttatttcttcaactttagagacagagttcaagatattagtcatttcttgctgctattctctgccagataagtcaatgtagtacaatgtgagagtctaggctttgcatccagatagacctgagattaaatcctgatcaactctttactagttatatggcttgtctgactgtaaagtggagatgataatatccacctccataaggttcttcttataggtgatgacagtacaaatatacagtactggccacctatcgggctttcttttttttttttttttttgagacggagtctcgctctgtcacccaggctggagtgcagtgccgcgatctcggctcactgcaagctccgcctcccaggttcacacccttctcctgcctcagcctcccgagtagctgggattacagaagcccgccaccacgcccagctaattttttgtatttttagtagagacagggtttcaccgtgttagccaggatggtctcgatctcctgacctcgtgatccgcccacctcggcctcccaaagttgggctttcaatagatatgtgtctcttgccactaccctctacaacacccacaacacccaacacccacccacattcatccccttttcatgctttccttcctgtcatctgtgaactgggcaactacataacgaagaagatttgaattatatctaaaccaaaatccagttattataatagaagtatttatttattctgagtgtacactattaattagcaaaacaaagaacataagcctaaaggctaacctatttggacctttaggtgggtaatatttgagatggtccttgaaagttgataggatttagactgaaagacatatgtagagaagcattctgtacagaggaaactgtttcaggcctaaagcacagcatagaacaaggaatgattcaatttatctggaatatagggtgtatgtggtagaagataaaactcaagaatgaatataggcctgttttgtcaaggattctgagcaccaggttaagaagtttaatttgatggaaaataggagttactgatatttcctaagcaaaggacttttgttttaggaggatttctctgtgttagcatttgggatatattagtgctgggagaaacaaaagtgaggaggtcatttagaaagttattagagtggttcaagcaaaaagtaacaaagactaactctcacacattactagtggtaatgtaagtcagtacaatctctatgacaggcaacttggcaatctctaccaacattacaaacgcacataccattttccttagccattccacttctaagaatttatcctcagatatattttcgaatgagtgaagtgatgcatataccaagttattcataatagcataaaaccttaataagaacttgaataacttacagcacattcacagtaacagaattacagcatatatatatataataagaatggggaagtcccttatgtactgattaaaacaatctctaagatgtattaaatttttaaaaattaatatattaaattgtgtaccatttgcttccatctgtgttttaaaaataaaagaaaattctggaagaatacacacacacacacacacacacacacacacacacacacacacacaaattatatctgtggcttcttgttgaatccaaaataaatattaaaagaaataaggcctaaagtcaaagtggtacctataatattggagagataacttattagaagttgatagtgggggaaaatttataaagaaagaatatggacttagaagaacagaaatttgtagaaagcctagtattgaatagtattatgccatgttatggcatgaagcagatgagtgtagatttgcgtgctttaagcagaaagaaaatttaagaaatcatgtttgcagaatataattgtcatcccaattttgccaaacaggcaccaaaatgcttggagatttattgtttcacccaaagtcacacaagtgatgacacagtaaaaacaaaaaacttctttcaaagttttatctaaagctccaatggcatagatatttagacaagtatagacaattgccttcacagctggaagtgccctcttcctccctcaccagttacccatgtaccttccctaacaaggtgaattttcttattcagcaggaaatattccctagacattagtgtttaatgaaaccatttattaaaatccgtgtaattctttcaaaattctaacatatccgaggcttgcctgattctgataataatattcaagcaaagatttttagaaaattttctttaagtcagtatgaaattttgacatttagtcaagattgaatctatggttcagatttcataacctcattaagtctccttgtgcctcttatgtgcagttctgggtacttactattatgtggaagggttaacatttttagaaaggaaacatttataaaccctagttctttttaacaagctgatttagctagttcctaagataatttactttcagaaagtataaccctttactacataacagtattaacttatagattgatttatctatcaataagttatttaagggagttataatttaaagcaataacaaaaaataatacaccaaatgtgaatctaccactgcaaaatttttaatagatacatggtttagttacagtcttttatgaacttctcaccttttatccccagagttagaaacttctatcagggtattattctcactgcagctgaaacagccctccagatgccagcagctttggcagtaggtgtcctctagtgctgactcataaaggtttgaaattttttatatttctggtctttcccccatctctgcagagatgcctttctaggtattttgcttttaattaagtctttatacagtaccttagctgactcttgtatctgggtcagtcttctcatccctgcaaagccctgggaaaactacttcactgaggttatctttgtgacaaactttacttcttaaaatttcttatttcaatcaaaacagatgtggcttgcataggcccagtcaagccctagtatattctctctaataaaggaacagttcatgggtgactttgttaatacttagcaagtgttcattctttagcattgttctttttgtcctttgagtctttactctctacttaaagaactgggtttctgaaccaaattagtactctcaaaatttgtcaacacttcacaaaccccttcattagaggggctgtcttaaaataaataaattttttaaaactgtaaatgtttgaatatttagaaacttaacaacaattaatcactagctttttcaaacccagcatttttaaatcacaaaataaatatatttgtttggtattttgataaccctctccccccagagtgaattcagccttatgagcaaatatagttaattgaaacctcttagtagtgaagctgatctttgtgattacctaaatttaattcattcacatatgagccaaaatcaaattttcatgtaggtcaattttctggaaagtttttgaagttaaacacatttagagatgtttaatttaatgctcttcctatatctattatattgtggagggagtgatttaaaacaaagaagcaaaatgcttcctgctggaaaataaagatgttttcattgcaaaattaatataacctttgtgctatgctgctgcttaaaaaaggatgtctattaattaatcatttttaaatctatcataagaagtaactgtattcattattctgtcactttctaacactaaaggaagaagaacagctgttgtctggcctctaactaactgcaatggggtctttcagaataatacagaaagaacattagaacagcatgagcaagatacacaattcaaaattaatcgaaaattggtgatctgagaactggagatgttctcatgacatgtaaatatttgttcagcagctaaagtaatagcaatgcattaaaccaatagaattacttttgacacctaacagaaatgttaattgatcatcaatctttagctcgtaataaaagggctgaacttgcagttctgaaagtatagccagaaaaattatgtgagagacataaatgttataaaaaagacaaactgctccaagctaaattgctttaaattacattgacctcatcactgtacctttgaaacctgtctctaattgagagcaattgatttacccttccaactttcctttaaagcctatcagatcccaaattctaaatgttaagaaccctttgccaaagtattctgcaattgagctttcctttgagattcttaagtgatgactaaggcacgagccaggtagaaaaacagtactcagtgaatttaaaccttagaaattaaggtgacatcttttgtctccccctggagaaggtgataaagtgaaagaaatttttagcataagaccattgtaattacacaaaaacatgaaagataatagacaccaaaatgagctgtgagagggacaaacatgccaaaatttctaacacctacccacacccagaataaaaatgtcaagttcctggaaattaaggaggatttgtggggaggatttttggaaagagttgtgctgtgtgttgagcatgatcccaccaccctctatccacgggagaacagaggggtcattgcctgctctgctgctcagctgagctctggcttgagggtcactgagaccatcagagagcttaagaggtgtttcctgcaggagggggacacagtaggttgttgtctgccttacaactaataaatccaaagtatgagagagagattggctaaagtggtatcagaagaagaaataaccacatataagaattatgtgcccttttttccaaagacagatcaaaggctcccaaatcccagggcccaaatgtgcaactcttaaaaggaatattagcctaggatccttttaaaagggaccctgctgggccgggcacggtgtttcacacctgtaatctcagcactttgggaggccaaggcaggtggatcacgaggtcaagagattgagaccatcctggccaacatggtgaaaccccgtctctactaaaaatacaaaaattagctgggtgtggtggcacgctcctgtagtcccagctactcagaaggctgaggtaggagaatcacttgaacccgggaggcagaggttgcagtgagcctagattgcaccactgcactccagcctggtgacaaagtgagactccatctcaaaaaaaaaaaaaaaaaaagcggggggaccctgctcaagagggttcctgataaaagactaggggagtcactggctaccaaaggaagttgtactgatggggcccagaagtgatgactccaaagatctcagatgattttaaacatatgcatatgacagtatcagttgagtaataattccctgcatccttttcactccttcatctccatgtcccagatactaagggatcagaaacctcagtaagcaagtagagtaaaatcacccactggagaacagagcattgatcagactttcttcccagcctctcttgcaaattctctcctgcaccaggtctcaggaggatgagaggagcagatttaatattgcaacaagtttggaatttttattgttctttgaaccaaaagatttaaactactaaatcaagacttaaagctacatggcaactttctgtcacctaagagattagggaggccattctgcaagggaaaactacccatactgaacaaattttaaagggacagtgggaaaaagaagtaagattgctttagtaataatatcccatgaatcctaattatttaacatatgagctacataattatttttaagattatttcattcattttatattcagatttttataccatgaatatacatagaaatataaaatttctaagaatgaaataaaaagatttttaaatgtcttgctaatcacagtagcctcacattatgattaacagatgtaaatccatatttcaaatactcttcttcaaacttttgaaatttgggagcctactattgttaaatgtgattatatcatcactgttttcatcgcattaggggctgacaagggttcagactagaaggagcacaggggttggctctggcactttcctttccttcacttgtgctttcattattattaacagcattcactatgaaccatggtttcttataatctttttaaggcgcttggactttttgtgatggttagcctaattaaagctagaaagtacagtccgtaaatctgtgtaactaggctctcataaactgccatgtactataatacactgcaagtaaagtgaacgatgtgcctgtgtcaaggagtccccttgaggaactccttctcttccctcaggcttgcccacatcccagaagagggcttagtgagaaacttcagaaggcaacgactcaaagcccctcacttttatggaccccttccacagcttgtttgggaccactgtttctttccattccactttcccttgtatcaaacatccccttaggacaggtagggttggaatagcagcgggcatctttttggatctaattagaagagggatacagttagttgggttcacaatgcaaataaagcatttggaatttgtatgatgacctgatgaaaaaacatgccacaatgtgcattttattaattgttttttataaataaagcagatagaggcagctacagtctggattaaaagtagagaaaggccaggcctcatgcctgtaatcccatcacttagtgggggcaaggtgggcagagagcttgagcagcccagaagtttgagaccagcctgagcaacatggcgaaaccccatttctacaaaaaaatacaataattagccaggcatggctgtatgcacctgtggtcccagctactggtgaggctaagatggattggtaaattgagcccaggaggctgaggctgcagtgagctgtgatggagacgttgcactccagcctgggtggcaaagcaaggccttgtttttcattcattcttttataaataaataagaaattattatatccaatataatgtttgataatatcatacaacatagcatcaagagtatgctatgaccatttgcagcagaacaatcctacacctttaaagtctacctgatttggacattttttaaaaaaggatgaagggttttctgaatggctgacttattttttctatacatgaggaaagaaccaaatgagctccaaagtataagtatactcacatgccttcctcagaatagatcaaataattataacaggttagccttgggtgcaagaatttcaagacaagtcaaaatatcatattttacccaatctcaggtaacatgtatttcttgggtacttaactatgttgtcagacactatattgaacttttagcatgtattatctcattgaatcctcacatgtaattcatctggagctgttaaagctaacatttgctcccctatagtctgatgaaagactatttttctaccttccttattagtctcttcacatttggtttctttttcatctgcagttcattattgattgcaagctaaatcgtcaaagctaacacaatttccaaataatgcttcccagccagcaagaatcatgcaaaatgaaaagcagtgatttgacatgaagaggacaatttttctcacagctcgaacataaattgtcaccattcatgaactccagtagactgctcttcctttatgatttgttcttattcatgccccaggtgaacaggaataaagcccagggcactgagccagtgtgctgaacccaagacaggtggcacaataagatactagcctttaaaatatgcattcggttggaacctgcaatttcatccacttctaaaaatttttcccaggaatatagtcagataccaactaagatgtatcaatgatgatgaccaatccagtgttgtttacaacaataaaaattatgagcaaactaaaggaccaagagtagaaaactgactaaggacattgtgataattaataagataaattactatttagccattaaatatatatatatatacacattttaaagtatttttaacaatgtataaaatgctaaagatatattgctaagcagcaaacactatgcatcaagttataccatacattaacatacacatacaaaattttatataaaaataatttatacataatttataatatatacttttttatataaatcctatatataagatttttaaatatgaaaacaattcagaatttttttcttttttgacattttctgttttttaccttgactgtataatttttaaaagcaaaaagatcacttatgatatagacttcaattcaacaaatacttttcagtagcctattatgtaattaaattaagtttaacaaacatttctttaatgaaccatacacatgactgtagatataataaagagtacaacctgatccctgctcttgatgagctcacagtttagcaagaggaacgtataacaagtcaaaacaactaatcctaatagttgttatgaaagagcagtggagatacaaagaggaagtagtcacctcaaactggaaaagcaatggtaggtaaagagacaggaaggtattccaggtagaataaaaaacatctaccaatgtatgctgtcatgcacactggaatggaaagtaaaagcaagtaagtgggaaaatatgaagatgaagaagaaggtaggggcattatcatgatggactcttgaagcattaaggtacagactctacagctgcaccagccacatgtgaattgaattcttgaaatgtggctaatcctaattgagatgtactgtaaatataaaacaccacaccagattttgaagacttcatatttaaaaatgagaaataactcattaataatttttatgttgattacatgctgaaatgacatttttgtgtacattgggttaaattaagtatattatttaaattgattttattcaattattattatttttcataatgtggctactaaacatatattttaaattatacacatgactcacagtatgtatctactggacagcattgttctagaggatagattagaggaacacagttctggaaggaggaagaccagttagaaagcttttaaagaacccaggtaagattcaatgaaagattaaaccaggcaagtgcaaatagggatagagaggatccgttggagttataaaagagagtgcattgacaaaacaagtccagttcaataagaaatgaggatctggtaagtgtctggaatgccctcagttttttggcttgataaccataggaacagtagtaaccttagggaaaataaggaatacaaaaggaagaccagatctgtctgtaaagattcattcattcaaatattatttattgagcatctaccatgtgctagttattatttagctggttaggtgctaggaaactagcagtgatgaagcagatgaggtccctgctctcctggagcttacttacactctattacaagcacataaagagctcaatttagccatgtttaaagtgagatggctatggcacattcagataaaaatgtcaactagacatttaagtataaaatttaggagaaagataggaatggtagtttgagatctggggatcattgtggtgattccacctagagacagcatgtaaaaaacaaaaccctgaaaaacactagctatctaaaggtaatgtggagaaggaagaatcagtgaaaaatatagatagaggagaactaggagaaaacagtgtcaaaaaagccaaggaagaataaaattttaagtgtggtcaaccatgttcaatggagtagattggttaacccaatgactaccaagtatccatatgtagctacgaggctattgcttaccttttggaaggcatttttcatgggatggtggggacaaaacccaagtcacaaatggctgaaacatgaatggaggtgaggagtaaagtcagcacctgagtactgttcctttgaagaacttggctgggtaggacagtggctagaaaagataaaatctcaagagagagcctaagatgagagagattgaaatatgttttcgggtatgagggaaggaccagtggagaggactgaaaatagaggaaaacagaggaatatgtgatagactaagatcacatgggagttgaaagtagatgcgatgaaaagcactgggggatatattagtcttgacaacaaaatggaacacctttgcttgacactccaggtgtcaggaggaatttttaaaagacaaatgtgtagaaagaaggacttgaaagagttcctgcctgatgaccagcactccctgttaattaggggatgattagggaaagtagggagagtggaaactgaacagaaggcctccagagagggatgaaagtttaaaatagctgctgaagggaacagaagagcaaggtgacaatgaataaataagaagaatatccagtagtactaaggattccattgagattggggaccatatgcttatgcgctatgaatagctcctattgtgtgtttgttctctaactgtgctgaagagtccatatgtggaagtgaactaattaaatggaagaactggcccaaagtctcatatttgcagagcattgaaagcagaaagatgatttgggaatctgagggtaatcgtagcagagaagttcaaaccattgcagatagaatcttgcctggtagaagaagtgatcagaagcacattgattgatgcaggaaaaaaataagagggttaagaggttggaaggctgtcctgataaggctggtgagctgctagaaagaaattgtaaataagaaatgatgtttctccaaaataacaataatatatcaacaataataaatagctcttcattattaagcaattactatgtggcaggcagtgtattaaaatttttttaactttacatttaattgtaatgacaaccctgtgaggtaattactattattatatcctttttgttttcttttaaacaagtaaattaaagtactgagagtttaaataacttgctaagactgtagagccagtaggtggtggagccctctttcttaatcactgtacaggccaaaggcaaagacataaagatatagtttatttaaaaaggagtaaggtttcacggaaaacagagggaaatggacagtaagaaaataagtggagactagagaagcagagttcagaaagaagagtacacagtgaatggagataaagttagaggagacaagaataaatcattgaggaggcccacaattttaatggtgctaaaagattaccagaatgagtggcattgaaaaaataactgaccctagaatttttcagctttacaaataagattactggagccagctcaaagcacatacaatatattacagacagttcagagaataaagttgaaaggcccatgccagcccccaaggaacttacaatctagagatgaataaaacaagtatgtttaaaaagcacaaaacaagccaggataagaaaatgtcagaaagacaaaactaggggctctagggcttgcatttttaaaaacattgcatttgccttgagagatatgaaacagtggacatgacactcttgaatacataaaattgagctaagtagcaaagtgaggcagcgtatttacagagagaagaaaccgtataaacgaagccgtggagaggcaagtccaaggaatattgtagatcaacaaccaagacaagttggctggtttgccctgagcacagaaggggtacagaagggaagactggaaagataaactgggaccatgtagtgccttaggttgacacactgaactttattcaactcaaaagctaatgaggcacttatgagagggcccgagccagggaattatagtataggaagttcaggcccagagcatcattagaatatcctttctgctcagaattttatacttatttttcagaatgagacgtgctcatgtgatggagtacaatcttgagagtgatggaactcatacattttccacgatgataaaaatgaaacttctggagtttgttcattgccctatataaaaataaactggtttccttactttttctgtaaagagtgtttctggtctggggatctaagtcaaggagaaagaagaacatgaagtaaattacagtacactcttcctttgccacatagcccttaaaacgtcatgaaataaagcaaaagtgaatgtgaaaggcagccttttaaatagagaactcataagttaacatgcatctgagaggtacatggagaaatgaaaaattttgctttggtaaaaaacaagattgacaaatagacacaataaaaaatgataaaggagatatcaccactgaccccacagaaataaaaactatcatcagagaatactataaacacctctacacaaataaactagaaaatctacaagaaatggataaattcctggacacatataccctcccaagactaaaccaggaagaagacgaatccctgaataaaccaataacaagttctgaaattgaggcagtaattaatagcctaccaaccaaaaaaaagcccaagaccagatacacagccgaattctaccagaggtaaaaagaggagctggtatctttccttctgaaactattccaaacaattgaaaagaagggactcctccctaactcattttataagatcagcatcatcccgataccaaaacttggcagagacaaaacaaaaaaagaaaacttcaagccaatatccctgatgaacatcgacatgaaaatcctcagtaaaatactgacaaaccagatccagcagcacatcaaaaagcttatccaccacaatcaagttggcttcatccctgggattcaaggctggttcaacatatgaaaatcaataaatgtaatccatcacataaacagaaccaatgacaaaaaccacatgattatctcaatagatgcagaaaaggccttcaataaaattcaacatccctttatgttaaaaactcccaataaatgaggtatttatggactatacctcaaaataatgagagctatttatgacaaacccacagccaatatcatactgaatgggcaaaagctagaagcatttccttgaaaactggctcaagacaaggatggcctctttcaccactgctattcaacatagtattggaagttcggcccaaggcaatcagccaatagaaagaaataaagggtattcagataggaagagaggaagtcaaattgtctctgtttgtagatggcatgattctatacttagaaaaccccatcgtctcagctccaaactcgttaagctgataagtaacttcagcaaagtctcaggatacaaaatcaatgtgcaaaaaaatcagaagcaatcctatacatcaacaatagacaagcagagagccaaatcatgaatgaactcccattcacaattgctacaaagagaataaaatacctaggaatacaacttacaacaaaggaccctcttcaaggagtactacaaaccactactcaaggaaatcagaggggacaccagcaaatggaaaaacattccatcctcatggataggaagaatcaatatcattaaaatggccatactgcccaaagtaatttatagattcaatgctattcccttcaaactactattgacattcttcacagaattagaaaaagaaatgaattaaaatttcatatggaaccaaaaaagagcccatatagccaagacaatcctaagcaaaaagaacaatgctggaggcatcacgctacctgactgcaaactacattacaaggccacagtaacaaaacagcacggtactagtaccaaaacagacatatagaccaatggaacagaacagcgacctcagaaataacaccatacatctacaaccatctgattatcaacacaactgacaaaaacaaacaatggggaaaggattctctatttaataaatggtgctggaaaaactggctagccatatgcagaaaacagaaactggactccttccttataccttatacaaaactaaagatcgattaaagacttaagtgtaaaatccaaaaccataaaaaccctagaagaaaacctaggcaataccactcaggacacaggcatgagcaaagacttcatgactaaaacaccaaaagcaatggcaacaaaagccaaaattgacaaatgggattataattaaactaaagagcttctgcacagcaaaagaaactatcatcagagtgaacaggcaacctacagaatgcaagaaaatttttgcagtaaatccactacaaggaatttaaacaaatctacaaggaaaaaacaaacatcatcatcaaaaaattggcaaaggatatgaacagacacttctcaaaagaaaacttttatgtggccaacgaacatacaaaaaaaagctcaacatcactgatcattagagaaatgcaaatcaaaaccataatgagataccatctcacactggtgaggttgtggagaaataggaacacttttacactgttggtaggaatgtaaattagttcaaccattgtggaagacagtgtggcaattcctcaaagatctagaaccagaaataccaatgggattgctgggtatatacccacaggagtataaatcattctactataaagacaaatgaacacgtatgtttactgcagcactatttaaaatagcagacacgtggaaccaacccaaatgcccaacaatgatagactagataaagaaaatgtggtacatataaaccatgggatactatacagccataaaaaggaatgagatcatgtccttggcaaggacatgaagctggaagccatcatcttcagcaaactaacacaggaagagaaaaccaaacaccgcatgttctcactcataagaggtagttgaacaatgagaacacatggacacagggaggggaacaacacactgaggccagttaggggatggggggctaggggagggaaagcattagggcaaatagctaatgtatatggggcttaaaacctagatgatgggttgataggcagcaaaccaccatggcaaacgtatacctaggtaacaaacctacacgttctgcacttgtatcccggaacttaaagtaaaattaaaaaaataaaataaacaggattgaagggaattaggagccaaattcacatgtctgtatgaaccagttctctttttagcaatcttctgaacatcaccacacatctgtcagcagtacagaagccctcaaaagtcatggccaagggcacttaccaagctgttttttgtactaaggacaactctaagtgtaggacattgaaatatatttatgaacttaataaaacatgcttgcttttaaaatgtgtttaaaaaggactactacaaagcaaccaatgggtttgataacctgagttagatctttcctatatgaataaaatatatatttctatggaaaataaaagttcctctgggagaactgggtctagccaggctttctcaaactgtattccaatgatccctgcatcaagaccactagggattattaaaatgcaggtaccagggcctcctccagacctaaaaatcagaatctctgagtataaagactggtgatcagaatgttttaaaacttcccagttgatttgtatatatcataaaccttttgaacctatggtcacccagaagcatactaaagcaaaacaaaactggttggctgagagaaagagtttgctgtaacctctcttctaccttctgaattctgactcttttcatgaacaaaacttaaaagaatgagcagcatatttatatttgcaccctgagaatgaagcagagcatctggcaaatagcagaataatcagaaaaatatttgtggatttaaactgagcagcgtggtcatgaaaggcatagtttataataaataacatactttttttcacatccacatttcctctcctcttcccagccttctctaaagaaagagaatacttactgcattgtcaacagcgtttgcaccaggacctgtattttgctttttattcttggtaatgagccatgcatcccccatacctagagcttagtggattcacagggttgatgctagaaagtatagataaagcttcccacacttttctcttagttacactttgacaaacagtatctgtttcctctctcataaagactaatgtatgtggtatttgacatttaccttttccctttttacagaaaaaaattcacagataaccatctggctatacacatctatatctcacagactagaaagaattgtttcagttgttaatcatataaacattatgcctttggcagtttcaaatgatgtgagttttaagcagctaaacagtccttttggtgacaactaattactcatagtgtgtttatagcaaaaattgttttataaatgcaattgtcacttctattgacactttccatctcattggaatctacaagtataataaaaataatttattttgatcaattttccatctaaaaaaaaaaaaacaaaaataaaacctcagtcctgaagcactcttaaaattgtaaaagtatcatctttaggaaaagactaatatctgcttctcctgaactagcagccttttcaagccttttctttgtttctttctatgctgtacagaaattgttgtcaggtgaggaattgccaagaagtgaaatgacattataaatgtcataggtcagtacacaggtaaggaagaaagactgtctagaaagcaagctaactttttaaccaaaacattcttgttatatatctgtttttgtcaattatgttccttaatgtgcataccttcctaagaaaaaagtaacaaagaaagagaggttacatgttcagcaaaagatatgcaatattccatgtctatagaaaatattgtgattcatgaaaaaaaaaagttcaaaaagaaattgaaatgtattatgcctgacaaattatactcccttatggccttcaggggcacaaaacaaatctcaggcttgagtacagagtctaaaagggtcataaggtgacatgcgttacaaaaacattaaaccgtcctttagcttatggtgcaccttgcattatattaaagtgggaatataaaaatagaattgaacatttgggaaaagttccacgcttggaggctaagtaggttttcttttacaggactaagttcaacaccttataagtatcaccttaattcttccaaatcaggttcagtttcatgaaaagcaatgttctttactagctcataactcattttgggttccatctgtctttatcagaaagagtagcatttttttactttccatagtcatgcaggtagagagtagctctctgctttaattgtcagaataaaatgttttctgaggttaaaaagtgaattcaaagggatttcgaatgtattagtatcatgaggttatatagtatctctatttcccattttctgtcccatgcagatattattcaagtgaaatatgacacatatagacttactgacaaatctttcataaaaataaagcaagaaatttgaacttactaaccaggttaaaaatacacatttttaaaattgtatttaaaaaaatttttaggagaaaggtgaccagaagtatcatttttctaccttattaagctacactgaaaaatgtggcatgtaaaacaaatgagtaaagaccacctccaacgacattagaaaaaaacttccaaatttaagaatgattttcataagtttctcaatcacctaatgttctgataaattttacaggagaaaaagaggaaatttaagtcacagaattgaagttgctattaaaaaataaccagaagatttaagttttaaagtctcattttttaagaaagacccaaaatggtaaaaggcttagttcccaattccatgactgcattggtctgctggtacagacagctattttaaatcactcacaaaataatttatttgtaaaagttcaaagatttaatatatgttcaggcagagtgaatagaaatgcaaatattcttgatcacaatgaagctttttatgtaaaagcctgcaggatttgttccataggatattactacttcctcttattcatagttgttaagtaattacatttttcttatttattgtgttaaatattaacataactttttctctcatctctgtcacattacctcaatgaattttcttgaatatttctttcagcctcttaatgaatgacctattaaattcattattatgattatagtaaaccattgttactattcattcacatgacattatatattttaggaaagtactattatcacatgaattattttatgatcttttttatagcagcataaacgtcacaatggctttctttgccattaaaaatctcatgcagaagaattcatttgtcaacactaaccagcaaaaattatctgcattcacttaaagctacaaatacccattctacgtctacatcccagaccaatgcagtctaacctgcagagttcaaatttattttattataaaaagtttcctgcactttctgtgattgtctttcaatgcatggattcaatctaggtcaggtgcttccataggaagagtcaattttatctagccaagcattaaagatttttcttaaaggagatgttttatattgggaataatggaactaaggaatgtgaaaaagggcttgagaaatatacaggttgttattcagcatcagtcttattgcaccaacatgggtatacagcagctattgatgttgaatgtatttttttgttatgaaatataagaaaatttcagggaaaaaatgctcaagtcttgctgataacacatcctccagtatgtattaatataatgagggtttgagggacatgtcccaaatccaaaaacacgccatcaactgaaaccctgtgcagactacttaaggaaaaaaactagcatggctgtgattatactgccctctagtgtcaaaataaatgttatttacactgaagttcatttgcttttttcagatcagcattttcatgacccatttgtccaactatgggaatgaccgactgggattatatacatttgttaatctggccaactttgtgaagagctggaccaacctgcgacttcagactctgcctccagtacaactggcccacaagtattttgagctgtttcctgatcagaaagaccctctctggcaggtaaaattaattaaataattgatataaccagttaattccaggaacataattctgtgagatatcccaaatttgaaaagtgaaggcacctgaaaaaacctgcattttggaaatgttagtaaatttgagaaactactccttcctaaactgtagttgtatatcattgctacatattgcacccaattccctgttcccttgcacattggaaattatgggattcggaaagttcagtgacagattcaatgaatataacgtcttcaatcaggagtgagagataaatctacaggttgcaataggctggaagagtagaagatggtaaacaggtcgtttgttagacaggtagcctttgaacacatccccatatctctaatgactaaaccatattaaaggatctctgagaagagttcagaactgacatctgccttctgaaccacgaggtacaccaacagccaacagccactgaatgtggacagctttcaaaagtattaattggggattaatatgggggaaagcatttcatgggaaaatcactgagcttcttaagataaataccacatgaatacagcatattcagatgactctgggggtaacctagatttcaaagcatagactcttatgtatcatagaattgcaggaacaactttgaatttaaattgtccactccatgatctgtgaaaaataataatcttggcaaataattacatattgcttattatatgtcagacggggcacttgacatgtgttaactcatttaatcctcacaactaccttaagtggtaggtacagttatgatttgcattttacagatgaagaaactgaagcacagaaaggctaagtcaattaagcaaggtcacacagctagtgtgttgcagagcaggaatcagttgtaggccatctggttccaaaagctgtacttcttaatcactgttctaaacgctactagagttacagacagagctgatggtaaaacaataacaatcatcagaagtagaactcagtaactttttaccacagattgaagttgttaactctgaactttatactcaatgcattcagctttcaaccgtaagttaattacctcctgagcacacacagatgactccaagagacataactgcatatttagcaggttaaagttggtggttgtggacttatgactgcatattacttttccgttgttttaacaagcatcttttcattttaaccaccacgaaacatcaccaaatgttagccaatggaaagacatgcaattttcctgctaattcaaccttacttttaaactgaaatcattatttcaggtgacaagttttaaactgtttttttgttttttttttcagaagaacagccaaaaagaatactctcactttagtcttaacatctgttgcttattaaaaataagcagaagtcttatttaacttcacatacctatggtattaattgactagaaataaaaaagtggtactgtttgcccattcctgaaataatattaaagggtactgtaattcttcctccttttctacataatatatactttgttcttaaaatgaagggtgttctaaataggacttgtgcagtggatgttggtgttaaatattatagaccaaaagcagaatccctaaggtagtaattcaccctcattattcccttttgctaaaacttaggactttctagcatcatagtctataaagttacatttttagatatacatttatcaacctttgacggcagctgagacgtatctgctgtctctttagatagtagtattttggccagatccctatccctttgaagcacagctggaaagctcaaagttacttagaataaagatctgacaacttacatttcagttatgtattgaatactgagtgtatcatcttttaggttagcaggaagcataatctctgcccagtaagctaactattaaaaaaaatagaactgctagtagccaattaaactcttcatgctatgagactgtttacccaaagtggaaatactgcctctctccagcctgctctgtagactctcaacctcaacatggaagggagttattcagaacttccatgatgccacttcagggctttcatttttttaaaagagtctattttttatcccagcgtttcctggtatacttttaaagaacacaagttggaaaagctggcacacaatggacacattcatgaaaaaaaatacatctctatgttcttctcccatttagaatccttgcgatgacaaacgccacagagacatttggtctaaagaaaaaacttgtgatcgcttaccaaaattcttggtaataggaccccagaaaactggtgagaactttttatgttatgattaacgagtgtaaattttctgatgactagacaatgagatcttgtcacaataagttcgtaaacttcccataactgctaatgaatgaataacatgtttttctctgacataattttcatttagcccagtaatatacctaaatgcttatcgaagtgttttttaagtgaagggaataaaacagatgtcacactgttcaaatatccagcagtcaatttggtagcacatgtttttttttttcccccccaaatgttttaattgaaaagtattgtaattaacacttctaaaatcaaagctgatcactgacaggattgtatcaaaagtcaagagggacacagataagtacctataactctttataataaatcccttctagaaaaatagtcccttaggctgccattttcctaatattgtttatttgtaaactatttcttgcagagatgactattttttaaaagtctaaaagatatttcacaagcagaattcctagacatacacaaaactttgtgctaagaaaggtgtttattcatacccaggagaaatcttttgcaccttttcttaaattgatgtgcaatttttttcaccataaacttctttatcaccataaacttttttttttttttttttttttgagacggagtctcgctctgtcacccaggctggagtgcagtggcatgatctcagctcactgcaaactccgcctcccgggttcacgccattctcctgcctcagcctcccgagtagctggggctacaggcgcctgccaccatgcccggctaatttttttgtatttttagtagagacagggtttcaccgtgttagccaggatggtctcgatctcctgacctcgtgatccgcccgcctcggcctcccaaagtgctgggattacaggcgtgagccactgtacccggtctataaacttcttgtttctaagaatcagtattaaaatgaagcatcatggaagctttaaactaccagacattcatgctatatcctgcatgataaattatttggggcccttggttactggcttcacagaaaacagcctttacaatcatattgcttgctaaggagaatacattccctctcctcattgatccagaaataactgaggaaaattctgtgcaatgtacacagggagttcagcatgttcatttttttccttaatgtcatttgcagatatcaatctgaaaacaataataaacatgacaaatacttacatttttcttgtccttatttatttcacttgtccttatctatctaaagtcaaaaggcaactaggaaaacatttaaactaaactctcttcagtgaactcccagtcatcacataaccttgtcaagactgataacatcctgaaggcttggtagcattttgctttagaaagtcctgcaggattcgcttcctctcgtgttgtgctggatatgcagacattttgatatcatggttagatggtagaattattacttgtcctcttaaactgaattgggtttccaaatgtttgttacaatttggatatggcatttgtcgttggaaaagaccttttatagaaattgattcttttttatagaaattgatttttcccagttttgttgaatataatttacatgcaataaaatccacccattttaaatgtacaattagctgaattttgaacattgcacacagttatgtccaccaccacattcaaaatacagaacagttgttagcctaaaaaaatttctccttgttcctttgcagtctatcccccccgatccccaccacatccccagccacaagcaactactttgtaccactacagttttgccttttctagaacttcacataaatggaagcatgtattccgtgtagtcttttgtaactgacatctttcatttagcataatacttttgagattcatgttgctgtatatatccatattttgtgaaattgattttttaattaaagtagtttctcatatcagttacatgagaattaaatagcttcatttttaactgtacttttgtcaaaagtatttttctgggccaggcgtggtggctcatgcctgtaatcccagcactttgggagaccaaggcgggtggatcacctgaggtcaggagttcgacaccaccctgaacaatatggtgaaaacccgtcactactaaaaatacaaaaactagccaggcgtggtggcgtgcacctgtagtcccaggtactcaggaggctgagacaggagaattgcttgaacctgggaggcagatgttgcagtaagccaagatcgcatcactgcactccagcctggacaacagagtggactccatctcaaaaaataaaaagtatttttctggataattttgcagatttctagttatctggatattcaagtatttttcagtgttgaggctgacaaaaatataaaaccgaagatttacagatggttatttaaatgtgtgtctatgattatgtagttgagttaccactgacaaaatatatatgcaggacagtttattcagacccaagaatatgtacaggtaaagacagaattcagaaaccacaacttaacaattttttaacacttataaattcattatgccttttactgactatgcaaaataattagattacatccattttttctgtttgtctaatgctggtcatgaaaggctattaaaagtgaacaaatgtatttaatacaattcttaaaaataagattcagaaaagaatgttttcagttgatctaagaaaggaattaatctctctgctttttttctcacattataatggcaatacttatttccaaaaagatatttttaactttaaaaatgcctcatgcatttttctggattatatctcatgtatgtaattgagattcaaatgtatttaatgtatttatttattgtaattctaagttatatctcaataaagtttttatctggaaaaatgccttttaaatattgagatatggcactctttaggtgatttcacctaggttacctcgctaatcctcataaaacactgatagctaagtattttcttccccactacacagatggaaaaactaagactcaagagaggttaaataatttttgttcaaattcacacagctggtaagtacaagaataaaaatcttggtcctagaatttacctgacttcaaaaaacatgctttttctactttaccgtggatttcatgtaatggagcttttttcctccaataaattttagatattgcttcatagttattctaagtcagtgattctcaagggtggttgccagagcagcaacataagcatcaccagaaaatttattagaagtgcaggccaggcacggtggctcacgcctgtaatcccagcactttgggaggccgaggcgggcagatcatgagaggtcaggagatcgagaccatcctggctaacacggtgaaatcccgtctccactaaaaatacaaaaatttagccgggtgcggtggcgggcgcctgtagtcccagctactcaagaggctgaggaaggagaatggcgtgaacccggcgggcggagcttgcagtgagccgagatcacgccgctgcactctagcctgggcaacagagcgagactccgtttcaaaaaaaaaaaaaagaagtgaaattcttgggttataacaaagacttaccgaatcagagatactgggatagggctgtgctatgttttaacaagcccccagatgaatctgatacatgctagttagaggaccactgttttaaggcaagcttgtgaagcacatttttactttgtatatcatagattactgttttattccctataatgatctatgattacagacaaactgttcattgtttggctcagatataatctaggaagactacctctttcaattcattttttaagacaatattgctgttgacagagttattttaacaatttttctattgtatagatatggtagatttaagtaaatattaaagaaagcttaatttataaatacttaaatagtatttatttacttaaatattgccatatttgtaccatttaagtaaataaacactaaaatactaccttacttccatattaatactatttaagggcggggcacagtggctcatgcctgtgatcccagcactttgggaggctgaggtgggcggatcacctgaggtcaggagttcgagaccagcctggccaacatggtgaaaccccgtctctactaaaaatacaaaaattagctgggcatggtggcaggtgcctgtaatcccagctgcttgtgaggctgaggcatgagaatcgcttgagcccaggaggcagaggttgcagtgagcccagatcgtgccactgcactccagcctgggcaacagagcaagactccatctaaaaaaaaataaataaataataataataatactatttaagtaaatactagcatattaatgctatttaagtaaatactatactatcatcttaatactatttatactactattatttaattagtactattaataataccatattaataccatttaagtaaataaataataaagaaagcttacctgaaaaataagaaaattcaaagttttgtacaaatggcaacatgacataattactaagcataattagagtaatttctccaagtgagagaaatattataaggccatgtcttgttactattgctagctattgacttggaatataattatcaagtcctgctccacagattgtataacagtgtaaataatagtatatttctctcttaggagtagccaatatatagaaatacttttatattatgatcttttaaacacagtcacagttacaagtattaaatacatggctaaatctttgacaaactgaacccaaactgccttactttctcttgtaccaatctgactaagctacaccctttatctcctcatttagtcttataaaaccctaactgtacagtttatgacattgctcactttttgaaaaatcacacccttgctccccaatagtcacaaatatatatacgtacctgtgatacaccattctcttccctagtaaatgcaaattctataagttatgtcgctaagaaagggcaccatttttttttccaatttagcaatttaaacaatttttgacactactaagtacattgaagcttaagcaaacttgtggaaagattaaattctgtcttgagtttaattagctttcataggcctctggaagaacttaatatgagaacccaagtattgattttggtaatgtaatatgttaaataataatatatttcatttatatagtgccttattaccgtcaaaatgtcttcaagtacatgttctttcattctcagagaaaatctatgaaataagtaggcaggtgattttccattaagaaagctgagacaggtcaggagaggtgactcactcctgtaatcccagcactttagggggccaaggtggaaggattgcatgagctcaagtgttcaagactagcctgagcaacacagtgagacctcatttctactaaaaatttaaaaaaaattaaaaattagcccggcacagtggtgcatctctgtagtcacagctacttgggaggctcagacaggaggatcccacgagcctggtgtcaaggttgtagtgagccatgattgcaccaccacactccagcctgggcaatatagtaagatgctgaaaaaaaaagaaagaaagagagagaaagaaggaaagaaagaaaagaaaaggaaagaaacaaagaaagaaagaaaagataaaaagaaaactgagacaaacagaagctaaaagacaaagtcacagacaaatcagtcattgagctgagattgaaagccagttctctcaatccctgcaacaggcctcttttcacaccacactatctccattttttagaacctgcttctattaaactgccgattatctattcaatttatttccagcagtagttgtaataaatctgtttggatcattctaatatttattcatgactttaaagtgttgatcataggaaattgtgttttcatttaattaatttctgaacctctattgtctttctaggtaccactgctttgtatttgttcctggttatgcatccttccatccttagtaactcccccagcccaaaaacctttgaggaggtacagttctttaatagaaataactaccacagggggattgattggtaagatgggttattagtataaatctaaaagtatatgtactgtgcacagtataaacttagcactaatatttagaaacatctaagtttgtagtcacaaataaaatttaacctctgtgccttggaaattgattgaatatcataaaggggctcagaaatttttcagaacaaactcttctcagtttataaagagacttgttataccaagaggatcacatgtaatttcaattggcattaattttctttgatggtaattatagatattaagtcagaagaatagcataatattcagaaatttaattcctttctactcgtaaggaaaaaaaattttcatatatttttcttcttgtgcactttttatgaagtgatgctacagccaacatatgtaattttctattttctttgtcacataaaaggaaaaataaataaataaaactagaaatgtttgtatattacatgagtaatcaaagctataaaaaaaactatcaacaatacacagaatttaattcttgcctttgaatcaaaattagaaatatatcaaccatctgaacaaacacttaaaaactaaaaatgtcagaatacacaaaatacagtaatgtagtagagatagatggtacaaactaacatgttaaccataaaatgtctctgaaggtcttgctatgaaggtataatgctgaacagagggtggtataaaggagtgaattataataattctgcagcataaatatattttgcatgtattttagcatagtcatatatatctcttgtcaaactgcatgatctcaattttataattatcagccccctgaggagctgcttatgagaagtccgaatggaaaggaaaagaaatggattgagtataatttgagcacctactaggatttacatatattctaattgttatatatttcactgccaatttttcagttcagggtttgatattgattaattgtgtggtgttacataacagctggaaaatcaagaaaccatcgacagtggccaggcacagtggctcacatgtgtaatcccagcattttgggaggctaaagtgggtggatcacatgaagtcaggagtttgagactagcctgggcaacatagcaagaccccatctctaacaaaaatacaagaattagccaggcatggtggtgtacacctgtggtctcagctaatttgggaggctgagatgggaggataacctgagcccatggaggttgaggctgcaatgagctgtgattgcaccactgcactccagcctgagtgacagagtgagaccctctctcaaaaaaagaaaagaaagaaaccatcgactacttcagctgtatttgatcactgactcaaatatacatgccagtatataattatagaataaaatgatattaacatcaggactaaaaggactgaataaaaactgctttggaggtggacaggaatgtattagtattacattcctgtcaataattggattccctaggatgttttttcaaagaacatatttttgaaaaatttatggtaaaaaattattgcaacagttattcttaattttttaccataaattttacaaaaatatattttggtcatcatgtggctaggtactctaataggaacaaaaagtccagctgggcacactggctcacacctgtaatcccagcactttgggaggctgaggcgggcagatcacctgagctcaggagttccagaccagcctggccaacatggcaaaaccccgtctctactaaaaatacaaaaattagctgggcttgttggcaggtgcctgtaattcgagctactcaggaggatgaagcaggagaatcacttgaacctgggaggcagaggttgcaatgagtcaagatcgtgccattgtactccagcctgggtgacagaaggagactccatcaaaaaaaaaagaaaaaaaaaggaaggaaggaaggaaggactgactcagggttgacccaaataacaaataaatgtggagtattgcaaaaaaaatcccatttttcaggtaaaagaaaatgctgaagttttatgttttatagaagtagaaaaacttaagggaggcaggcatttgcttttaaccctgaattgttaaaacactccagtttgttcactaattctttgaataacctgaatttacattctataaatgtgagcctatttgtggagcttcaaggtctcatactaaaaatatgaaccttttatttacttctctattaatcgaacatctttcaaatgcctgtaagtgccagcaactacactagaaaaatgcggacatataggcaaacaagagctgtgccctgccctctccatgagcccctggggcctggcaaaatcaacacattataggtccaagatccagacttgcttgaggaggttttcaaagcctaaactgttccagatacaaaagacttctaggaaggtatggcaggtttaagaagctaaaatttctgctcttttgtgtgatttttgaagcctttttcagaacaagcaagtttgagtcaagcttggaccaaataagataccactagacacttgaaataatcttagcactcctggaaccagtgtgagcttctacataagaagcatcctgaaagttggcactctccgtaaatagaatgtacaccagaacaaatagcacatcaaaccttccagaaatttttgtatatctctttctccctaaaagggtgccagaattacatatcaccaacaagccaattccagacaacataaaaggatttctttactgctctgaatctcaagatatcactgtgttgcaccagctaagctttgcaatatgttaacaactggaatcctaccagaagctttatcatgtttgaggatatgatctcagtcaaaaatctatgaacatctcatgtgatcttttggtcaaaagaaaacaagacactgtaaaaaaaaacaggtcattgcatgaatattaatgacttttttattcagtaattattgaactaccttgtcttggtagcccagtgtgataatggcttatgaattgaagggggtggcaatggaggctgagaatccctagaagctatatttttacagtcactctaaaaaatcccttttcctctaaaggatgttccttagtgcttcagatatatttcttatcatatgctgaattagttacatttgacaacttttattcaggtggaacattaaataaaattctacatttcagtgcttgaacctatagatatccctgtgttcattctgctggtaatttgaattctctctacccatgaggatatagaacatgaccttgggaaatttgttagagttttatatttggaatgtacatagtttttaaacttctcttacaattattctaaagaggaacataagtggctctatatgagaaaaattaagcaaataagcaatatttataccagatatactctgcatctttcacactatgtgattaaacgtaacaccggcacaatacatttgtagaaaagaaattatttcacttgcaataaagtaaaaaatattttctctaaatccttttaaaatgtctgaactgaacatatcgtctgttttaatacgattttctttttgagtacttgaatttttctctgtacagtgtttctacattgagacacatttgatatagttaggtcgatcactgttgcagtttgatcactctgtgtctacatttttgttattgcttatattttttcctgatattaagcaaaacataaagaaaatgtacttagaaaaacatcttccaaacacattattagtgttctagatatttttctcttcctaactatggaggacaaatgctgtaaagaaaaagccttttatttaggaaacacatgaatttgtgggacacttttaacatctttggtcaccagaatgagtataaaccagaatcttattttgagaaaaatattccttttctaggtatatggatttcttcccagtcccatctaatgtcactaccgactttttgtttgagaagagtgccaattacttccactcagaggaagcccctaaaagagctgcttctctggttcccaaagccaagattatcaccattctcattgacccttcagaccgagcatactcctggtaccaggtaaggaaaatgcaaataaaatccaacagggagaagtggagtatggacaatggagcattgtttttagcaatacccactagctcaggttttcacaaaagagatttgctagttgtttgatatctacagaaaaatggacaagtttttcttgatttctattgagaaatttcctccactaagtttttgttcttattttattaacttaatcaattaatttaataaaatgtattaatgcaataaaagaaactaaattaaaatataacaaaatattatgtacttttttatatctatgcctctatatatctgcattttaaggtaataatttaaaatcattattttttcatctaatacttgtgtactctataaagagtcagattgcaacaagttcagacattgaggtttatacagtctccattgcaactctaccattgtatttcgaaagcagccatagacaatatgtaaatgcataagcattcctgtgttccaataaaactttactgaataggcagtaggccatagattgctgaccctggctctaaaacagcttaaatagctacttgtactaaagaaacagcttagtggcaaaactaatatatataagaatctttaggctgggcgtggtggctcatgcctgtaatccaagcattttggaaggtgggaagattgtttgagcccagttcaggtgggaagactgtttgagcccaggagttcaagaccagcctgggcaacatagggagactctgtctctacaaataaagaaaattagccaggcatggtggcacacatatgtggtcccagctacttggaaggctaaagtgggaggattgcctgagcctgggaggttggggctgcagtgagctgtgattgcagcatgtactgtgcagagggagactctgtcaaaagaagagagagagagagagagagagagaaaagaaagaaaagaaagaaagaaagaaagaaagaaagaaagaaagaaagaaagaaagaaagaaagaaagaaagaaagaaaaagaaagaagaaaaaaagaaagaaaattctacatccctgagagcctaacatgtctaaatgtttcttgtatactcattgccattgttttctgatgttggttagaaccttgcacaaaaacgatcactttgaaataatttaacaaactctagtaataatatatatgtcaaatacacttttaataaatcattgcaaataggaaacaatcttttaaaacttgtttcggtgataatttaaccaccagttggaagggtttaatatgaagcagtcaaaattaacataagaacatagtaaaattaatagagtcaatgtctttagtctctaggacccttagttctcatttctcagttttgtaacttaaaaaatgctttcctactgttcatgtgtttatccgttcatcaagtaattttaatgactaccatgtgcaaagttttgttctaagtgtgatttgaaaaataaatttgaagctatacttgaaattgctttcagcctaattggagaaatatgtataaacaagcatataaattagaaagtaataagcgactgacatacagactccttcggaatgacaaagcccacctgacaaagaccacctgggaaaggctgtcgcagagaagcccaaataccagaaccatggggcactttcttaaataagggaaagatacgtaaggggatacatttaggcaaaattaaaatgaagaagtgttttcataggtgcaaagcagagctgtgtaaaggagttatcatcaggtcagtgctgaaaagcagactgagggtcctattttcttggaaacaaaaatgttaagacaaacgtggaatgttctatgtacaaaaacctctaatctgaagtctgcaaataggctggatatatgactgcttccctgtgttaaagtgacccacatagcttagatcctccctacaagagtgggatgttccattcttattgatttgatttaaaacagctaagttcttgacaatcataatattagagaataaagttgctcattactgagtccttttgctacttaacaaaagcagtttttgaagttcacaagaggaagaacagattgttggaaaaggttttgtggcaggaacatagtagggaaaggtcataaaagcagatgaaatcttagggattttgataataatctgaaaaatagcgagtggagacatcctggaaagctaagatccataaaaatccaccattctatactaatcattcacgccaaacctgaagccatcttttaaatcaaaacatacagcaaattgcaaattgcctgatttgattttgcaacttctaccttttccaccaagtatctggagaaaagagaaataagccttaattgactccaagaaaaagaagaaaattggagcttggcaaccacttagtccctgaaaaatagagaatttacagaaaaagaaggctttaaggctgcaagctaacaaaatgtcctaaatattacaaataaatcacagtggcaaaatgcaggccttaacaaagtctagtagagtttgtagtccagtgatttgaatctcaattgcagaaaatttgctattcaactagatgaggtaaacatccacaaactcaccactaagcctgaatatttattggccaatttaaagaaaaggtgatttcctcaaacccatgggcctaagcctgagcaatcctgttggattgctgctttctgcattttctgcacaataaatgattctgattcaccgcaaaggttaccattagataaaataatcttggcttttagatatcagggaatgtatgataaaagctgtggatttcagataatgtacatgtcagactttctagtactttcttcatttaaaagagctgataggccttttctaatctaaaactgcattactagatggagcaaaactatttggcagaggtagtagggtgcttctctattatagatattcactggacactataaatggtttgcttatgagctggaaagagggcattaacacagctttcaaaagtttactttcacaataaaatacatacactaaggaaacaactcagtaatgctggtgaaggaatcctatcgataggaattcaacttctaccagataaattctcaaaaatttactcccataagtatcataactttaaatcctgatgctccaagcaaacattttcttcctttactaatttcaaaatagataactctccagcagtgaggcacttctttctttagctttgagacttgtcacaaagattgatttttaattatttatgcctacggttcagattagtttaattatccaccttttcatcatagcatcagcgatcacatgaagaccctgcagctctgaagtttagcttctacgaagtgatctcagcagggccccgtgcaccctcggagctcagagccttgcagaagagatgtttggtcccggggtggtatgccagccacatcgagagatggcttgtttatttccccccatttcaggtatggagtaataaggatttacatcatgttagaatctcattaagttgatgactttgccttaaggttaagaaaattttcaattgttaaactattactagtttttcctctttagttgtaaataatgaggctatggcaaagagaaataggcagaagtagaaaaactttaattttctaagagtatttcagaataattctccctgctctatttgctgtgcgtacctttcctgattgtaaaaagctttgaaagctttagatacgattcttatcctgagaataaagtttgaaagagaacctcttaaccaaacaagacaaataatgttttgcttaattaagtgccattatttcctttttgaaccaccttgctgaatttttgataagtcctatgtttttctcagccccttgaatttcttctgcctggcatcaacctagattgcaaaatcagcccctcatgggatcatgtaagcaatccagacacatcagacatggtatatacctgtgagtctagagccatgctttccagtatgacagccactaccacatatggctattttaatttatattaaaatcaaataaaatgaaaagttcagttcctttagccacattttaagtgttcaatagctaaatgttagacccagcagctatagaacatgttcatcatcacagaaagttctattgaacagtgctggtctaggctaaacagaaatatcagagaagaggtatggatagacaagacctgctttgcaggctttgtggcctttaatcctggtctcctctcatcttgctgggtccaccctccttggcataacaagcaacttcttcttagtttcttgaggaactttgtccatgttcaagtttcctgagaatctaaccttattctccatatggattatcgaaatatttcttcaaacctgacagtgctattcctgaaaggaatcgtgaggaatgacatgttctctgtcagattacatctgagtttattataacctttcttcttttctattgtactttccagcttgaatgacaggatcactgctttgtctgttttgaaagttggtttccatttgtgattttctagtcacttttctaagctctcttggtctttcaactgccttttttgttttcatagtgtgacttctcagactgcaaacctgagtgtacttaattggtgtgatttatttcttattccaggtcattaatgaggatgacctggattctatctaacaccaatgcatgcaattctgctcaggacagtgtctctcactgaatgagtttagaatgcagaaatttttcattatacagtttacatgtcttttttcaatgtgcatttttttatttgataatttagttgctaattattgatgggcaacaactaagaactgatcctgctacagtgatggatgaagtacagaagtttctaggagtcttgcctcattataattactcagaagctttaacgtaagtttatattctaattagtttattgacatttcagcagagaattgatttcaaagaaattgcagtttggtcatacaactgtcaggttacttgttccttatatactggttatttttcaatttgacattaaccacggaaaaaaaaaacatttcaacagtgtgacacagaaatgtcctaaatcctgtgttaattcctaattgtacaaagatttccctgaaaggaaagtagagaaataaaacagtggtaaatcttaaaacaaaccacaaaccttaaaagaagttatctgaaataaattcgtaaagcctgagcctatttaacaggcaatatggggcttcttggaagtatgaacaggtgagtaactaggtagtttaggaactgactcttctctcatttgtgtaattttcagaaacaatgtcatacagcaagaaatagtccataggtgattgaataagcagagagagatgtactattatcgctcctaaacaaacgtccttttttattttttcatctttgtctttatccactatttgaccctgtcatctctgcttcagagtcctcagcagttaaagcactggtttgatttttctgtttgtttgtatggttttttgctggtttcctccgattttcttaggtaactgactctgtaaggtccatgaccagggaccagtaaggaactagggctgaagaaggcagtcactctcggaggtgtgcccatgcctgagactgagtgctgtgtcctaggtgcctctcttacctcaccctagtgctgactctgggcttcacttagcatttttgaagaagacctctatcttactgcgtccatttagaatagttggcaatcagatttaggagaattatatttgttcctaccacatgtgtagagcaactggaagatactgagttggattgggtcatggacctgactcacaccgtaagttggtttttttttaattacatggactgagccttaaaaaaaaactgaaaaagactatcatggaatttttccattgtgtttttcagtataaaactcagttccacagatcgagtagttttccctttttttgtactctttaatatcaatttagaaagtgagaggcaggtttcctttacctttcaacaaactttgcaggaaaaaaagattagcaggaaaacatcaaatactgcttatatctcctacaaatcaaatatagagacacgtaagggaggcattttgctgtagaggacaaaggagtaggtggaactctgcagttttgagcttccttcctaagagtcatttatactttgctgttattattaaccttctgacctctgtgttttctatactatgagtactgtcagagttttgtatagcttagttcaagtactaacacagacactggccttaggtatttaacattcaacttgaccttaaagaaagctgagtgatttcagtttgcacttaaaaattcaagaccattttctgttctgtatctttttaagcatctcttggaaaagaaagcttttattttctaaacagttttctatttcaagttaggttatctgtgggtcttttttatagagtatgtagcaaagcattgtatttcagaaaaaaagaagtacagtattctataaagacagagttgctttttcttatgggatggtccttgacctgcatgctgtgtatttgtcccctctgcagccagctcagcagcaagctttttattcatctccactgctgagaaaaggcagtgtaaacttaagagaatatcaaagcaacatactatatacaaagaaccgtagtccgtttgcacctgagctgtatctagctaaaattactgattatatgattctctaacctggttgggggctcagtgggtgaaatagcaagataagatatgtgtagtccctgaaaccacagtttctattccagcagtgccacccaggctctcaccctgcaggtggagatactgtgtttccattccatttctttttatattttcttgtcaatcatcaattggcctgacataccttgtaaaacctggcagtgcactagttgtagaatatttggaagtttcatgtcattgtcttgggtctaaattgatcatccttcaccctatgccctttgtagttgtttatctgaaacctgtcttcacaatttagttactcctattagagtaactatactgatagctgtttctgtagtgctttggaaatactgaggatgactagaggtacaaaatatatatcgtcagaaatgccatttataccagtttgtatactttgtacactttggtattgcttcttattttttcttcttattttcctgctggtgataatgacgactatctcattggtgcttaaaattttttttttctcattggaagtcctctaaggatatagtaaactgtaaaccaatatgaattctcaactaactacataaatctagtgctttgcatgtagtagaataaatgaatgaagcaaggtctatacaaatgttttgctatgcaatcttggtgtgaaagagtactccaatttaagatatctctaaacttattatcttccatatagcaaatttcagcatcaaaactattttcaagaagaatcacaataagcccccaatgtcaagattgttgtttattcttttccacaagtgctaaagaaagcgttcaagacttttaaagatatacaaagtcactgaagaatctgtgatgtcttaaaatgacttattactgttatcatgggtgttaaatgacatatttaatgttaaataatctgattttctcagtgattgtgtgaatgaaataagcaaaataagctttaaaaatataaataagaactttctcattcaatcaagtaaattataatttacaactcttgttccacatacccttaatccctaaatgggattaatatattaacattactttagtttttgtgttacatgttatatagtgttttgaagcaatcatttgaaataagacaggaaaaacaatgcttagcatggaattgtactaatttgtatacactaaaatgaaaaatatgaacttttagttttgccatgaatacatctgttcacaataatacctagccatcaatgccaatgacagatgtcttcatgtttagaaatactagttagctaaatacctgaacctggcatctttatgtctcagtcagttaacctatttgtcaagatgaatgaaaccagactatgttatatgaatttttagtattaatttactttgaaaatgtcaataaatgggcaatgagaagttgaaagccgagagttgagtatagttgtttgtttgttttgtggacagaggttagctaagtcacgaaggactgaagctgcttcaaaattcagaaggacttcaatagcttttaatataacttccttggcaacgaaatttatattgcccgggaattgttttcctacccactgtagataaattttagtacaaatgtactacactaaaactttcttattagcaaattatagtagccacagtaactaaaatctgctggttctctggatggcatgaaagaacacctagaaatgctgagtagggaaaagaaaaaaatagtctattctaatttcttattataaatttttaagtggttgtaacagttcaaaataaatatacatttatatgtcctatatatctctctctcttcataaaaacacaatgtgatacgtacaattagctccattttttcagattaaaaaaaactggggcacaggaaagttaagccaaaggtcactcagcaagtaagttgaggaggcaggattgaaactcaatcagttatctctggaacctacattgccaacctgttaagctcttcatattggcacaggatgttagaaccacagaaaaacaatactgtgaatttttaatagtgaatagcatattaacaggaagtgcttccttaaaaagaactagagccttaaaatgagctatggaagttgtttcagattttattatgaataaaatccatttccaggtgcactggatgtcacttttcttcataaatatgtaatcataaagatatgcaaattaaaataacattgaaataccactacatacccactaaaatggctataatccaaaagacaataccaatttactgtattagtccattctcacgctgctatgaagaaatgccccagactgggtaatttataaagaagcaagatttaggctgggtggggtgtctcacacctgtaatcccagcactttgcaaggccgtggcagatgggtcacctgaggtcaggagttcgagaccagcctggccaacatggagaaacttgtctctactaaaaactcaaaaaattagttgggcatggtggcaggcacctgtagtcccagctacttgggaggctgaggcaggagaatcacttgaacctgagaggcggaggttgcagtgagccaagattgcgccattgcactccaacctggggaacaagagcgaaactccatcaaaaaaaagagagaaagaaagaaaaagaaaagaggtttaattgactcacagttttacatggctgggaaggcctcaggaaacttacagttatggcagaaaccaactcttcacaaggaggcagaagagagaatgaataccagcagcggaaatgccagatgcttataaaaccatcagatcttatgagaacttactatcacaagagaaactgccccaatgattcaattacctccagctggtcccgcccttgacacgtggggattattaaaatccaaggtgagatttggtgcggacacagagccaaaccatatcacaaatgttggcaaatatgtggagaaactagaatcctcatatactgctaatgataatgcataatatatggccactttggaaagcagttttgcagtttcttaaaaactaaacagaatctcactcaacaatccaatttcacttctaggaatctaccccagaataaatgaaaacctaagtccataaaagctagtaagggaatgatagcattattcataatagctaaaaactagaaacaatacaaatgttcttcaactggtgcatggctttgttatatccacacaccaggggggtttaaaaaaaaaaaaaaaggaatgtccagaaaagagacaaatgtagagttagaaaaggtttatctgggccgggcatggtgactcattgctgtaatcccagcactttgggaggccgaggcaggcagatcacccgaggtcaggagttcgagaccagcttggccaacgtggtgaaaccccagttctactaaaaatacaaaaattagctgggcgtggtggcgcaggcttttaatcccagctactccagaggctgaggcaggagaattgcttgaacccaggaggtggaggttgcagtgagccaagatcgcgccactgcaatccagcctgggcgacaagagtgaaactctgtctaaaaaaaaagaaagaaagaaagaaagaaagactttatctggaactagggatgacagcagggattgactgcaatgggctgcaaaaatatgggttttggaaggatagtggaaatgttctaaaactggattgtggtgataattgtacaactatataaacttgctaaatagtgctgaattgtatatttaacaatatgtaaataataccttaaaaaagttgttaaaataaaatgcatatcagtaaaatgattccttaaatcataaacgtgtttgccaaaagagaactgattttaaaaaactgcaatgcctatcctatattagtaatatctaaatgatggtattttgattttgaaatttactgaattgctattttcaattcagtattcacccatagaaatggtttttcgatgtaaaggcatttcagacatactttagtcttctaagtgtaatctgaatgttttgtacgattaacccgcacgagggtagaaataaagtcatgttttcattaatataaaaatgtcagccaggcactgtggctcacgcctgtaatcctaacactttaagaggccgaggcgggtggatcacctgaggtcaggagttcgagaccagcctaaccaatatggtggaaccccatctctactaaaaatacaaaaattagccaggcgtggtggcgcacacctgtaaccccagcaactcgggaggctgaggcaggagaattgcttgaatccagcaggttgaggttgcagtgagccaagatcacaccacttcactccagcctgggcgaaagagcaaaactccatctcaaaaaaaagaaaaaaaaaagtcactgtttagaggttgaatcattggagaatcttggtgcccctgcccacaagtcttttacagttatttctaaatatcccagatgatattccacacaagctttagaaccattcttacccattcttgttttactctttaaatcaacaaaatgttattgaataattatgtgcatgactctggagacacaatgatgaacaaagtatccccacctccaggttagggtagccctagaagcggacactaaacaatatatgaacacttcctccaaaatgttcactgcctgaaggccttgaaaggagggccccagccatgacaatggttgccagtgcttacataaaaagatagtttccttgctgttccaccagacttcagagaaacactgctgctttctgaatagatgtggggagattttctccatcttctattacacttcttcatttgggctctgaaatagtattacttgtgtcccaaactcataagaccttcaatgaacagcagtcccttcatctatgatggttctccatgaaggaccagacccagtccctcaggccattgggtaaataaacatgctttcccttctagcttctccttctcattttcatcctgacacacttataccattgcctatgagggtatgcacacagatgcctaggctaggtgccagctacacacacagtttttctcagtgaagcccagcatgacacctgctgcataagatctaattaattagccgacataaaagaaaaacctatttttcttttgattcttaattttagcatgtgtggagttcagtgcttcttagaaaaactttctctcagaagactactcattttaatacacagcatatgtatgttccagttacgttatctacagcaaggtatattagcaaaaagtaatagctgctctggattctgaattttgatcacttgaatacttaaaatgagtcagaattcaattttggaaaattgctgatagcaaaatgttaatgaaaaatattacatcaatcacagacttccagaaatgttgtattaaagtttcccaaaggctttcatgtacagattatttaaataatacagtctttattaatgatctctttgtaattctgaatatagcactaatttattcagttgccttaccgattcaaacaagaccataaacagcatgaaaacataaaatgttgtgtcctgatctgacacaattgctttaataatgatgagaaacaggctttacgtaaatggaaagtgattattctctctaatacacaaagtcatacagaggcagaaatctaggtttgtattcttttcatagggctagagttataaattctacaagattaactacatatagactacagccccacatacacacacacacacacacacacacacacacattagatcacactatcattttaagtgctttgttaatgtataatttacatataatcacccattgtaattgtgcagttcaatgaatacaaatatatacagttgtacgtaccaccagaatcaagatatagaacaaaaaggtataatccaaaaaatttaatcatgctccgctgtagtcaacactttctactcaccttgacccctaggaatcatcaagctactttctttcacttagcataatgattctgagtttcctctatgttgctacatctatcaggagtcaattcttttttattgttatatattactccattttatggatgtaccacaatttgtttatcctttcaccagttgatggacatgagtaatttgtattttttggctatcacgaacaaagctactgtgaacagttgtgtggacatacatttgcattgcattcgagtaaaaacctagaaatggggttggtgggtcatatagtagttatgtattttaatttctaagaaactttacaaagaggctgtaatatttttaatttctaccaacaattctatttgttccatgtctttgccaacatgggatatttttaaaatcagtcattctactgagtgtacagtgctatttcatttgtaattttaatttgtatttccttaatgatgaatgatgttcagcaaattttcatttgttcattgaccattcatatgtgttctttggtgaagtgtctgttccaatcttttttttttttttgagatggagttttgctcttgttgcccaggctggagtgcaatggcacaaactcggctcaccgcaacctctgccccccaggttcaagtgattctcctgcctcagcctcctgagtagctgggattacaggcatgcagcaccatgcccggctaattttgtatctttagtagagacagggtttctccatgttggtcaggctggtcttgaactcccgacctcagctgatccgcccacctcagcctcccaaagtgctgagattataggcgtcagccattgcacccagcctgttccaatcttttatgcagtttttattgatatttttatcttttatagtgagttatatattccaaatacaagttctatattagatatattttttacaaatgttttctcccagtctgtggtttcccttttcattttcttgtgtctttatgagagcaaaattttaaattttgataaattcaaaattatcattatttttcccttatggttcatcctaagaaatctttgcctaacccaaggttgcaaaattttctggtttttttccctatgttttctttcagaatttttataattttagctataaattttttatttatttatttatttatttatttattatttttattttattttttttttttttgagacggagtcttgctctgtcacccaggctggagtgcagtggcacaatctcggctcactgcaagctccgcctcccgggttcacgccattctcctgcctcagcctcccaagtagctgggactacaggcgcctgccaccacgcccggctaattttttgtatttttagtagagatggggtttcactgtgttagccaggatggtcttgatctcctgacctcgtgatccgcctgcctcggccttataattttagctataaatttttaagttttcagcttaaatttttatagtttaggtttagctcaataatacatttcaagttaatttttacatacaacatgaggtaagggtcaatgttcagctttttcatatagatatccaatttttcttgtgaaatttaaaggactaatcctttcccactgacttaccttggcagccattttttgaaaatcagttgactgtagatgtgtagatttatttctgaactcttcattttgttccattgatccattggtccactgatgccaacaccatacaatcttcattactgtagaattagagtaaatcttgaaattaaatagtatgagatctccaaatttgctctttgttttcaaattgttttagcttgtctacttcctttacatttttatatgtactttagaataattttctgtttctacttaaaatatagtccactggagttttgataggaatcatactgaatctatagacaaatttggagagacttggtattttaaaagtatctagtcttctgatttatgagcatggtatagctccctttttttctaaaacttaacaaagttttgtagttttaagtgtgcagccattgcacatattttttgtaaactgtcaccctagatatttcaggttttcacattataattttaagcaaagtgttggaagtagcattcctagaagtagaacagattaaaggcaaaagaaaaacgttatctgaaataattctaattgagaagaaaaatggcaatataattattgaataacaaaagctatgtaaaggaattatcattgctattacattcacttttatatctgagcatacaaattagtgctttatttacagtgaataataatataaaacctacttggagaccagtaaaaaagaaaaggccctaaaccgaaaatcagcaggcctagacttgagtcatgacttgaatattgaagaagtgtatagtacaaggtaaataaaccttgacaaacattttctcccttctcattttgtgttcaactaatacttggcaaatgtttacaagagccaaacagtatgctaaatgctataaaatgggaagaatccttcacagcatatccttaagtgtcagaatgaaacctcaaatgagaaagagttatatgaaatattttggtaagataaaatgtgtattttaatgtgctattattatttattataattatggcataaaaagttcatttaggctgggcacagtggctcacgcctgtaatcccagcactttgggaggctgagacaggcggatcacctgaggtcaggagtttgagaccagcctgaccaacatggagaaactccgtctctactaaaaatacaaaaattagctgcgcatgatggcacatgcctgtaattctagctactcgggaagctgagggaggagaatcacttgaacccgagaggtggaggttgcggcgagccgagattgcgccattgcactccagcctgggcaacaagaccaagactccttctcaaaaaagagaaagaaaaaagaaaaaaattcatttgtaggtgctattactttaatacagagctcataccaaaagaagaaagtagctctgaaaaaaattaaatggattatagctagagaatcctaaaagtaatcactccatgatacactgaaaccttttctcttctattaccttctagttgtatgatacaagtagcatctaaatccatagacatggaagaaggctgacttgtttttaaaccctacaaagaaaaagaatgacttgtttttaaacccaaaaaaaaatttgaatatttatgcattttttccttccagatgaaggaagtagccttattaatttctattaataggagatgtgctgacaatttttctgttaggaacctggcaaactcacaaatatgacagatgaactcagaatttagaagtatgccaaaagactttatgcaaaggaatatagtaaaaaagaattcagtttctctggttatagattgttatccaaataaaatatttatgtattggtcactatatcatatgtattggtcaccatatcatataaattggttgaaaaatgattttctggtttttctgtgtgtattctttttttttttaggtttgattctcataaaggtttctggtgtcagttactggaagaaggtaaaacaaaatgccttggaaagagcaaaggaagaaaataccctccaatggattctgatgtaagcatagaccttaaaaatacaaactaaatcagcaaaatggtaaccaataatatcatctactttcttaaaaaactagttaaagtcaaaattcagcctttctaaaaattaaaagtgccatttcaatttcagtacaggtaggttgcttattttgatttacccacaatatattattacctgtcatgcaagaataaaggaaaacaatagaattcaacattctgaataagaacaaagagataatatcttattccaaaaagaatgatacctgcacaaaaattttagtataaatgttaactgaaaccaagacaggaagtatatccattggaaagtgaaaataggaccaagatttctatttttggccgagtgtggcggctcatgcctgtaatctcagcactttggaaggccgacgtgggtggatcacttgaggtcaggagttcgagaccagcctggccaacatgataaaaccccatctctactaaaaatacaaaaaaagattagctgggcatggtggcaggcacctgtaatcccaactactcaggaggctgaggcaggaggatcgcttgaacctgggaggtggaggtcacagtgagcccagattgcaccattgcgctccagcctgggcagcaagagtgaaactccaactcaaaaaaaaaaaaaaaaaaatcctatttttttgactgcctgagtcattctgttgtagtaagtgtgccctgggcagtaatgtaagttactgatataatatactaagttttgagctgttaatatgctaataaaatgaaagaagcaatgtatttcccaacatctaacatactagcagataatttaggctttggggaatgtagacacacactttgcagtatgtattcagcacttcctgtttattctgttcagaatggagacatggtgatcacttaatgctacagttttctccatttctataccccacatttttactttaatgcttacttgacatatattaagatttactaataatatttttatttattattagtctagttagtagtttcaatataaccatgcaagtagattttgatttgtaaattttttttagatctcagaaattaaaatatgatttgggatttttcccccacaattaatacattacattaactgagaaccctaagatggtctgaggatcctaaggtgggctaaacttattagaatactttaacaaaaccttgaggactactttttgtgccttgcctgatagatgcagggtctgtcctcaataaactcataattaaatcatatacggaagagagagagagtttctgttattttgataaacaaactgcattttcagaactccaattttctgtggctgattaaaatataccttcagagcactttgaaaacaacccttcttttcccaaaagaaattgacatacaatttctatagtatttcaagaaagtaatataaaatatatcatatgcatttatgtcaaagctatttccccgtaaatttattaaagctaaaatgtttaagagacactgcagaatatctttcttagcattttgttttactctggtctaacacagaccttattaaatttggaggtagagaaagataagaaaaacacaacttttcaggatatccttccttctcaacaaggttactgagtaatccatattgggtttatttaagggagtggctgattttgtgaaaataatgtccacaaagcaggtaagagtaaagaggtcttcacagaggtaatgaaaatacaaatgtgtaggagggattagagtgggcagtactgtcaccacaccttttgcctcttcctagtaagaaaaatgccagtacccaagactgtcagtaaaatatcatagcatgtgctaaataaatagtccatatgcttaatacaaattttaatccagatctggtatacttggtacttatttcaacgtagtcaaagtgtatgaaatgtaataaacaaaataaaatgtacttttctctcctcctctccacttagagcaggacatttctgtcaagctactatcgagatcacaacgtggaactctcaaagctgctgcacaaactgggtcagcctctgccatcctggctgagacaggagctgcagaaagtaagatagcactgagagaaaacttgagacttcatcgtccatgtagaacacaccttttccaaagcttccagaagctaccaaaaggcagttgaaaaatatacctcttcaaatgagaaaaaagaacagtttcttccatgtgctggcacgtggatgattagaaaaaaagaaaaagtatgtgttacaagccttgaggcctgtggcctttctcttaacccatatctgagcctgtgggattattgtagactactgtgcactcatgtggaagtcaattgcaaccaacataaatatcaaacacaaatgcagaactgttccatttcatagtaatatttacacttttatatatcaactaagattgtgtctctgtaggtttttagaccactgtttgcctgtacgatgttttcttattattttattctataaagtgtcctatgaaacaagaagcaaaataaacatcacaatgtagcataaaatgtcaaaagcataacacccatgaaaaatgcttgccaaaatttaaatccacttaagtatttagaaataattgtaaattataatttgtgctagatcagagtggaaaagttatatatgagtgttatctgcaccaaaaaaaaataagtgctatagcaaaagtgattttttcatatacatagtctagtgaatatatgtaaaaattactaactcttccatcacaacgtaattgttatactgaaatatatactgtaaagctgttggatggtaaatagaaacacatcaagtacaccaaaacagtaaataacaatgtaaagtgtactgactgaatcctctaaaagggagaaattgtaggggtctaaaaacatatcatcgagaattctatgtccacttgctgtaagctgtgaatctatcccagtagtcctcactagttctacagaaatgcatgcctagagtctgaggtatgtgtcatctccagaaacaggttgacttttaaatgtgaatagctatttttaatgctccccaaaacaaaacctattaaactaaaactaaaaacagtttccctagatgatgtggttaggctatttacatttaggttattaaaaaattgcattttcccagatagttcaaaataaaattatgtaatgtagtagagatttataacaaaaaacaaattaatatattatttgtaatctaatgtttgcaatgatacttttgatataaggcaaagaaacataagcagagcagaggcccatttttgaaaatatttcacccatcactctggtggaagtaacagatcataggtacaattaaggattagctactaaattaaatgcaggaagtacaaagatgagcaagtcatgctcttgaaatatatttacatttcaattgtaaataatatatatggttaataaagtttccaaaaaagaaaagaatacatcatacttattttcctgttaatatttacttaatttttttttttgagagggggacagagtctcactatgtcacccaggctggagtgcaatggtgtgatctcagctcactgcaacctccgcctcctgggttcaagtgattctcctgcctcagcctcctgaggagctgggattacagccatgcaccaccacgcccgggtaatttttgtatttttagtagtgacagggtttcaccatgttgactaggctgatcttgaactcctgacctcatgatccacccaccttggcctctcaaagtgctgagattacaagcgtgagccaccatgccctgactacttaatttttaaatgtactgtacatatacataaaatttaagtagtaaattaattccctgctatgattataagcctttataaaatattatcaaaggtatgattagaaacaaatgggaggaaaacccatagtaaaaatattttcattgtcattttaatgggtaaaactatcaattactaattagaaaatgaattgtgagatccacttactataaatttttaactgtacattataattacttttttaaagtttcatgtacctaaagcatatgctaatttttaaatatactattagcagaaaaaattggaaaaatcaccaatttttaagactcttgactctaaaagcaaaatcaaagtgatttggacaaatatgggaaacacagtcttcatgcttactgctgtctcttttatagcagcagatgccagacatgctaggaaaattactatagtcttccatctccaccaacttaagaaaactggcttaggaaggttaaacatgagaataggcctcagcagttatatacagtgtcatgttttcatttggcaacaacatttattctaataaaaaaagaaaagaaaaactgatacatttatgctttaatggtaagatgtacatttgaactgctaagcaaagctgctaatggcctattttgtttaggtaaatcgagttgactgaacacttcatccttttaaatagatgtcaaaaacatactccgtgtttgtataaagacaggagaaaaaggaagagatcttaccaaaatttattcattcacaagtacatgtattacgctagctagagcagcaaacctgtgaaaggatttttgaccactcaatgtgtcttgaagacagcatcaaattctagaggacatgcatactttccacattatatactccaactggttaatatgctaatctgaaagtaacataaatacatatgagagaataatgagagataatctgatttaaaactagctttgtatagaattccctttttcattgtttaaaatatgaaacttcctcaggaagaaatgaaatggttatttcaatgtttatagctgtaatattcttgtcattcacattgaatgaaaattactggaaacatttttttctctgagttttttaaaataaaaaacctagatataattctgatagtagcatggtacctcatatgtacaacaataaactgataggaaaatgaa

SEQ ID NO: 2596 - DNA, 20352 bp, Homo sapiens
ggggcgggctcctagacggccgcgcgcccgggaacccggcgcccacagagccgcggcaccatggcacctgctggacgcccgggggccaagaaggtgagtttcgtcccctcgatcctcgcggagctcctggccgctgggctgcgagcgactccgttcacacccggcgtccatccctagccaagccctggggcctcggcaaaacacttggacgggatggccctgagcctcaattttcccctgtcacgggttggttagcgtttatggagcccttactcggtgcctggcgctgcacagagtgctgtgctcaagttatctcctcatcttcacaattatccccatttcacaggtgaggaaactgaggctcggcgagtcaggcgactagctcagggtcacgggtccagccccgcggggagcgaggatcagaagtctagctttcggacgcatgtcgcgcacacattttcttccctcaaccgaccctcgcccgcagctctttgggctaatccgtccgggaactcttcggactgtcccctcgcgttttggaaaagtcagcagcctggccaagcagcctggccttgcgagtcgccggctggtctgaaactagtcctgggcaaggacgcccccagagctgcggtgcagggtggagggtaggtgggattcgctagcacccctcaacctcctctcacccggtggtccccagctcctggcccctttcctggtctggtcaccagatgttggctttatgcccagccatttctacgtcgagtatgtgtgggggtgggatgaaggagtgactaagcaaaattaggaagggcatgagcttggacgaaagacatccccaggacccttcagagacccccacccgctccagccctgtcattcagaatgggaggaagggaggaggggcagtttatgcgtggaaatgtgcaccaccgagctatttatactaaaaagttagaaacgaccaagatactctgcaatacgggattctaaataaattaaggttcatctacttaagttattagacagttaaataacttagtatgagaaccagctaagtgccttggcaatgttaagttgcaaaaggaaatatatcacaaactgatcccaaccatatacaaatatttatatacacactgtaaggaaggacacaataatggtaatagttacacaagatgtggaatattggtttaaaaagcatgttttaggatattttttcaggttataaaagcaaaatgtgagcattgaaagaatacagttaataaaaataatcaaagaacattgtgcttttttctctcaactttctctaatgctatgttcatctttacagttcatatttttaaacgtttttaaaatgccctgtttttgttcagtgtctttggggcctctactgttacaacaccaagattatcacacactaatccatgtgaatgtgtacctgggagttaaggtgttaatgggaaggaactaatctcacctctctcctcagctagcaggtacattttaagaattcatttaattgccacagacaagacctccaattaggtcttaaatccaaaagagcagttctgctggcaaatctaggaaaaggggaagttattttagacagactgggtttttctgatcacctcctactacacagtgaagttgatccccactgagtatgaatagagatgtcttgaagccagatcttaaacccagaggtcttacgtagtgatatctgcaaaaagggggcataaatgcaccctagagctcgctgtcagatgcaaggcaggttcactgccaaactgatggggaggagggaatgaaaatataaatgtactgcaaaattaatttacagggttccttattttacatgttcctgtctttataattttacagttgactttagatcgtactagtataatggtgaggaacaacacacactggggcctatcgaagggtggagggtggaaggagggagaggatcaggaaaaataactaatggatactaggcttaatacctgggtgaggaaataacccatatagcaaacctccaatgatgcacatttacctgtgtaacaaacctgcacatcctgcacatgtacccctgaacttaaaagtaaaaaaaaaaaaaaaaaaaaaaactaaagaagggatcatactggtatagtaattaattgaggtagttagaatagcagtgaaggaagggctaaaagatgctctgatctcaaatcttgataacttagttattttgctaatggctatgtagaaaaatggcaaattggccgggcacagtggctcacacctgtaatcctagcactttgggaggccgaggcaggcagatcatctaaggtcaggagttcgagaccacactggacaacatggtgaaaccctgtctctactaaaaaatacaaaattagctgggcatggtggcatgcacctataatcccagctacttgcgaggctgaggcaggagaattgcttgaaccctggaggtggaggttgcagtgagctgagatcgcgctactgcactccagcctgggcgacaagagtgaaactctgtctcaaaaaaaaaaagaaagaaaagaaaagaaaaatggcaaatttaaaatggtggacaaacatccagataacaaatgaaaatgtcctccctttacttggtttcataaagacacagtcaaaatatatactacaattttcttaaaacctacctaattgtctgctaaagagtaacattttttcttcttcaggacaaaaattctagcatatgcaatacatctgacattttcaaaacagtcctgtttatttgctaattcttggcatagtttcttaagtgtctactcattttagttgttatatgtggtggtagggatatagaccaataagatatgtcacctgcccccaagcctcttacagtcaaactgaggtgacaagtaagtaaccagatactgctgtacagggggatgcatgaatgaaggatctgtgaagttaagcaggacacaaaaggggtataatcacaggtgagactgggtcagtgagcctgtgctctggtagcaatggaagacagttcagagtagggctggagagaactggagaccatttcaataatcaaatgcagtgaggatggtggggcatttgagaaatgtgtaatacacttggcataaccctgtgataggttggatgtgggaggtgagaagctaacctacaacatctgaattctgtgccaatgttttccctcgacaattgtttgagtaaatttgattcttttttttttttttttgagacagagtctcactctgttgcccaggctggaatgcagtggcacaatctcaactcactgtaacttccaactcccaggttcaagctattctcctgcctccacctcacaagtagctgggattacaggcacctgccaccatgcccagttaatttttgtatttttagtagagatggagtttcaccatgttggccaagctagtctcaaactcctgacctcaagtgatctgcctgcctcagcctcccaaagtgctgggattacaggcgtgagccaccgcgcctggcctaaatttgattcttaacatggtgaacctaatgaagtgtatgggattttcaggaaaacagtttgtacacagtaactgtacctctgactttctcttctgtattcctgtgtagcatttattggtcacattctgctgtgattatttgttgatttattggccttccccaaagtagccagactttgagcttgtggagggcagagaccttgtcttattctgatgtttatcccacttgcccacaactatacctgacatgtggaaggtctcaataaacgtccaaaatttaaggccttttttatatttcaaaagtacaaattgaaaagagtgaattgcatttgatgcagggaggagaaagaaagagatgagaatcagtaaatattaacatttcttctgcattcagctaaaattcagctttagatataaaatatggaaaaataaccagagttgagagctctctctgccaaaatagtgtttatgtttaacatagttcacacagctgggctccatttgcctgccctccaagtgcacagtaaaaagatgctgtaggtagagtgacctggtatttacctctagttaaaccccttctgatggaccttcttgcactgcagaggaaagaaaactaaccactttgccagactcctttgcagctaggatctggataagaactagcatccccaatcagatgcaccagtatgagtctgggaaggtggaagcatagcaaatgtggccatagtgcagcattccagggtcacgtgaggggcagctgaggtcgctggagcagcctccttctccctatatgacagctgtgtcctgaagccaacagttcaatagtggcttctcttagttgtggcagagggtgcagccccagccggccaattcagtcatgtttttctaggggtcatttctggaagcccagtgtaaattttttatgtacccatttctcaatattaaactcctttctgcttagtcagagtggtttgtacttctgcagctaaactgaacatggggagaaagctagaataagccccctctctagtcatgccattcgatggagattaagagattattcaagccatatttgacctctcatgtttggttccatactgttaacaggactgtcctgggaggctctgtgggaagatcctcacgtctgctttaatttctggttgcttttattagatccaggattgacccagctaaggacaaagactcctgtaaccaagatcaaattagcttccctcttattctttattgcctttatggccttccagcctcctgggaaaagattgaagaaaatagtatatcaagcaatatggccaaaatgtgtttgggatctctttgttccttggtatccaaggaagctcgctcctgacacctgggtgggtcactttgtgtggggagtaagcaaaggagaaatagcagatgccagacactagaacagaagcagtttctctccaaaatctgttccccctccttccgaaggattagcgttggagctggacacatggacattcactgatgatacttcctggcttcccttgcagcaaggtagagccatgtggctaaactctcacgcaggaaatgtaaatgtcaatgagatgagtcacttctaggtctgagctaaaaactttaggatgagctttgccacactgtttcctcatcgtttgagacagagtatgaacgtgactctgatccagtttcccccatgctgaggaggacagtaccctagggctgggttggcaaacgctttctgtaaagggtcagatagtaattatttttagccttgggggccatacagtctcagtggtaactactcaactctgctactgtagtggaaaagtggccattagacaatatgtaaatcaatgggcagggttttacctaagactgtttttacaaaaacaggtgatgtgccagatttggtctgtgggctgtcatgtgctgacccctgccgtagggaatggcaaagcaataagataaaaggactgtgcaatttggtgcacactctgtaaaaaagagtcccccacaaacagtggctttcctcttacagaggaaaaagaaactacttttatttaaagccactgttgtgggggcctcttttttacacagcttagttttaccctacacccaacacgtaggccagtaagctgcctatgtaccctgcttgatgtctcccttggattcaggaactgagggggtttatgttgatttcatagaacagataagactagttaaaagaggcatctgaggcttttctccctgatccattcattgctttgtgtccagctatgggcaggcctgaaatgaactggcctattatcaataaaaggttgcatcttccactgatgcagcctacaaaagagggatcaggattgctgtggggagttgggaggagtgggtggtttgcattgctcagggaaggcatctctgaaaaggtgacacttgaccaaagaccagaaagcagtgaggggatgaccctgcaggcacctggggagatgtgctttagaccaagtgaaatgggaaaagttcccttatgccccttgcagggtgtgtgatggaggcgtggatcacttcttcagcaccccacagcttaaacccctagggggagcatgcaggtaccccatggcagcatctaggggtgaatgtttacagctcctgaagccccagtgggtgtgtgttacagtgtgctctttcagcttagctgtccactggcagcttgtgttaatcagctcaattagaccctccgccttatcgaaaggacagagggctttctgtatcctggggttcttgccagtgtactggaaaaattggatcacacatgggcttggagaatgagtgcaaggttttatcgaatggtggaagtagctctcagcagatggatggggagccagaagggggatggagtgggaaggcggtcttcccctggagtcaggccgctcagcagccagactctcctctgattacccctggctgaattccacttcgtctgtgtcattctgccaccgatggcctgccagagtctgtgtgttcttctgccagtgtgttcctctcaacgtccagctgcttgtgtttgtgtttgctagggtcttgaggtttttataggcacaggatggaggtgtggcgggccagggtggtcttggaaaatgcaacatttgggcgcaaaaacaggagtgcctatcctcaccagggtctgtgggcacaggcctgaggcctttctgtatcaaaaggaaactgcaccccatggctaactgctctgaatggaaccttttaaataagttatgagtgggctaaataggaaggtggtaaaatagaaggaaaagagagtaggaatttagaagctagtctgattttttacttacttagctctgtgatcttgggcaagtcaaccattctgagcctcagtttcctcatctacacctgagaataaaaactgtgtcctgcctcactggcagagttgctgggagtgccaaatgataagacacgtgtgaacacactgcatgactacaaagcgttgtgtccactaccgttctgttcagtggctgacacgaagaaaaattatttttctcacctaacaagaggtccaggggtaacagcccatggctgccgcagccacccaaggatgtcttaagaaatctgcctcatatggctgtcagatgactgctgtattcccaggcattatgttggcattccagccaggaaggaggaaaatagacaaaagggaagggagtgggcgtctatgtcaggaaagcaaaacttttccagaaatcctccaccagcttccgtatgtgtctcactggccagcactgtgtcacagggctgctcccagaggcaaaggaacctgggaattttttgaaagttaggggcattgtccccccacacaaaaacaggggagagaatgcacactaggtagacaactagctgtgttgtcacaaacatgttgaaaagccaaaataactatcgtggaatcagtgctataatttgactcagattaaatgttatttaagaataaatagtctcagccctttcattgtacaaaataggaacctggatcggccaagaaatatggtatgctcaatctttctgaaatattattagagcacatgattttaacaaaactacagctctaagaacgtaataccacttcacctaaaattagaaaatgcttttaggaaaaaaaaaaaaagtagagcggagcttaggtgctttttttctcttcttcaggggattttggagcgcctggagagtggggaggttgtgattggagatggcagctttctcattactctggagaagagaggctatgtgaaggctgggctctggactccagaggcagtgatagaacacccagacgcaggttggtgtccacatccccaagagtgtctacctgagtggtattttatttaaatctgattgagagaagatcaagaaaaaaataacaactgtttcaaaggggtgttttgcttgctaagattgccaagatgtggagataatggcagtatacaggcggaagtatatggaagaaaatgacctctctctctctcatacacacacctacccacatcacacacccacccatccacacgcccacacacactcccacacacacacatccatgcactcacaccccaaccccacatccacacacaccccacatccacacccacatacaccacaaacacacatacacacccacacaacacactctcacacacacacacactctcatacacacacacatctgcatcttaatgtacaggcagtgctaaaatagacatcttaatatttgttccatgaatatttaccttgtagatatacagagtttccttaaaacagcaaaactgttcctgcttctgattcaccctgctgacaatgtgcatggttaagtgtaacagcgtttatagtgagggtgattaatggtagtcacagtgtaacagagcacagacagccaggttccagggttgggagggcaaggaagtcaacacagttttatatcatcctcctggctgggaaaaaaaaaaaaaaaaaagagctagaggtaaagaactatgatgggattagatagttacctgaaatgaaaactttaattctcttctaactctttttttgtgtgtttgttctcctaaattaaagtgagaaaataaagccaaagaatgaaatgggtgtaagagaacactagctgagactggaacttttgattcactctgattttatgtatattcacacagcgtatcagataaacctagggtcctgtcttgattcttccactgaccagctgtgtgaccttggacaagtcacttgacctctccaaggatccatatcttaatctgtttcatgggggcacaacatgggctaggtgtgaggactcacaagttaacccgtgtgaagtgcccgtatcatcagtacgatggccgttatgattggtgcatcggacacccagagttctgtggtagagcaggaccaagttttgttcctttggtgcttaacaggatgttttcatctggcccaagaagaacttgttcttaatgttaaaagacctttttgctaaactgggaagaaagtgctggaataacaagagtaaggataagggaggaggggcgaaagtggtgaaggagaggaaggaatgactttcagatagccaggaaaagcttccagactgctttctgatgttcccaaactgcttgctctgactctgatatgggtgccacccacatgcattctgctttctatgagaagctcctcactttactttaagggctgccaatgctgactatagtagaccagctctgtcctttacaacacaggtatagaataaacctctctagaccaagagaccaagggttaattggccagtcaggccttaatctctgcatgtgactgcaccaagtcattgaggcccatcaccagaacaatacaaggctgctctaaacagtacatcctgcctatgaattctactgaccttaatctataattttttgttactactaggtttgaactgaggtatgattgaaagagatgggagtcagtgagctactgctgcttttgaaaatgatagcttctgtaatatttctttattcatttatttcaatgtttaaaacccaactactttgtagttcgtcaacttcacatggaattcttgagagcaggatcaaatgtcatgcagacttttaccttttctgccagtgaggacaatatggaaagcaaggtaaacggcaatggctgggtgtgggggagggagtcatctattaaaaaataacctcttcatgggaagctatggaattgattatgtgttactatactttattacaaagtccatataaatatgtattaattttcacgtgaagatatatactaaataggtcgggcacagtggcttacacctgtaatcccagcactctgagaggccgaggtggacagaccacttgagcccaggagttccagatcagcctggacaacatggtgaaaccctgtctctactgaaaatgcaaaaattagctgggtgtggtggcaggcgccagtaatcccagctacgcaggaggttgaggcatgagaatggcttcaacctgggagatagcattgagccgagatcacaccactgcactccagcctgggtgacagagcaagaccccatgtcagcaaaaaaaaagaagttaatatatactaaatgaattagctttctcttcccatttaggtagaggaggggtcaggactaggggtaaaataaaccattggaagggcatggctgtcttcttgtgctattttttagagagaaagcacttcatagatgctcttttcaccttctcatttcacacttttctcttctggagacagggaggccctaaaaaacaatactggagtagaaatgagaaaaaacgggtttgatatccagcattgccacctattggctgtgtggctttgtgtaagacacctacctgcattgagcattggttttctctctgtaaaatggagacaacagtagtgcttaaattcatagacctgttgagaagagtaagtaagaccaaggatgtgaaagtattgtgaaatattctgcaaatgtaaaatgttaatacgtgtaaatgttaatgcccattaattcattcaaccaaccaacatgtactgagtatctgttacagtccattctctatgttagactcaaagttgatacaaaggcatagaccctatctggaggtgcaaggtcaagtatgggaggcaaacaaatagttattaaaatccaatgtggtaagtacaataatggaaatataaggtcatggtaacagaggagattgtacccaactctgctggtcttttctgcttgcattgaagagagtggcttatactcatcttacttgtttattgtccctttagttatcttttatattttaccttcaaactgctaggctcactatctgaactcttgctctctaacctcagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagaggtgaggctagtattggaggaaaaggattgaacctattttgcaagcataactgcagagtcttcacatttcatgagggtattggacaacattctgccctcatttcttccatgtggatggtcaaaggtttatttaaatgcatggtagtcaaggccaacattccctcattggtatgctaggttctcttagagccaaaggacagacccaagagaggcctgaccatagccttttatcttctaaggtctgggtggctgcagaagctgacttgggggactctacaacctataaggaagcatagggcacagtgcctccgggagcaccctctccagagggagaatccacacaggagggcactgcatgtgtgggctggggactgagagagcaaggcctggaaggtggtggctatccaggctcgtctaggccccaccaataatgctcagcacccagtagtttccatagccttctccatccatgtcttgctcttcttgcctctctgctttcactcaagctatgacatgtgaattacattttgaagaaagaatcagtaagaattggtcattgattggacatgaaggcccagaacattctctttcctccacttccaaaacgaaagtcctcattccccatttcccaacataactgctactgcctggggtcatgccttcaacccacaactttactccaaacaagagaatatcccctggcttggcgcggtagctcacacctgtaatcccagcactttgggaggccaaggcaggtggatggcatgaggtcaggaatttgagactaccctggtgaacaaggtgaaagcccatctctactaaaaatacaaaaattagctgggcatgttggtgggagcctgtagtcccaactactctggaggctgaggcaggagaatggcttgaacctgggaggcggaggttgcagtgagccaagatagggcaccactgcactccagcctgggcgacagagtgatactctgtctcaaaagagagagagagagaatagccgccaccattattccccctagtgaccccactgaactctactgaaaaccttgcctcatcctcctgcccacgcctggccaaccccactgggaacagtcatctgcagggacaagcacaaattccaccctctgtgctttccagatggatgatgacaccactctgtttgtttaagaacccgtcttttgattctctcataattcctcacactgcttctgcagaatttgtttctaactcaagagggaagaaacaggaagatttctggcttttctttagttgccttaaggtcagcttttcagctgtggcactgaaggggcttcctgggaagcacccaagaaaatgacatgggtttaccagacaagatgtcctgtccaccactggcaaagacagggagtagctatttctcctatgctgtgcctcaatcttctcacccggggaaatggtgcttcccttcctactttatggagcacttatgaatatctaactagaagtgaatataaaagctctttgaactataacacatgataagctactcattgtttcagagattaccccagttttataagagatgaatctaaaatttattagcaaaacttttcctccttcaaaattacaaaattatgattttaaatactcaattactttgaaaacctctgggtgtgttttcttcttttttactaataggcatcatctcactgaatcaatgaaccctgaatgaaaaactatatgttattgttataggaatgaaaatgtttactcagaaaggtattctttagtcagtctgatagacacacattccttagcaagttttattatgcatatgtttatattctatttggtaatttttataactgttttgctatatttacctttaccattcaaaatctgctttatgtttggaccagtagaaaaagtgacatttctcttagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggtaatttggacccataccgtgatacacagctcagttgttgcttacgaaatttaacaaagtgtgcttgatattgtgagagcagtttggaaatagaagaatgaactccaatcagttttcttatctgtaaattgtgggaggtggaggggaatggctaacctctaaggtaccttccaactattaaaaaaaaagaataaacaaataaataataaaatgtaagtgttatttctttgcacaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggtaagctcaggtgcatagtagaggtccttgtatttctcgtgacaaaatccaaatggctataataaattgtggcccagttttacaataagagactgcatatgacaaaacattcagagttaaccaaaaatgagctatcagaagaatgcatcatctaaagtttatagtttttttaattggaaaaactgctcattagagcatccatcatttgaaaatgagaacagtaacagaaatgctgttaactattgtgattcaggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaaggtaagcatttttaaattaacattcttattattttcctttaatctcattttatttattgttgtaaatgtcatgcatgcacatgacaaaaagtatagaaatgtataaagtgaaaagtaaaaattatccccttcctgataccagctccattcccaaaattgtctttagtccatttgggctgttagaacaataccataaactgggtggcttatacacaacagaaatttctttctcagttctggagactgcaaagtccaagatcaaggtgtcagcagattcaatttctggtgaaggccttagagatgataaaggccatctataaggaagcaggcattccttatagatgataccttcttgctgtgtcctcacatggtagatggggcaccacagctccctggggcctcttgtcttttttgtttgtttgtttgtttgtttgtttctgagatggagtctggctctgttgtccaggctgcagtgcaatgacacaatctcggttcactgcaacctctgccccccaggttcaagtaattctgcctctgcctcccgagtagctgggattacaggcgcccaccaccacatccggctaatttttgtatttttagtagagacggggtttcactatgttacccaggctggtctcgaactcctgacctcgtaatccgcctgccttggcctcccaaagttagagtggggcctcttttctaagggcactagtcccattcatcagggatgcatcctcatgacccaatcacctcccagtggctccaccccctaatatcatcacactggtgactaggtttcaacatgtgcattgtggggacacagacaatcagaccatggcacagaggaaacctgtttgtcatttgtgttttgaaatcttgtacctctatttcttttgtcatcagttttaagtggtaactattgataaccctttatgaaagctgagggatttaaatcacataggcttccccttttccccgttctcctttttccagttttgattcgttacacttttatttcttctgttggatatctttttaagttaaaattatatatttaaccacctgtttcttagttcatcaatataaggcaggaatctcttgactccactctctgtaaaataagaatagattcccctctgcttctttccaccttccctctctcatctaccccttggtgtctttaagttttaccatactttactatcatcaaggtttataaccattttgttctattctatagttataattgtctttcaagctttctctgtaggttgatcctaaaaatataaaatcagtgaataacatttacaatattattataattgttatattaaacaagcaggactcatgagacataattagaattcacttttatttttgtctccctctatccctttaaacctactcaatgaattccttcgtttgttcctacttgaaaatactgaccagctctagaacttctctgggtgctcttaggcaatggaaagttccataatcactttatttcacagatagtctcagttcagtaattaaaagtgtttaggactgggcacagtggctcacgcctgtaatcccagcactttgggaggccgaggctggtggatcacctgaggtcagcagttcaagaccagcctggccaacatggcaaaacttcatctctactaaaaatacaaaagttagcctggcgtggtggcgggagcctataatcccaactactcgggaggctgaggcaggagaatcgcttgaattcagtggggtggaggttgcagtgagccaagattgtgccacttaactctagcctgggcaatagagcgaaactccatttcaaaatgaacaaacaaaaaaaccccaaaaataaaaaataaataaaagtgttcaggttcatgtcaaatcaaaactcagagcatgtttgaaacttgaagcttctccctttgtccagcaacagccttccacagacaggaaaccaggagaggccagcgcgctgcttctctttctctgttatgctcccaaacttcccttcccatcttgctaccatggtttctggcctcctcagattcaaagtaagaagaaagaggatggataaaggagtaagactgttgttgcttgcctggcaccctgataggaagccggcatcctctgaccctggcagatctttgtgagcacgctcatgggtcttcagaggctcccactggaaacttttgtctgtacttctcatgccacaggcatttttctgactgtgacttctgcctcagacagtggctttttcaaccaggtcactccagatatactctgatttgggggtcctgttgtcctccccggtaattctcttgggccagattttagatagttcaggctggctctctcactctcattaggctcaaaacagctttcaccctttctgcagacaagccatgagagtgtggtctgaccccaatttaacagcaccccttttgcccacaagcaaagtagctggcccattgttctcttgtggtccagattttccaggggacagtcaaatgagtcatctggctggttcgtggccacctccttttaacttctgtgcagtgtctgtcttgcaactccccttgatacctaaaatccatcatgccttggtgtttccagtcaaacttccaatctaatactctgttgcaggaataatagaaaattgttgcatttagaaaaacgttcactgcagaacaaagtagtatgcatgggaccatggataaagagaaataatcctatttacaaaacttgagctacttgttggagaatgttccaagcatcaaggtcaaatgaattttcttctcttgcattcccgtggatatattgtccaaatccatgccatatttcaatttgcttcatacttggtctgactttctttgtatagcctttggttttctagggatttctgattaacttccttttccattgttgaaagaaaaataacagggcttcactttccctgaggtcttataatttctaaattatattgtttgttacagtaagtcactttattattgaaggcatttttcttggggcctcaagaaaattactgttctgttatggatcattgtatttcacacacacacactcatactctgtctctctctatctttccatatagataatcttttgtgtatgtatgtgtgtgtgtgtgtgtatatatatatatatatatatatatatacatatgtatgtatatctgttgatataattccatcccccttccatcttctagaactagtcacaatctctgctgtcttctctctgttcagtactctcatgtacttcacccattttgtgcttatttattcatttcagtgggatttgaaagtcttcatttttgaactggaaaaatttgcctaatgcaaatttacttaggttgtaaaagtaggcaagaatcacttagccaaagctttcttctaggagatatggatatttaccagagaagatgttttgtatatgtgtcatactttttaaaaagtattaaatataaatataattaaaaggtgaggaaaacatactttggtgatgattaaaatagtttaaataagtgagtagtttatttaattatcatctgctaggaatccttaaaattcattagctattagaattaaaacattattctgtagaccaaagcaagaagacaccctttttaccctgactcccaaacctactgatattcacagaaatttatgattacacaataaacactagatttctgacatctcatcatccaaaaatattgatttattcattgttttgtaagtaaagtggaaaaaacaataaaaatatattcatcagaaagggctacgaccagggacctttgtactcttcttcctttgtctaacaacaagaaacaaatattggtaaagtaatttgtattattttcttagttactttttggagaattatactttgactcattacattaaaaactgttctcgtattcttctcattacattaaaatattgatagagttagaaggactctgttagaaatttcagaataaatataattcataaaagtatgtgaaatgtaaggctgggcatggtggcttacacctgtaatcccagtactttgggaggccaaggcagacggatcactggagctcaggagtttgagactagcctgggcaacatggggagaccctgtctctactaaaaatacaaaaattagcctggtgtggtggtgcacgccagtagtcccagctacctggggggctgaggcaggaggattgcttgaatccaggaggtctaggctgcagtgagccaagattgtgccactgcactccagcctgggcaacagagcaagaccctgtctcaaaataaaaagtatatgaaattgaaatacgttgtctttttctgaaaggtggtatgaaacctaatgattgttattgaaatgtaagaaaggcccctggcattaatggatatggacacagttttccgtctgtatgttaaaacaaaagttctgctttagcctgattatccaccaagttttgactgtgtgtgtgtgtgtgtgtgtgtgtgtgtgtgtgtgtgtggttatatacatatacatacatatatacatatatgacatattggacttataggtaagacttttaattaattaattatgtatatattgaaacacagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaagatattaggtcctagaatttttaaaatgtgtcttcataatcataggtagctaggttataaactatttaaagacaagatcacgtgataagcttataatcttctcataattccccttacttagcattgtgttagacatactaataggtgcacagtgaaatacttattgttgattgtttaaaaataaagttttagaaaaccttttcaaaagtcagagtttaggccaggggcacaggctgacacctataatcccagcactttgggaggccagggcgggcagatcacttgggtcaagagttcaaggccagcctggccaacatggcaaaaccccatctctactaaataaaatacaaaaattatccaggcatggtggtgcatgcctgtaatcccagctacttggaggctgaggcatgagaattgcttgaacctgggaggcagaggttgcagtgagctgagatcgccccactgcaatccagcctgggagacataattcaaatctattttggtcttatatcttcttatgtttgtgttatttcatgtgtgccagtttctctttttttcacaacaatttatcaatttgtggcaataaaaatgatttaccttttatagtg

SEQ ID NO: 2597 - DNA, 20352 bp, Homo sapiens; identical to SEQ ID NO: 2596

SEQ ID NO: 2598 - DNA, 272818 bp, Homo sapiens
gtacactgtggaattagaaatatttattcagaatataagaatgtttgtaaaatattataaatgtctctgtataaataaatggagtttttaaaaaacaattctatatcaaataacgcaaagtagctattttacagcagctaaaactaaaggcatctggaaacatttaaagaatacaagtggagaatctaaaaaattacaaggtatagtacagtgttaagtagcaattttaaaatgagactttcagtacaaacagtagaacaatactgacaaatgcaaacttagtcacatgtgctttaataactgacaatacattcaagcaggtttttctaattcaagtgtatagcacatattcaaataataggaaacaaatctcatgcaaagtaaataaatcttgatgtctaaaaactgattagaactagaaaagaagtggacatgttttattatctttgcattacgttctaacaaaagcagattatcaggggctcttactcacttgccattcctgacatgagcactataagtgaatactatgagttctacaaacagaacatttttccacatgaatttgacttgcaaaaagtgcaaaagggaatggtagaaccagaattactaagtacggcatcagtgtgaatgtgggggaaatttgtgtataacttgctttgttctgctgagctgatatttcacctgattagcagatggatgactgtggaaagatgaagtactagtcaaggatgtggttttacatagcagttgctatttccgggactgaatgatttcttcctcttggtcacatgcaaaatctcacccagatgtaatgtgataaacaaacagtttacccagtgtaacctttaagcaaaaatgtatggtgatctgcatgtgaaactgtctttctctacacaggtattagcaaaacaagaatacatgaacagctgctatcaacttgtatactttttttccacttgtttatattttaacagccactgagagatcagtgatgctgtggtgacagcagtcagcattatttcttagagaatacaaatgtattaagttagagtaatttcaggtgtgttaaacaggagatgcttctgaaggccacaagtttggagcttactttaacctgacctacatgaacataagatttgtaggatgtggataaactttaagaactggatagtgaaggcgtaacttttgttttgtaaccagttacgcctcttctgtaaactctataagagtgctcaaaggtgaatcaaacttgtatatcattccttgtcaaataggctgttcccactggataagaaaatttgctgtatgttttcctgaaaaattttatagtgttctacaaagccatcaccttctgcagaaaaaaaatgttacttatgctccacctccccagccctcactaaaaactttggtagccctatggcggtaccctaattaaggtcagtgcagaaatctcaaccattacagaagtctcttactattttggctctcaaaatactctaactagtagctctgtttgctgaatctagaagtaggtagagctgtaaatagtttaatagaatgattgggacatactcccaattaagaatttgcaaattgtttaaagccttatggaggaaaggacactttcagagatgtttattttttaatagtcatcttgatatgttatcactttaaagcttgataatcgaaactcttgagagctattaaggttgactgatagacttaaaaagtgattgctttataattctcgtgggccataggaaacaccttcagaagggaacaagcaactatggaggttctttaattcatgccagggacacaggcagtccaatcttgatcgggtaactacggtgcacttttttctcatttaaaataatctaatctgtatccagttaggaaccagaagactttcagatagtttcatgttttccttagagtggtaactttctttactactccttaacagcttttaagaaaaagcctatgggctctaatttggacttccttttggagtagaatgtcaaggctctgacttagaagaggtccctctaaaatattgctgcaggctcagagaagacttagtgcatgcatctgaaaggagaattaagcaattttaaaagttaagtgctagttaaacataacatttgtttcaggcagcatggatattaacttcagaacgctgacaagccagccgatgaggatgaaagtttcaataaggaatcatactgttccccagtccatgacagatttttgtagctggtaagctcacactgatggcactcgcaactacggacagaagtctcttttgcttgtgatttgcacagttggttttgtttgcctcagtccaacaatgggaaatatattccaagggaactgtgaaatgggtcctttggctctgtgcccatttcttcaaaagccaaagactgaattctgaacagagatggttactgactaaaagggggtaaccactgaggaaactagggagaacaattcaaaatacgaaatctgaaggtttttaacctcatataaattagaatcaagatcattgtttaccctcattggagatgtttgttagagaaaaattcaggtagcgccaggttattcacaaaggaaaattacccaggaacctgcaagcatttaatttaatcagtatagtttagttcagtagctcccacaattagcataatcaagtgccacctagttcaccttcaaggattgtgtcttggggagtatttgaaaaatacaagaaaaggaaaaacttttatagcttttttattatacatatttataaaaaattaacacttttgcctgcaaaatagtttttacccaaatcacatttgaaagtactaaaactaaggtcaggtagcatgagtaaaactggggcccttaacaggagctggagccgcctctgcctgggggaattctcagagaaggggaggttctctgattttacctggagcaagaatggagacagaagtcagtaggcaggattttattcctgcttcagccacatgtttctgtgtcagtgaaaatgaaaactgcccatttgatgcctgcttaatcacaaaaaagagccatgcacatcccactttgctcaggggaggacgtttccctaggcaagctggaaaaatagtgaaaactgatttttttttttttggggcatatgtttttcagccaaaacattttcctcatgataaaatgcaactttatatgaaaagtgaaaaattctaaaaaatcacaggaatggccaggcacattggctcatgcctgtaatcccagcactttgggaggccgaggtgggtggatcagtggtcaggagttcgagaccagcctggccaacatggtgaaaccctgtctctactaaaaatacaaaaaaactagctgggtatggtggcgggcacctgtaattccagctactcaggaggcagaggttgcagtgagccaagatcacgccactgcacttcagcctggtgacgagcaaaactccatctcaaaaaaaaaaaaaaaaaatcacaggaactaactttgaccaaatgattgacagaaaccagtgaacattttcatagtgatcaaagcaccccaaagctggtccttctagactgataccagttgatctgttgtttcgttttggagatgggcagcctcactgctggcctctcagtggttgcttttaggatacagctgtctgccctccgaactggtggctggagtatcctccagcgaacagaaggctgtggaatttgtatcatgctctgaaaatagacctacccgtagcttatggacataaagactctatgcagaaacctcctcaactttaatttgtagtcagctatggcaatggaacacatttttcatagggaactttggatggattctctggtgctacagaaaaaaacagtaaatggtccttcaagtgtatcagtgtagaactgagagagaagaggtaaaactgaaaaagaataatgaatttgttttaagattgaagaccttcctgaaataattcagttactttggtactgcctagccctgtaagcattttgcttgaaatttaaccttttaagcaccatatgctaaccatcaccatgtatctgggggcaaaaaagaagccttaactaccattccctcactctgtccccgtcatgacaacaggagctaagtcttgaactgggggttacacagcactcttaagtaggcgtgataagttttgcaaaatgttcagtatctcctcagtgtcttgtccttaggtagagacaggtccagagctacaaatgcacccatgtggaagagatttgattcagcagaacagcaattatgtagtgccctggggcgggaagtgctaataatgtttctcagctcttgaagaaacccctgacagaattttagttccactacaggtatcaaaaagattcccagctctaagtcttggatattaataaggctccactgagagggagaaatcccagaatcaagagagcgctcccttcccagccctgcctccaaaatgaagattgaaggaagtttttattctctcaatacaaaattgttcaggcacagtcctggtggtggtctgtttgtaactttagtgtatctgggactgtaagtaacacctgtctacgctcttcccatgacctataactcccagagatcacctcttatggccgcctctatcttaaagttgagacccgggacttggaaaccaaagccttgctgtagtaaacaaatcagcagtccttttaaatgctggaggcacacacaggtctgttttcccatgaagcaggaggaaagaggagaaacgagattctagaagatgagcccagcatctaccaaaaagaggatacaatggaaaatcttacagaaacaaatgtctgggatcccactgatgcacagccgccagaccagaagaggagggggagagtgagtgctgaaagcagaaacgaggctctgctgagcaggcacagaacatgtgtttacacgctgttgtgggcccaggagggaagagcgggcacctctggatacagtccacaatgtcaccatggccagtcgccccaagggttgagttggggcactccattgtccaagtgccgacctacctgccagccttccctttcctcctcctcccaacaagtacatgggcccttctgtccccagtggcctgctgcagtttacttcccatgggcagaactccggtgcgtgagtgctgattaaagcgaagtttcattggtgtgtggcctggagttctcctcctctagcagagctattctttgcttgagcatcctcacttgggtctcatgtctctccaccatggccatcatctgcgactctaacttcttcagtttgttttgatgctttttctttgctttctcataggcagccaccaggttgctaggtgggaatgaagggaaattggtattaagattcatcctaagtagcatcgtgacaccatcctgtccactggataaccagatctagtgagcactgctctgaagaaagatcactcatcctcttcggtaagaatctgaaatctagtggtcagaggagggacagcaccaggatgtcaacactcaacggccagtcacctactggcttaaccctgatgaatccagccggattgctagaggctggtcactctcacatattagaaggggttctaagagtcaaaccagcaatccaaattggcccagtccaaaacggataaatacaaatagtgggtctatttgttgctccatggttgcttgcaacatagtcaagtgtatcttacaggagagtactcctaaggcactgcaatcaaagtgaccatacctgggacgagagcagagaggttgttcttgttccaccttccctttatgctttgggctggtgggactcggaatattaaattaggccataagccaatgctgcaaagccaaacatggaatatacaggcctttgaactgttcccaccagagcctggtggtagggtatacagtgagcccaggtaggtccattccatgtacagtcattacccttacagctgcagttctcccagatagtctgaggactcaccccagagatttgtaaaacccattcaggaggtctgtgaggtcttgagcttttatttccaactatagagctggatgatgccaggtgttctcaatatacatccacataatgttgactacagaagcaaatgtgagaacctagctgtcttctattaagccagacattaaagatttgcagaattgtaagaccagtgccacttttctaattatttcttggaaaatagtttttcataaaaatgccatttttttttttgtaaatgaaataataaaaactttaaataatttatcttggttttagttctaacatgagaagtatcaataaatacaacttacaggaacaaaagctctctgaggtcctccgttttttatagagaagagtcctgagcccagtcttagagcagtatttcctgaagtattccagtggatattgtgttgctcaaataaattccatggctaattttgtttggaaaatactggcttaaacagattttttattatatgacttctcagaacatttaagatacataataccaggaggcatataccacagtatgctacatttggccaaaggatgttgttactgagcatttcttagtttccacagaccatcttgggagatgccactctaaggaagaccaggctcttagagagccaggtagggactcacccactttctagagttagttcttaagagttagggaaatgtccatccctggtgctgtgtctacatgcagggtgtcagtccaagtaccacaggtggagggcggtgggggctgggtatagggagatttttacctgttggcccgctttagatcattcacgaactctgcagattgctgatgtcggatttcactgctcttggtgagtctctccaaggcactcaccagctcttgaactctggccttcaacttcttttctctatattaaaggagacaaaatatgccaggagtagtttgagatgatgctggaggtgcccactccctgggaagtggtgacagaaagaggaaggtttagcttgcaaagcctaaaggcaagggagagaaaagatactaaagggcccaacagcgctactgtcacctgaatgaattcattctcaaatgcagatttaaacccatttcttcaatgacaagggctttttaaagatcttatgtgtcaaagaaaacaagacaggaatttctgtttctagtcttctagctaatctagaagttcctttctactattggcataccagatcctcagcaatgagtgcggcctgaccacaaacccccgtctgtctccatccccttctttttcaggtgtcctaagtatctcctgaaccactcaggtttagcaacctaccttgaacaggtccccactcattgagaccaacatgatcccaccttgccaaaaaccaaaaaattggtagagggagtagatatgatactctcttcattgtaagggtccttatttcccatgaaattacatttgcacttttgactacgtgccctccacaggcaaagcagcttcaagttctgtggatcctctactactttggtaacccaagctaattagagtcagttcagggaggtttccagtatccagtcagctcattgccttcctctaattcccacaagacccagcagggaaacactaatcaaagccttctcgactactctgactcccttccaagatccttctatcacatgcacagtgttactccacttagtagcacactcagcactatgtcaccgtattacgtgctggagccatgacgctcccccatggtcatgttgggttctagagtggcaaggactttacttggtttgattccccaatgcacccccagtgctgagcaccgtgcctgggtgacagcttctagtgactgttaaaacagctttagaacaacttactgaaggtaatgtatttgattctttgggcatattaagaaaccaggatttagggaaggaattcgtttaaaaaggactcactgtatgtagaatgtaaatttgcatgattaatttataagacagttgggtaggatctagcaaaataataaatgaacatgccccttgactaagcaacttcacttctaggaattgattttacagagatatcaggagcacaggttcctaaagatacatcacttatatttggattcacttaggcattggttacaataatgcctaataaagggagacaagcagggaactggttaatcacggcctacccatgctaccgaaatgctctgcttgaaaaatatttttaaaatgcagatggagggctgggggcagtgactcatgcctgtaatctcagcactttaggaggccaaggaatgtggattacttgagctcagaaattgaagaccagcctgggcaacatggtgaaaccccatctctacaaaaaaatataaaacttagccagatatggtgggtcatgcctgtagtccatgctactcaggaggctaagttgggaggatcgcttgagtccaggaggtcaagaccagtgagccatgatcctgccactgcactccagcttgggtgacggagtgagaccatctcaaaacaaacaaaaaaatcagatggccatgcactggcatgggaggatatctgatacattaagcaaaaagggtgagttctaaagatgccatttttgtaaaaactgaaaagctgagtgtgaatatctgacactgtaataagactagaaggtgaaacacaaactcaacagtgcttaactcctgaagggggttgatgggaggctttcattttctacttcactcacttttgcattgccagatatttttacaattttgtatattttctgtaaagtgcgagttagagtcatgtaggaacggcatgggaatgtgacgtcggggtagaaggctcctttctgctgcccaaactgttcagaccctggttctcctttcctagcttttcatatatctaatcttttacatttctgcctttagctactatgagggtaagtcaagctctccaaactgatcaatgaagaaaggaattacaacgtaaaatccaggcctgcttttgggagagaggatggaaggggcaggatctttaagggaagtctagcaaccagccctcagcccagaactcatttttcagtaaatcctcctacccgcctctgctaagctggaaggagcgtgtgtttttcctgggccctagcagcctccaggacatctcggatctggctgcatttcctcccggcattggagagtggcagcatttcctaccagcagtgaggatggtgttgcaggaggggggctcctttcctccccacccgccccccaacacctcctcggccttcccagcagtcctcctccagcggagggaagccagggactcctgcttccctccagctaaaaacagcagggaagggttttttgccctacattttattaccatttagagccctttatctttcattctaatgttgattaatagtgtaaaaggaaaaaaaatactgaagagttaaaaatgtaaccacaaactcaataagaaattcacaacaaaaaactctgggatgctacctagagcagtcaaatcccctccctcccccactcctatccacactcagtgaacagggagactggaaatcccagcccttccacaagacaaaacgcttccttccccagcacccaggccctcaggggaccagagggaactttctggatctggcaggctccaaaggaggatagaaccccagaagggcaggagagagtctctcagacccaggccaaccccagcttagggttgtggcgcaggagtggggagtagccattgctgggagcttagaactgcctggccttcagaagggaatgggagtgaaccgctgggagaaaccccaggaaagaactatgatgctcatttatttaaagatgcaaagacgaggccaaactgtaaacttaaacctaaaatttgggttggttgatctgttttcatgacaacacaaaaaaatgtaaaatatctatttagtttaaaaaatactgattacaggggccgggcgctgtggctcacgcctgtaatcccagcactttggtaggccggggctggcggatcacctgatgtcgggagttcaagaccagcctgaccaacatggagaaaccctgtctctactaaatacaaaattagctgggtgtggtggcgcttgcctgtaatctcagctacttgggagcctgaggcaggagaatcgcttgaacctgggaggtggaggttgcagtaagccgagatcgcgccactgcgctccaacctgggaaacaagaatgaaactctgtatcaaaaaaaaaaaaaaaaaaaaaaggatactgattacatgttgagatattttggacatactgggttacattgttattaaaattaatttcatgtgtgtctctacttttttcatgggactactagaaaatttaaaattacatacatgccttgcatttgtggatcatattatatcaccagtggacagtgctgctctagaccaattgtttaatgctgtcagaggcatgtgaaccagagcaactccatcttaaataggagttaggtaaaagtgaggctaagacctactgggctgcattcccagatggttaaggcattctaagtcacaggatgagataggaggtcagcacaaaatacaggtcataaagaccttgctgataaaacattgcagtaaagaagccagccaaaacagcaaacccaagacggccacaagaatgacctctaatcgtcctcactgctacactctcaccagcgccacaacagtttacaaatgccatggcaacatcaggaagttaccctataacgtctaaaaaggggaggtatgaataatccaccctttgtttagcatattatcaagaagtaaccataaaaatgggcaaccagcagcccccaaggctgctctatggagtagccattcttttcctttactttcctaataaacttgctttcattttactctgtgggcttgccctgaattctttcttgcacaagatccaagaaccctctcttggggtctggatcggtaatattttccagtaacagcattaccagatattttccctggcttctgactaagtaggtttcggttgagacccaggaattgcagtttaacaagggccccagctgactcttgtcatcaggcaagcttgagggactggcgtaaggcagaagagttcctcacctggacctgaggatgagcttcagttactcctggaactgactttctgaatttatatgcaaaattgcaagcacggggctcactttatcaagtctacagttttcctcagattttcaaacgatgacatggaaaatgcaaagaaacatagcttactaattcaagtcacattgaaacctcaaccattcttgttcctttctccttctaatttaaatttgcttagcctttcgttaagattttatatggtttgggtacataagttaggccaaaacaagctttcttggcttcacacaaatgagaaagcaaaaattcaacactacacgttccatatgcaccttcaatagtaatgtattcatacagtgtttcctggaatggccagaaatacataatccattccttttttatgcccagtagtattggcactcacaaatataccccatagcatcaagcaaaaacaatgctggattgtaatgactgtgacaactgaagtcccccagtacacacatggatttcagttccacgtcttcccacttcagcttttgggcttcttattcctggtgataaaaggtcgtatgactctaaccgcagagccagggtgggacttttaagagacagggtcttgatctgtcatccaggctggagtacagtggcacaaatcacagctcactgcagcctcgacctcccaggctcaagcaatcccctcacctcagcctcctgagtggctgggactacaggtgtgtgccaccatgctgggctaatttttaaaacttttttttttttttttgtagagatagggtcttaactatgttgcccaggctggttgcaaactactgggctctagtggtcctcccaccttgccctcccaaaatgctgagattacaggcctgagcaactccacctggtggattctttttaattgaaacgtaatgtggtacgtttcaaggcagtggaatatacacagggaattaagaggcagcctcgtggtgtgaatttaaaggtaatatgaaaaccaaggtggcttgccagtacgctgggcagagcgaagcaagcctcggaagtggtgcttgttggtgtacctgggtagcctggcagtgcggcttcgtgagccatcagtaaggaggttatattctccctaaaataaaaaggccagcagcggtactctgtgattagagtccaattgaggagctgcaggagtcatcgggcgagagcccagtctcaatgaggctgtgagtggcttcacagctggccaggaaacctttcagaggagctgtaatcagaccaaaccacagggagtcacagccatgcagccacaaggcctagaatttcttagtaattgctgattatatggaattagtcactaagagaattgtctgcatatgtgatgtctctcatcctcaccttccatttacttttaacccgtcaggctctgtctccactgacgtggatcactgagctcaccagtgagctccaagttgttgcatccagcggtctggtcccttctgtccttttcttacctgcccgcatcacctgcagggctgacagcctctttgctcatggcttgcacaaggcctccagagcctgatttcgttctgcttcattggctgctccctttctatactccatgacaaaatactgggtgttgtttaggacttgggcctggcctgtattttatcttatccttttctctaatggactccctccattcccttttcctaaaaacttccacactcttaatcttctggcctttccttggatctctggacttgtctgtttgcggcctcttaactggcatctgcgatttcacatgtccagaggattacttcccagatgacctccaacagccactctctctcctgtgttggctaatggcaccacctttcagccagtcactcattgggctcagatctctctgccttcttgcaaaggcagtttaagttacttggagtaagccttaactcctcctcccctcatccttgacatctgttcaacagcaaactctatctgccaagtctcatcctgccattgtcaccacacccaggtccaagtggtcatcacttctcacccggacaaccacaacagcctgctaactggtttctctgtctcctcccctgcatccctctgccctggttttcacacagcagcccaggtaacatttcacatgacagatctgatcatgttactgtccttcactgcctttcacctacacgtggaataaaccctgtggtcttgcctggacctctaaggccctgcttgacctgagtgctacttgctgggcctttgggctgctggaatcacccttgccctgatggaatcctgtaggtcctcaacacagccctgcacagccagggcctcttccggatatgattctgcctctctcctcctcatctcagcttcagtgtcacctcccagagaggcctagactgaccacccatctaaactcatgtcccagagctaagacatcaccacgccttaccatttccttcatattattcattgcaaactaaagttactttattggaaaaaaaatctccacagtgactgtatcacatcatcccgtttccttcatggtaatcaccacaatgtttacttattttttagaaaatccaggcagcagataacagctgtctctaagtcctttataaggataacatcatttcattcccacataaccttggaagtcagtactatcatgattctcatttttaaggatgaggaactttttttttttttttttttttttttttttttttttttttttgagatggagtctcactctttcgcccggtctgaagtgcagtggtgcgatcttgggctcaacacaacctccaacccctagggttcaagtgattctcctgcctcagcctcctgagtagctgggattataggcacctgtcaccatgcccagctcatttttgtatttttagtagggacagggtttcaccatgttggccaggccagtcttgaattcctaatttcaggtgatccacctgccttggcctccgaaagtactaggattacaggcgtgagccaccgcgcctggcctatagatgaggaacttaagattagtccctgcagaactgggactcccacctgggattctgtctgcagagcctgtgcccttacgcatctcactgggtagtagcctgtgattcacaaagggaatacagtagagtgcaagataaacaagacctctgcttaacagtgcagccctgcagaactaaggctcaagtgtccccagataatgaggttctgcaggtatgtcggtggctgtgttttgccaggagtagcagcacaaggacaacagcagtctaacttttttttgcccagactttgctatgaacatgtttcttgtccaggaaatccatctggagttttcacaggccttgccagtggctgctgggtgttccagtgccctctaccactctgcctttatgaggtcccaggcaaggccttcttctctttgagctttggggatgctggagggatggcaaaaaagtaaaataaatctcaattactcaagcaacaacccctccatcccttgagtgagcctcagtcttcaccctctgtgcttctaggcacttggctctggggctcagcagtttatttgcgtgctaatgaagccacaggcacactttgtattccattaatgtcctgcagacccatgtgcttttatggaattctaagcacaacttccattgcttgattgcttttatacatcaaccaaatatgaagaatcagcaagtttaaataaaacagcaccttttacaataatggtcctcctcatgaaccagtgaagattctgctgcttatttgttcagtgggggctcccttttaaaaagcaccccacccacttcccttttcattttatcccactctttgtgtggctcaaaaacagtattcatccacagctgctgaaataggggtcaactagggtcatcctttttccattcagggacaaatgttggttcctacaagtctggaagttttctacagttgggtggatggtgtatgaacttggacatggatttgaactctgaggagtctcgctggctttttcgaaggcactggtaacagtcaagggctctgtgggccactgatgggtaaagagtagtcagggccgggcacagtggctcatgcccgtaatcccagcactttgtgaggttgaggcgggcggatcagttgagcctaggaatttgagatcagcctgggcaacatggtgaaatcctgtctctactaaaaatacaaaaattagccaggcgtggtggtgtgcacctgtagtccaagctacttgggaggcttaggtgggaggactgcttgagcctggggaggttgagtctgcacagagctgtgattgtgccactatactccggcctggatgacagagtgagaccctgtctcaaaaaagtaccagagaagactcagagaatagcgggaagatacatgatggaggtgactgaaggaagcttcaagatggtaagcattctgattggaaaggatgagggagaatcagggataaagcaaagggtgtgctcttggaaagatgaattgtccagaggggctggactacagatcaagcatggggaaacatttgaaatatgggctaggaagttaagttagggacctacggacaatcttgagtgccaaggcactgaaggtgcttatgcagagcaccctaatccgaagtgtgttttaaggtattctggcggcagaatcaaactacagaatgacccattaggacactactctctgggttctgagggtcagtgcgatggaaaggaatggaagggattttaaggaattatgacctgctgacgagaggtagggaggggagacttacaagttataatcctggatcattaggagaaggggatttttaacataaataggaattcatcaaagggcaggaagaaacagaattgtattggatgtgctgttttgaggctttagcatatttgggtggagatgtccagtgggcatgaggttgagataatttagggaccatttagaaggaacagctgaagacatgagagttggagtcatgtacttggctgagtaaaccacaatccctggccctaaaaggactctctttctgtgtggggactgagggttaaggaggggagttgggggtagaaccaggcatattaagaaatgagcaatgaaatgttccatgggagaaggaaattcatggcgctaggaaccaaaaaagaagtgggagagggtgtcatttctgctgggaggtggaggatgggaacatccggatccattttacagatagctgtaagtcacctgatgtgaatgtttggggaatggcattgggtggggccaggacaaaagcagatgcaagactgaagccccagaggcgcagaagaggaagagcagtctcacggcaggtgtgatcgatcacactgaccagacaaggccctcctgccactggatatatccttacagggctctggcacacaaccctgtcttccagcagtggcagcttgcctacttcttattcagcagagaggggaaaggaagccctcttctggtggatgagtcaggggcatcctgtccctggacagaacggccactgtgatttgtcgattgccttaacgtggcattttacagaaccatctggcaaacacgcagacacagatggcatattccagttccctggagggctgggcacagcccctggatggtcggtgactaaatgaccgcagcctcctggagggcagggcgctgactcctgcaggtagtatgtgaggctcgccccaccctgctcctgggtagagtgaaaggcgagtgcctgtgaggcagcaccatgctctgctcctcaccatggctcaggtgatgtatcatggtgaggagcagcgcacctacttcctgcctcccagcactgaggaagcacagatccttactttaaaaagatattttttacttatttattttttaaagacgagatctcgctatgttgcccaggctggatttgaactggcctccagggatgctcctgccttggcctccccagtagctggaactccaggtgtatgcaacagcacctggctcactcagatccttacctttttatcagcatgacttaggctgacatatgccattgcttcacagctctgtgtgtttaaggaagtccgcctcccgccatggcacctcatttgcctttcgcactgacagactaagacatggctgtttactggaggcatagaggtttctcactgcccagaccagccacacagcaggtagtcttcagataaacgagtgggctcagctcactcatcggcaagcaagcccaatgctgccagcacatgtggggcacaaggggtccccatagagaatgtagaaacatgcagacttccccactgcctcactgtgtgaccttgagagatcactcagccttgccgtcccactccgcgcccccccccccaacccaccccaggatcacatggagagcagcacctgctcccggctgcctcccaagaatatgacggagatgaactagtctgctcctctcagctgtgcttgggtcccgagggcgggctgcacaaacaccatgtgagtacaaaaaaggagtcatttctgaaaattcccttatttagctgcctttttatagatcacttacttggtggaaagatcagtcaaattttactaggaccaagggtgagagacagatctgagatggagaaggtttttacagcacacaggctggatggacaagagagaaaacaaaataccctgttaagaaaacatctcgtgtgccagactggaaacctggtcatccagatggggttttatggcaataccacagccaacaaactgcaataaatgttcaccgaagtagggggaacgaaatcagaccagatgggagttatacatacagtaaaggcggggtggcatgtagccttggttttgttccaaacagaagaaagttaggagaagatacactgagagagccagggctgagtgacaagggctggccaggtaaggggaggttgggttggggacagtgtcatgacccagaaccagtgactgaaatgtcacagggcaccttccctgggatggctggttctccttaaggacagcccatggcttagcctcttcctcttcccttagcgacacctgatcttttcagtctggatgcctgcgcctacagttttggtgtctggcaccatccttttttcaagggagaaatactgctgaaaatgctggtaagattcccccagctgacctcaaccataagctcggctgtgatttaataccttcaaaaaaggtgttcgtttccatttgattttttaaaataaaaacctcaggaatcatttcatcaaggtatataatacaaacccaaactgcagccctgaggtgtgtatattgtatcccctcatgaagtgatgaccccagtttctaagctatatttacagtatcattatgttattttcctttttcctttacctctgtaagtttgttcttggctccatccacctgggtcttgattagaaatccatgctaaccaacttaaggctggttattggaaatccattgtgactgacagaacaaatgaagtctctttatgtttagtcagcacaatctgcatcttccttgtgccagcaaaggcctctgaggtttggggaatttgaaaaacttaagggcttagcttacagatacaatatccaaatggctcccactggaaatagcgagtgggatttccatcccgtgtttctggcacagttaagtcattaggatttgttgagggcatttttctgcgcagcttttctcttcccgccccaagcagagcaactgccatttaactgcacggccagaggctctggcaaagtacaaacagagctattacaacttggaaggaaagacaaaaagtgacaataaatcaggaaggtagtgaagttccccacaaggcaaccttccatccaccatcagcttggaggccatcctataaacaggcccgctggatcaagtgagctgactgaaaatacactgtacccttcccctccaaccctaaatccccagaaatggcaggaaagacattttttaaaacccctgagcatcttagaaaggagtgctctttgtatatcagaaatcatgctcaatcataaaaaatgaaaggcagatgttttcttcttcctgaagagaaaaccacaatgcaaaatgaatgcagaaaaatattctgcaaaaggaagaaggggattcagaggtgctccaaccagaggtgttggctaccagaacaggaggggaccaaatgcttgggtcagatacgcagactagagggctgttattagccaggagacacagaaagcccaggagacagcttctgatatgacccagctgacagcactttgaaggacctggctacattttctgggtggcagactgtaataagtagaagcaggactctcaaatgggatggccgggtgcagtggctcatgcctgtaatcagagcacactgtgaggccaaggcggttggatcacatgaggtcaggagttcaagaccagcctggccaacatggtgaaatcccatctctactaaaaatacaaaaaattagccaggtgtggtggcgtgtgcctgtagtgccagctaacttgggaggctgaggcaggagaattgtttgaacctgggagaccgagattgcagtgagccgagatcgcaccactgcactccagcctgggcgacagagcgagactctgtctcaaaaaacaaaaacaaaacctctcgaacaggtgacctaggaatttaaaatacaagaatgaacacacaaacaagaaccgctgaatatttaaagaaagcaaacaccaagaaagagtcacaaaactcaactatgaaaagaattacatgtgaagaaacagaattaatacagcagacaaaaaagatgaaggaatttaagggccgggcagggcactgcatgcctgtaatcccaacattttgggaggccaagatgggaagatcacttgagcccaggagtttgagaccagcctgggcaacgtagggagaccctgtctcaaaaaaaaaaaaaaaaaaaattagccaggtgtgggggcatgcacctgtggtcctagctacttgggaggctggggtgggaggatcacttgagcccaggagattgaggctgcagtgagctgtgattgtgtcactgcactccagcctgggcaacagaatgagaccctctctcaaaaaaaaaaaaaaaaaaaaaaaaatttaagcattataaaaatcctcaaagagatgcatatcactaaaaaagagatgacagatttaatcaccaaaataactcaacatataggtcaaacatcacaatgaacctaactaaagaataaattagtgagctggaaaatttagccaaaaaatctgtctctccagaactgcaactatctgatagggcagccacaaccatatgtggctcttgagaacttgaaatgtctgaatttgagatatgctgaggtgtaaaatacataccaggttttgaaaacttggttaaaaaaaaatttcattaatagtttgagaaaatattgactatatgttaaaataatgtagacatattatgttaaataaaatgttattaaagggaatttcagctgtctttgttctttttaatgtggctactagaaaatttacaagtacatatgtggttcacattacatttctgctggacaatgctgctgtagcacccggggaaaaagcagtgatggaaagaaggtatgaaaagtggagatacggaagacagagctagatgaatcagcatctgtttctccttgcaggaggagataaagaactggggggcggtgaggggaaagaaacactgaaataatagaggaaaatttcccagaactaaataaatacacaaagctttttcacactaccaacgctgaaggaaagtattcctgctgaagttggaaacaaggtaagagtgcctgttttcacctcactagttaacactgtcccggaagtttctagccaatgcaacaacataacagaaaaggaaaggaagaggaattttcctattcactgatgaatcaatgactgcctaagtgctgtctcttaagtgctctctcttctcactgttttgaaaggcctggcaccaacaggccttctccatttctggcttccaagacatgggtaaagtggaacacatcagcaccttctccttttgggagcagcaaagagaactcagaacaaagtctccatgcccaggataaacaccagctggggtggggaaagggtgcttaccgacgaatggcgttggtgaactccgcagccagctcattctcgctgcacgttgtcctgagttcggctagggacagagctggggaggcagcatcagcacactcctgacaacagcaaacacattccagttaggcctgaatccaagccggcagcaccctggaagcctgcagcagagcgcggtaggtggctcgtgcagtgatggcagcagtgtgggcaccgggtggcgccctcaggtcatgccaaaggggaaagcctggcagcaagccaaagaggcccctctgctcccagaccgctggctccttttgcagactggccagtgcggtggggatgacacccagtatgctctgagcagccgctgatgccaggcactggtctaagcatgccatatgcattcaatcatttaatctccacaaatactctctgaggcaggaactatcattatctccattttaccaaggagggaatgaaggcacagagaagttatgcggcccagtcaccagctaggaaatgggggaaccaggattcaaacccaagctgtgtggccacagatcaatctcttgaccgctaggtaaagcctcttgtaatcatacaagacaagtgagaaatacctgtgaatatccttggtgccccatcccacgtctccttgggagaaaagcaaactcctttagatttaggagccttgctgggttcagtgtaatcatcaagaaaacccagcagaggaggaggaaaacagaagtgcagcccaccccatggcttagcattagacagggaccttgacatcatctaaagcaaatcatcccaccctgcagatgaggaaacttaagagccagtgctccaaatcctatagttaagactattcaaagcagtgaccatgcctgagtgctctacattccatgcacagagaggacagcagccacactacatagtaccatggctgggggaaggcattcatcggatgatctctcaacggacatgagtgctaccaagctgcagacctgagaataaaaagcttgtgatctgttgcaggagatggaatgtaaacagatatttttttgtttgttttttgagatggagttttgctctcgttgcccaggctggagtgcaatggcgtgatcttggctcactacaacttctgcctcctgggttcaagcgattctcccacctcagcctcccgagtagctgggattacaggcatgtgccaccacgtctggctaattttgtatttttagtagagacggggtttctccatgttggtcaggctggtctcaaactcctgacctcaggtaatccacccaccttggcctcccaaagtgctgggatcacaggcgtgagccaccgcacctggccataaacagaaaattttataagatatgagctacagagaggcacgaattcagtgctgcaagtccaggcatgtggtctcccgaggcagttccttggcagtggcactgccaacacttgagtgctcttccctctgccatgccctccacctgggccgccttccacctcctctccacctacctgcgctcagagatccaagtcccctgtccacccttggaatctgttgagattcccacaataccctcactttttgtatatccattcccatttgatgttaacatttcgtgagactccttaaagacagggactgctctgtctcattcacggtgcctctcactgaatatacttggcagtatctggtgcacacagacgagaatttcaaaacctaacgcaacttggataagatttggaatccagctgtgctagttggagggaagctttttaaagaagcataagcacccacccagtggagcaagaaaaaaggttcaagactcaaatgtggcccgccagctgctttttatgacccacaggataagaatggttttcctatttttaaaatcattttaaaaagtcaaaagaagagtattctgtgacaggtagaaattatatgaaatttaaatgtcagcatccatacataaagtattactagaggccaggcacagtggctcacgcctgtaatctcagcactttgggaggccaaggcaggtagatcacttgatgtcaggagtttgagaccagcctgaccaacatggtgaaaactcatctctactaaaaatacaaaattaaccaggcatggtggcgcacacctgtagtcccagataattgggaggctgaggcaggagaatcacttgaacctggtaggtggaggctgctgtgagctgagatcgcaccactgcactccagcctgggcaacaagagtgaaactccatctcaaaaaaaaaaaaaaaaattaaataaagtgctactagaacacagccatggccactggtctccctgttgcctctgcttttgcgctagcattggacaatagcaaagctgagtggctgcagctgcacccaaatgacccacaagctctacaacattcactgtgtgacccttcacagaaaagtgctgaccccttctctagatgctcgcctcatccagcaacagctaagaccagatgaatagcccagatgggagattttattccaacagtaaatggatctagtatttgaaaggcaagataatcagcttatttcattacctgaaaaacacaacatactcttataaaggttcttactgtagtgttaaaaaaaaatcatctggccttttccataggataaattttcttactttttttttttgagacagagtctgactctgtcgcccaggctgtggtgcggctgcacgaccttgggtcactgcaacttccgcctcccaggttcaagcagttcttgtgccgcagcctcccgagtagctgggattacaggcgccaccaccatgcccggctaatttttgtatttttagtagagatggggtttcaccatgttggtgatgctggtcttgaactcctgacctcaagtgatccacccgcctcgggttcccaaagtactgggattataggtatcagccaccacgtccagccaaatttccttactttgaagccactccacataacagtatttcacccagtcaaaataaataccaggaactaggggaaaatgctcagttcatgggccttctggcaagaacctggtaactccattcctaccacaccccaagaacacacacaaacactagcgctctgtctctaactgactgctaacaaactcaaaaggcaaaaaaaaaaaaaaaaaaaaaaaaaagagagagattttgaaggtgtttgtatggaacctcatcttcccgagccccagatacttccatgtgaacccagatacagtaccgcatggctgatgcccacctgcacagcctgactcacctcccccagccttgggcagatggcttcatagtgcacttggcatagtgacttctctaaagcccaaactgtatcacatcatctcttgctgaggacccttccatgattccgcacggccctcaagataactccagccagtgcatcaactccacaaccctccgggccattaaacgtgctgtcccatcagcctaagggcacctcttctctcccctggccctccacctgcccctcttcaacaggctacctcccactttccactggggctcagctcagaagttcatttcttccagaaaacctgtcctgaatctcccaagtggacatttgtgtctggcttctgtcctcccatggtgctaagaattcagcctcgcactggggacattctctcactgctctgcgatcacccatttgcccaccagtctcctcctaagaatgtaaattcctagaggacagactgcctgtctaccacagagctgcctctagcaccctgccttggttctggcacgctgtgagtgccaaatcacatttatcagctgaatggatgaataaaaagcagccagggtcttgggagggctggcctggctgggtgccacagctgtgtcttgtcttggctcctcagcaagtgggaggtggagaagggtgtagctgtggccatttgtgaatcatgcttcagagttcttaactatgtagggagtgacaattcactgtcacatgacatcagtactgttccttctttcccaggtatatggctctcctggagacgatcctgcacttatgctatgagaagcagcttattagactagcaagttggcatatgtctgcgagtcctgggtctgaaacaaatgggggtcaagagaagcttgcatttattaagaacagaaaaatatgatgcacagaatatagatgacccttggacaagggatataattctttagagtccacagttgtttttttcccaacacagtatttggaaaattctgagatacaggataatggaatgaacttggattccagaaaaaaaaaaaaacacctgggggctgataaaagagtgagtttgcaaaattctatcaccagacagcctgctttcagatgatgtggacttcgtaacccaaggcttccttcctcctcctctgccggcaggctgattcctgcttaccaccctgtgacggtagcaacgccagcaggaaggagtcaaggaggaaatgcagtggagagaagagagcccgttagtggatctgggctaaatcccaattctaccatttatcagcagtgagactcctcacttctttgagcctcatttttctcatgtaaatggggataactattctttcctcagacctgtgagacttaagggcgataataaatgcagtcattggtacagaagtactgtagctcccccttaactgcagttttgctttctgtggtttcggttcctcaaggtcaaccatggtctgaaaatattaaatgggaaattctagaaataaacagtaagttttaaattgtgcaccattctgagcagcgtgatgaaaccttgcactgacctgcgccatcccacctgagttgcgaatcattccttaggccagcatagccgcagtgtagacactccccacccatctgtcatttagtagctgtctccattatcagatcaactatcagtgtcacactgcttgtgttcaagtaacccttatggcatgtaataaaagccccaaagtgcaacattaatgatgctgacatattgttataattgttctattaatattttattagttgttaatcttttactgtgcctaatttataaattaaacttcaacacaggtatgtatgtataggggaaaacgtagaatatataagggttcagtattacctgtggtttcaggcatctatgggggattttggatcatatcacctgtggataaagggggccctattataccaataaaccaacaaatgagggctgccgtgtgacagaggattagacgaaggaggtgagaacagtatcagtggacaactgcagagatcacccctctgatgtgactgtgatatgtgaaaaggttcaactattacataaagtgagatttggtatttctaaaatgtagacctggtttcattacactcaaaatgtcaccttcttagatacctacgaatggcctgcatttcctatgcaaatacaagaactgaggcagcagggcggtgaggtgtggccagtggtcactgggcagtcactgggcagtcactgagcctaagggtgtccccaagccactccggccctaccttgccaggtttgtctttgctgccgctgctggtggagctgagggatcgcatccgctgctccttctgctcctccacctcggacttcaggtgctcaatgtgcaccaggtaggcctgctcctgggcctcccgcgtgctcagcttcagctccagggccttcttctctttctccagtaggtagagctgggccttcaactcggccatctcctcctacagacaaaggagcacagagcacatgaggcatgccctatctgagagcaggcctggctgctgccaagtgggtgggtggggggtccccggctatgacccacaggcccatggtagagttctcactttgaagttggcagtaggatgagtgggaggagacgtggcacctgtcaccacacttctaaaggaatgacgtatggacaaggccatgcactttgtcagtctatggactagacctgagacagaagggtagaagttacaggcaagattgtggttcaatatagggaaaacctttctaacaaatagagcccccactcaggcacatgggccttgatggaaacccattctctggtctgcagaggctgagctgcacctgccagaggctgtaaagtcacctatccatggaaggcctcttctggccaagccccttccaattcccattttggtttccatggcaccaaccacatgtttaatcacacccacggcacctctgttgccctgtagctgggccaggcatgcggcgaatgcctgcagcagcatcaacctccagctcttgcctacttctcagggcccaaatgaaatcaatagaaacagcatccttcacaggtgactgctcatcagacaacttctaaaagtatcctaagaactcaaatgagagcgatgagtggagaatacgaagtgaatccaaaataggacagtgccatcctgggaccaggagccagtaacaatgacagccagtagcctttactgagcacgtggcactgtgctaagtgttcacatgacgtggctcatttcatcttcccaacctgggttaggtattgcaactatctccattgacagatgggaaactgaggcacacagaaggaaatccccctgcttatggctactgggtaagctgtggagccacagattgcagccaagctgtctggttcagagctatactgcctccctccctttcaaggtgagcccacgcatgactcttgtccccgcacttctgctggagagtaactccaccagcccatggccaccaggtccagccttcccagcccaccgtgagatggactcacctgaggttagttcagattctcacaacccccgaagtcacccttctgaggtaataaaccacaggcctggtgcactctcctgggtaagttggactagggggtagatgttttcactctcaaatgtggggaaatgggtagaggacacccctcgaaagggacattagtcaatatgctcagtaaactactcagaacatgccaaccttctttaccctaaatatcagacataaaagccagaatgaaaggtgtgccacgcccagagccttcggatcttttgccattggaagcaggattctgaaggttctggcaacactgcatactgagctaatgtgatggtcgcttccagaacaaacatataagtgcaggcttgaaagagggaaagagaaacctatgggtgccagaaatgaagagggaactctgccagagagaacggcaaggagggcaggtgctggccagcaaggcgtcagactgtcctcaggccctccacccgggggcttaacattacccaaggccagggccgtggcctctgaggcagagagccacagctcagacccctacgggagcaggattctcatcaggctgcccataagacactaggaaacttcctttctggagatgtgacaagtaaacttgtcatctctcaggctctgtgtgggaaaagaaagaaaaatctctttccaggaattaaacctcaagcttgtgtcatgtgtaggtgtggtacaggaatccagagccaagaacttaataacaactagtcctaaacctcagaaactgatgagtcccaacagatctaaacatagaaccactctgtagggacatctgcaacccaggatcctcagggccccacggaagacagtttccacagaggatgagctggtgcttgcattctctccccctacccccaccaccgaggaaatgagaatgaatcagcactgacgaagaatgagcggatgcaaaaagtaagagtcagcatttacaagaagcagaaataacaatgtgcaaaactagaaaataaagatttaaaacaaagtgatacaggagtcataatgaagggataagatgttcaaaaaggaagagaaggccaggcctggtgcctcacatctgtaatcccagcactttgggaggttgacctgggtggatgacttgagcccaggagtttgagactggcctgggcaacaaagtgagaccctgtttctacaaaaaaataaacttaaaaagtcagctgggtagggcagtgcattcctgtagtcccggctactcgggaggctgaggcaggaggatcacttccagcccaagggcgaggctatagtgagccatgactgtgtcactgcactccagcctgggtaacacagtgagaccctgtttcaaaacaacaaacaaacaaacaaacaacaacaaaaagaagaatggatttgaaaaggaaccaagcacatcatctagaaatgaaaaggtattacaaaaacagaaatttgaatttctcagcagttggatcctagaaactggtgaaaatccaacgtaacctgctggataatggatttggtatgggtgagcacacatccccaagcagactgggagggactcagaggaaaaggggacggctctgatatttagccttcaagaaagtcatagggaaccaagccagaatgctagcaatggctgccctggatcatgatattatggattgttctcctcccagcttttctacttttttagaaaatttctaagatcagtacacattttattttcaagtggcaaagggagtattagaacttttattccaacaaaaatgtctttcttaggtagaataccagtaaatttatcaccccacgttggccaattttaaaaaggaaatccttagtctttggccaaaagaaacacaatgtttggaacaaatgatggaagggtggcctcatagctcgtgccacaggctgcaagcatctgcaaacagggctcccagttgggggaaaagtcgctacaatgatggacccaagtctagctcataagcaatgagaggtggaatcagccaaagcagcatgaggattctctacagagaggtcaggatgggagctgcgtggcttgatgaagatgagccagtttggaaatcatgggggtgggggtgggaggtaagattcctgtatctgttaccactgcctagtgtcttcccaaacttcgcccagattctagctcaagaagctcccaaggacagggctgtgctgagtgagtcacccctgagggtgtcaggatggctgctgttgccagctcccctccactctccagagatggtgcgaccagggggttgtttttctccctgctgcggacagtactgatcctaataggagccattaactctgcactgccacgacctgctctggcttgctagactccagttcctgaccggtcctaaactcaatctctggctctcttcccctccccggaggtcaggtggctgaaagtcccaatcctccaacacacgcctggtccttctggtgaccagcccacattctgaagctgtctagggcccaccataagtcacctcatcagcatcacaaagacacccctagctcagcaagaaactccaagggtttctcaaactctgtcccaaaaccaaggacaaatatcagatatggtcttatttataccacagctgccttgtaagagcaggtaccaggtgaagggctggtgcctggcattccacaccagaaacaggcaaagtgatgtcttgttgtaggtatggcggtttaactacttcccagtaggggacaccagctttccaagaaagctcccttctgtagaaataccagcaggtaggtatctccactagcagctgaagggcccagtgtttcagatccactgaaacactgacctcaacagcactgtacaccttcactggagggcactatggtctgagcaggctcgacattgcaccaaaggtacagggtgtcaggaaactagggctctcggccaaactctacaactggcctcaccctgttctccccctgccggagttaacatcagcatcagcaacccaagacatatttccaagcattcttgagattaggggtcaatttagatggacagaggctccaccctgcagaggtctgacctggcttctcttagaggatgaagggctccaaagttgggctgggacaccctgagaaatcccttagaaattcaactcccctgtccagaaacacgcagcccaagtgacccccagacatagtgaaaccagctctgtctataaacaagggtctagctcttctctgggcaggaggggttgattcctccttatctgctggacctgctttcagaggttgtttagatttcctcctggtggcagcctagcacatgggacccacccaccacataccttcatggccatgagctcctgcataagcactgcgttttccagatccagcctctggctgtctccccgaggcttgacgtcatagctgagaggatcgatgtggatgctttccagctccagcatggtcagcttgaccgcagccctgtcattcttgagctgctggatataatccttcagcctctgctcgtcttctttagtgaactcggtgtcgcaactactggctgtggagctggttgtgctgagaaagaagaaaaacaaagacccaccaccctgtgttattccaagtcatggcaaatagatctttcctcctcactcttctccacattccctctccccagtgttatttagatggtaatccaaaaatcagttttcttcacagcataggaaaatgataccaccttttaggaaagaattaagtatgaagaataacaaatgcttacactccttgacgcaacactgtggactctagaaatgaatttctaaggaaataattccacagaagcaaaaagatacacatacaaaggaacataatctaaaatacagtttagtgatttatcacacctatcaaaaggagggaaatcatgtggacattacagtgataattgtaataagtgaaattatagtgatatcgacaatggtggtgatattttgaggacataggttaaaagatattatatatgtaataaaaaagatactcatgtggtcagaacttaaaaaaggtatatttaaggcaacaaaagttgaagcacaaaactcctatggcatgatccacagatgcgtgtcacaccctcgcacgtgtacgcaggtgtcccaggctgtggcagccgtccctgcggagcagcaccgaagggggctgttttgctgtgtttacttctgttgtttgcaacatgtaccatgaaaaacacaggggtgcacaacacagcaataaccactttgggagtagggtaccccctggccttcacaggatagtctgagtatagtgttcactatagggactcgggctggcccaagggcccttggcagcccaaggtgaatggtgaccaggcagggagcccccagctgaaccccaggcctgtggcagcccaggaaggtttctaggggaccaaaccaccatgaaagggggagcaccactggaaaacggaggccacggctttcaagtgggctctggccttttccagcagtgggcaggctgctccccgtgcctccgaataaggcccactccactcggttgaggactctgaggccagtgtgcaccgacagcagtttctctgcacttgcactgggcctccctaggggtgactcgcccctcatggaactggtctgaagatggcagaggaaaaagcagaggcctactgaccttgcatcaaaacaggccaggctgtgttgtcatgtctgttgctacagatttggaaagtgaagctcagagacatcaagtggtcagccgagtcatgcgactggaaagaggtgcaactagacttgggccgcagcctcgtcccacagccctgtccttgtccccagaatcctgtagctagaagctataccaggggccacgagtgatctccacaggccgccagatgccacaaacccaggcctgccctcctcatctcacactgcaaaagggtaagagccaggaccccaactcagtagctgtagtccccacagcctagacatgagtgagggcaggcccactcttgtacatgacacattgctacgaagacaaggcttccggggagagaaaagctgaagagagatggtggctggagctttgctgttcacaggaggaagaggctaccctagggcttggggtggtcttcaagtcagagaaccccttctagaatgggaaactcctgagcactagaaaccctttggggctgcgtctcactccctctgtaccatcaggacgggtgggaagtcccttggagataaggtaagctagatcagcctgaccattaaacaccatctcttcagaggctatgcccagtaagttcccacgtcagctgggctgggctatgtgcgcagttgcttggtcaaccaccagattaggcattgctgcgaaggtgtttgttacatgtgattaccattaaaatcaagagactacagggagactgtttccatacagtgagtgaacctcgtctaatcagagaggccttaaggggaaagacaggtcccccaaaagggaaaaaattcttcctccagacagctttcagactcaggatggcaacatcaactcttccctgggtctctagcctgacctgcagacttcagatttgccagctccattatcaaatgggccaattccttaaaataaatcactgtttgcgatttactagaatctatatcaagagatcgatcttgatctttctatctaggtatagatgtctccatatagacccacctcctattggttctgattctctgcaatgccctaagagcaaagtgctacctttacgtgtgacccaagcgtcttacatactttgaatattccctgtcttctcatctctaaaatgaaggtaatcatagtacctgcttcataaagtcagggtaaggaataaatgaggtaaaattagaagtgtttgtaatagcaaagacatggaatcaacctaaatgcccatcagtggtagactagatagagaaaatgtggcacatatataccacgaatactatgtagccataaaaaaagaatgaggtcatgtcatttgcagaaacatggatgaagcgggaggccattatccttagcaaactaatgtgggaacagaaaaccaaataccacatgttcttacttataagttggagctaaatgatgagaacacatgaacacaaagaggggaacaacaaacaatgggcctacttgagggtacagaatagcagaagggagaggatcggaaaaaatgactaatgcatacgaagcttaatacctgggtgacaaaataatttatacaacaaacctccatgacatgagtttacctatgtaacaaccgtccacatgtacccctgaacttaaaataaaagtaaaaaaaaaatagaaatgtttacaacagtgcccagcacatagtaagcactcaataaatgcagaagtcatcattcatttattcaagaaatattggagtgcctactatggggtcctggaaaaatccctgccctcagggaactcatattctaatagagtaggccaggaagtgaaatacacagtccatgagatggtgaaaaatgaagcagggaagaggcgtggggaatgcagagtgggcatgaggttattatttgtgattgagctgcagggaaggcctgtgtgatccagtgacatcagggtggacctaagggaggcgagagagggagctacgtggatgtttgcaggacacagtaaatgcaatctaggcagggagtgcggccagcagaacgagatggtgactgaagcagtcaggcaggggagagaaagaaggagaagtggtcagagagggagtgcgtgggaggggctgggtgccaggtcatgcagcattttataagggctgtgtctttttctctaggattaggatggaggccattgggggttttaacagggagggatgtggtctgctttattgttacaacaggatccatctggcctctaggatgagtagagatgcagggaggccagggcagaggcaggggtgcaccttgggagctacagcaacaattccagggagagatggtagcagcttggagcaaggtgggagcagggaaggcagggagaaagataaaaatgactactgatcatcagcattatgttttctcaagctgtattttaaaaatgagaggggagaagcagcaacatcctgcagctggaacaccacgggctattccacagtgaaatgaggcagctcaagggaactgcaaagagagcaaagcgcgcccacagcagagggcactgaggaccccggctgtgcatcagaggacgcatccaaaggaccctcagcatctcagcgaaggcctgtctgcctgcaacctgctcagcggcaggcatgcctcgtacaaaacccccaagtagagctcaggagctcaccttcacaaatcatcaacactgatgtggagggacagacatctaatgttccacaggcgaacgcgcgacaaaattagagcaaactcaagtactggcactgtttgcaaagcattctacagacagggctgagggtggagatgtgctcacagcctcgacatgtttagacagcgtggcgctggcagacagcagcacttctcttccagttacttgggaggtttcaggaatgaaatccttccttgtaaacctgggacacagggtgtggggtttacttacacctctagtctttcctttcattaaaaattattttgaaaactttcaaacctatagaaaaacaaagaataaccaacagctgtgcgtctaccacccacaagacactgaggtatattttcttcagactactttttgggaaatataaatttatacttgaaacactttttgttgactttcatttaaaataaaaatcacaaaattcaaagagtggtaaaagctagcattctctaattaccctgcaggaactgaagtgatactattttggcagattttccatttagcaggactggtccaccccagcagttttccaagaggggtcccgggctggccgcatcagcagcacctggggacttgttagaaatgcacattccggggcctgctgtcaagacctccacagtcaggaactctggaggtggagcccagcaatctgtgttttaatataccctctaggtgactctgatgcacgcttaggtgtgagaagcactggtctccccctcaggctaagtgggcatttgctcaggagcctgtgaggtgactggatgctcctaggttttctaggtagaggccacaatgctcctggctgccctggtgggtgtcagggtctacgagcaggtctctgatgtcagtcaaacctggataaatgttcctcctctgccacttccttgctttatggcccagagtaaattacccaatgtttctgggctgcaggaaataggaatactaagggttcctgcctcactaagttgtggaaaggatacggcaggccctgaagcaggcagctggtgctgccacacagcacctgtcctgtgggagtaagagagaaggtggccactttcctgatggctttgccaacagccccacaacacctaacaccagactcagagatgccctgagctattggccaccagcaggtcatccagaatccctccatcccagggagaacgaaagctgccagtggttgaatggacttgagaaatcacctagccctaacacgaacgcaggcaggcagagactgacaggcgctgccacccttagggcccggagcctcatccatggcaggcagggaaggcttttgtttcacccaccttgctatgagtatagttttcaaagaggaaggaaataaaaaaaaaaaataacaaaagatctcagtccacagatcttaccctgttggaagcacagagctttaaaatgcttttagtggagaaagtttaatttcaagataaacctcacagcccctccggcttcccttctcctgcttccaggacagcagcggggaacagatcaggcgaggttaattacaattctgctttgagctcttaacgtttcactgcggaatatgattatgacaatggtaggggaggggaagccactggccttttctctggcctcacagacaaaggcgctggcggtctcccaagggcctgctgctggctgctgggcaagggttaagtcatccattaattctcccagcttggaatgctggatgatctcagttgtcaagggggaatcaatcactttctgtggctgcattattcctcctctccagaacaggagcctgtctgtgttctctgagagcgactgtgggggaaggctaatgacaaaaaccctcgccacacatgtgtgtcttgctctggcttcttgaggagctagtctaggatgtgtgggtttctcctttccgtgatgctctgctggagctcccgtcacgctggctttcctctgcatctgttcattgccagcagctcttccagcacaaagcatacacagcaggcctgtagcctggtgggaatgcggggctggctggttcgggacggttcgggccgacccactctccacctaccctgtccactataggagaagctgttcaaaccagctatcgacgtcaaatatcctctcttctatccctctccaccatgccccacctctgtcctcaagacagtcccccagcctgctcattagaagaaaaattcatttttcatagcctcctcagcttgccttggtggaaggctagaaggacatttcatttcttttgccttgaaaatccgtgatgacattttcctgaagttttcatcaacatcttacctggccctagctgagatctcatttccatcaaggagcagctctttttgtttgtttgtttgtttgtttgtttgagacagagtctcactctgttgcccacactggagtgcaatagcatgatttggctcaccacagcctccgcctcctgggttcaagcaattctcctgcctcagcctcctgagtagctgggactacaggcatgtaccaccatgcctggctaaattttgtatttttaatagcaacaggatttcactatgttgtccagggtggtctcaaactcctgacctcatgatctgcccgcctcagcctcccaaagtgctgggattacaggtgtgagtcactgcgcccggcctagcagctcatttttagaaggaaagtgccctgggggtgggcatctgttttgctgagcatttgaaatttatctgaatgagtggggtcagtccaatgtcctttccagtgagagtcctagaatggagaactttaccatcctatgcattttgcaatgctggcattttaattgcttagttttacaacaaacatacagttcttttgaaatcaagaagttagatctcactagaaaaaaaaccataaaaagcattccatgtctataccttgttctcatagaacctaaaaggtaagtgatgaggacatttgagcaggaggactgatcataatgctgtcatgtcaaggatgtgtcggggctggtctctagagctcactaacaccagtaagcgtttgtctcaaggactttggatagactctcctgacacacagatggaaaagcacctctcctcagtaaagatgactgtttcagccagatctagtctgactctcattccctgaagcttactgatgcctgttctaactaggtggctgtttcaaaaaattcaccctttcaatggacatgatttcactctcctcaaccattttttctgccccaatgaaactttaccttaatccagactagttcaaagagtgagagctaggcatctcttgagctctgctgctgtccagtccaacttggggattacaccccagagtgagtggccacacaggcagcaccctggctacctggaggtacctagaggctcacggcaaggctgcaaccaccattctcacagctctccagggtccccacctggtgctgagacaagggactcaatttcagtctctgagagtacagacttgctgtggccgatcctgtcttggccacagttcctttgtggattgagatcgatgactacgctgcacagaaggagctgaactgtgaggcctgccacagagggtgggcttgaccaaggattcctatttccacttcctaacattttagtccttgtgcctctttgtcatgatatgttgataaagccatccaggcaatcaacctagtcactctgtccataagactattatactttctgatgaggccatggctatatttttcaaaaatgaagtggcaccgaccctgggcacctgccaacagtcaactgagggttggctatcacttttattctccttgctggttaactacccctctgctgctcctctctaaaaccattaaccctcctgtcgttaggagctgcctatgggctgccagaaatgccgctggaggcacaatactcagcgtttctttcctgaacccttgaggggcagttgatggacactctgattagacctcttgaagctgggtggttacagcggggggaaaggagatttgctgggccacataaagctccaactcagaaagatccttttctttattttcataaacttgacaagggggaatgtctgagccagaatggcaagatttacaaacaaaattactataattatcataattatgaaaggggtctggtgctttgggactttattctaaacccacgtttaacataaagcagtctaattgcatcaggttctaagaatgtggagtgacaaatgaatgcctcgtgtgtggttcttccatcctcggagctgctctgatttgggcgggagggtaaaagtgattttttaaggagaattgggtgacattggagctaaagacctctgtactttgatgggaagatccatttgagactgaaattaatttaagaaccattctttggtgaggttatccttggaaacaatgactctgtgttttgaatttatctcaatctgcagaaaaacaggatcccaaattaaatttctctaagaaaacagtctcaaaatcaaggctaacctgtaagttcaagtacttctaacaaatattcaaaagctaaatagatggtgataaaattgttctccctcctgactggttctaaatttgtctctgattcagaataaaaccacaacattctttttgggggtagggaggtttgagcaaatgatccgtagcacaaacctcataagctactgaaacagcacacatttcctgtcaagcaaactcttatgttcactaataaaacaacacagcatcactgacaacatgagaactacatttctatactaaataaacacacaaattatagattatacacatctggaagagtcattaagaagagcatctgctttctgtgtttacacagtagaatatggttttatgaaaaaaattataatctgtgcttcactgaatgagacaattgttgctgaagtaaagaagaatcaagtcccttttgtttgtgggcacctggctgagtgcattactgggcatgttccctctcctgggacacctgggccagtagaggtaaatggaagcgctaaggtagatggcgggtcccaccaggggagaaagagagaggggaacattaagttgctttccagcaccaagaaagcatcagtatttctcctctggctctcaacagtcaatctatctttatgcagttctggtcacttagtctgcaagtagacactgttttgttatgtcatgagatccaatgtgggaagaacaatatgctcgatgctaagatcccgggttcccatccaggtttccctcttatcaccaggcaggtcactgacattatctctgagccaaggtttcctaacctgtgaaaatggagtaagttacccttccaagtctttcacgatttggcaattaagtaagaatctctaacaaagtgtcttctaaactgaggactggtaaataaagggaaggcattcgtgtttttagggctttggtggcaagaaatgagaaggtaagtagaaagggttttgttctgactctccactcccatccaaagaatgaaatgacttcagcaaattatgctctgcaaggtcttcgccgctctcttcctagcttcctttttcaagcacccactttaatttcctagattcacagacagtgaacttgacctcaggttcatgactgagtgcctgtaagcatgtgctgtgaatgtggcatcattccatgaggcaaaagagatgagaggagaggctcttgcctgagaagagcttatagacgatggaggcacaagaagacaggagagtgatgtctggaactaggatgagctgggctgggccttgggaccagagggaccatttggagcaaacggctcttggctaccctaagtgcttcctggaaatgaagacttataaagaaatggagaacagaacaatgcagagaaaatggatctgacagaaaggtaggtttgcattccatctctaccactttccacagcaaatctctccaatctcgactgcagtttccacattggcaaagtgagagggccactttctagctcttctgttctgatcttctgactcctttttggatggagcaggctgcatgccagaagccatgtctgccttttcccaagccacacagtccccaagagctgggtcactgcacaccaagtccagtgaacagatgccatgtggacacacgcccaccccagagcagaaggctgagcattacctggtgtggctgttggaggaaaggctctcccagggctgcacgctgcagccggccacggcaaaggctcccccacagctgccgtccagcttcatgagcagggccttggcagcgttctcagctgtcttccggcagtcatgagctcgcttgagcatctgagtgatgttttcatcccccgactggtctcctatgtggcagagaagccaacggattaatcaacataggcctggacaaggcacgcctgggagggactatgcataattaactctgttacttagggcagaggtggcactgtggaagggaattggcagtgcccagccgaagagaagatctgtgttctgggcctggcactatcacttagacgctacatgtgggaaggtatttctctgctctttctctgggctccactggcctcagggacaagtgtaggagttaaccaatgggatcaccacatttctgtttccagctctaacacgctctgatttttctaatgatccaggctcctggcttctcctcccattcagccacaagtctaccatttggccattcctctgtgcattggcacttccctgtgaatgagggagggagaaactagggcaaaactgtgccatctttccacatgtctacagctttggttagagccctgtgtgggggcaagagagacaaaactaatggttcagacgagagctttagattggctctgtattataggtaccgatgccacccctgacccttctcttggcttggtaatcggcgtgaactcaaatgcctccaggagccaggtaagtgggctagtgcagaacatcagggtgtggtgggcactcgcacagaccaggcagtgaagtccctgcccaaaatgttcacattcctattgtgatttaagactgtgctggaaaagacagaactatagagatattgaaaagatcatgggtggctgagctgaggtgggaggactgcttgaacttaggagttcaaatacagcctgggtaacagagcaagaccctgtctccaaaacaacaacaagaacaacagcaacagcaatggttgccaggggatggggttgggggaggaatgaataggtggagccagagaacttttggggcagtgaagctactctgtatgatactgtaaccgtggactcaagttgttatacattggcccaaacccatagaatgtacagcaccaagaatgaactctgatgtaaactatgggctctgggtgatgatgtgtcactgtaggttcatcacttgtaactaatatactaccctggtgggggacgctgaaaacgggggaggccgtgcatgttgagggttggaggcatatgggaaatctctgtgccttcctctcagttttgctgtgaacctaaaactgctctaaaaaaacaaagccttaaaaaaataaaacaaaacaaaacagaaactgtgctggctgaacaaatcactggtttgctacctgtacagcacagatccatgcttttccaaatatttttaaatgaaatcttacaccaaatcatagaaaatgctatcctaacatacaaaaaaggtaaatgcggaattggatgaagtgggcagaagtgggagacacactcagagtcccaccctccaaccccactgccgaggcccagagaaactcctccagcttcccagaccagtttgaaaaccactagcctaaagcacctgtgaatgaaagaatgaacagaatgaatgcctgtgacatcaacaagaaacaaagaaaagacccacaatcatagatactgtgggtgcatgtcacaaatgagttcctgctttgctgtgcaacagctctatggcatgatgggtggcatgatggcacagtatgatgggccagccactcctgtcagcggaatgcaagggcgaggcttaatggggaactgctaaaaatcaagcctgccctcagtactatggagagtgggcaggaaatggggtggacccattctgcaggccaaaaatccctggaactccctcctgtcatttctctgacaaacttcatgcctctcttctctccacaaataagacattttacatacatctcaccactgactgctatttggaattaggcatgacattacttactggctcatattataaatgtatacatgaacttcccagtattaggtaaatacaaagcatttcattattgattttgaatatttaaaaggcagatttatttaagctctttcagctcctacaccaaataactgcactgagtaggtacatgcctaatgaaaggtaccttgtgaggcctgaacaggttaagacactccgctgataaccaactggaaatacgattgactttttcctttaatttatcatttttcttaatacgtatattaatttaaaaaaatcctgacagcaggccaagatcattttaggatctgtttcatatgagaaataaagttttatggttcagttaaaagaccctgaaaaatgaggtttctaatggaaatgctggcagagtttctacttctgggctgggctggtaatactatttaaaaaaaaccagagggaggatcagagcatcactctccatacaaatgaaggtgtgctcctttgttggattacttggatatgaagcaggaaattaacacccaggataccttccttccttcacttttgcttcagattcctgtgcaagtcgaaactgaaggaggaaacacatgtgagtgttcagtgcaaaagtgagcccccagacaaagggggaggagcggggaagaaggacaggaaggtgcattcagaaggtgcctggatggtgactttctttgaagggtgtgtcctggatggacaagtcctaatggaagctcacagcagaaatccagtccatgacagaggcctggctaccacacatgggaatgcctggcctgcccacaccatccatctttggctctggagagacctggtcaccttggctttctgtttacttgctattgcctctccgaaggctaagggggtgtccggggcttagttctgcatggagagacggccacctttctccttgggtctctctttcctcttagcactgtttctactgcagtcctccccacatcactgcaggctcggagccacaatcactggccacgttttagcaaatgctgccgcttcctagaatgacatgcttgtgtccaattagatactccttccaccttactcaaaattgagggacagaagtgagcaggcagtgcagatctcgaggtacaggtcaggccaacagggcacaggatccccgggctgggggaaggacaggcacaggaaagcgaggtgggcgagcattctgtgatgctgacaagagcagggggtgaaactacttcttctttgttcgtaagacacctggagacctggcaggggaaacccatgtttcaaaactactcaaaagccgggcgcagtggctcacgcatgtaatcccagcactttgaggcaggtggatcacctgaggtcaggagttcaagaccaggctgaccaacatggtgaaactgtctccactaaaaatacaaaattagccaggcgtggtggcatgtgcctgtaatcccagctacttgggaggctgaggcaggaggatgcttgaacctaggaggtggaggttgcagtgagccaagattgcaccattgcactccagcctgggcaacaagagcaaaactccatctcaaaacaaacaaacaaaaaaaacaactactactcaaagaggtaaacttggagaagctcagccaatggaacgagatgaagtgaaggccatgtggcggcagcatgtgccttgacaacaggcatcagagagacagctgcagaaacgctggcccctttcatcgctgatgcggcctcagctccatctggccccactgtcagcccaggagaatgcagctcctaagaagtcttgtttgttttaacttgtctgttattctgtttccactccagttcttgctgcattcaacataaacaatttacccattcagtcatgaggaaaaacgaaaaacacacttgacaaccaaattttgtgttgtcgggagatgattcaatgccagttgctgagacaggggcagaagcaaaggaggcagggagacaagaggaggaagagggactctggagacacttaccaggggaggaccccacgcccgccgctcggaactgccccaggatgaggctctgctcactctctgccagcgccaggaggagttcgtaggcttcgatgcactgctcgctgaaacaaagcacatggggcctcagcccttgcagagaacagcggacaccttcaatgtggcgccggtttctgtgcaggaggcagctcaggtgctgtctcggcctcactctccacacaggcaaggaaaccacccatgaatattcccagggcagggccagtggcttgctctttcatttggcctttttatttttaaacctttaacttggttctggaaaaatacaagagaaacaataaaggtgggagaggcaaatgtgtcgtcccttcagtgaccacctgaaaggaccatgtgattcccttgtggtaggccactccaggtagtcccgctgagccggcaccctggtgtccacacccttgtgctgtcccccatctgcactgtaccagggttggtctgtgtgacagaagtgacagtaggtcatttccaaaattagcttactaaaaaaccctgacttccatcttggtcactctctctcacttcactatcttggaccatcctccccggagcaggccagctgtcgtgtcttcaagattctcaggcagccctatggagaggtccacatggtgagtaatgactaaggcctccagccaacagccaggtgagtgagccttcttagagcagatcctccaatcccccactgaggtctcagatgatacagccctggctgacagcttgaccagaatctcacaagagaccctgaaccagaaccacctactaagccacccccaggttcctgatccttgaaactgtgatgcagtaagtgattagtcatacaacaataggtagctgatataacatcccacaaggagatgattttgacctagacctgcactattcaatatagtatctactagccacaaatagctacttaaattgaaaatattctgagttaaataaaatgaaaaagtccattcctccattgcagtagccatacttcatatgttcaatagccatacatggccagtggttaccatattgggcagtgcatgtagagaacagttccaccatcacagaaaagttctattagattctcataaaactaagtgcttaaaatgtctcatgaaacattcttaggccttcacaaaagctctgacaagagtttgagtttggatttctaggaggaggaaacatagtcactcttctttgtgcccaacattcattgggcaaacaaggtaaaatatcaaacaacagtccctttcctgtagcgtgagacccacgtggcccacgtccacacaagaggaggtggaacatgtgtacagcatcctcagggtcccagataatatgcctgcagtaggaacatttcctctttaagaaagtaactgtctagcttcttcaagctgaacaggggatatgttgcttcatttagtcaacagacaatttcctttgattgcctttcttttttttctttgagacggagtctcgctctgtcgcccaggctggagtgcagtggcacgatctcagctcactgcaagctccgcctcccaggttcacgccattatcctgcctcagcctcccgcctcagcctcctgagtagctgggactacaggcgtccaccaccatgcctggctaacttttttttttgtatttttagtagcgacggggtttcactgtgttagccaggatgatcttgatctcctgacctcgtgatccgcccgcctcggcctcctaaaatgctgggattccaggcgtgagccaccgcgcccagcgtcaattgactttattttcattgtcctttactaagagttaagacaaagggctgaaatgctagccctaggtgataccagctcctcgtttcaaaggcagttcatattccagagatgtgaggacatttccttatccatgaggttgtactaatgtggagaaagacctttctgctcaaaggcagattgtgggtggacagcaaccagcttcaacggttatcacagatggattatctgcttgctttgctgtctgtaaaccagaatgattgctctctagctttggtctcattcattttgctttgataatttcctgaataaacaagaatgtttcttaaacaataccgaactttttagaggatgctaagtgtacgatacagtcaactactctgaggccttggcaaatacacttaagtggtaacactaataaaagaaacctatgatgataataataaggcatagttttgcagctttaaacaagcagtaatttaaaaacagataaatttcaaagtgatgaggcagaaaaaaaaaagtggcccattcaaattaccacttgctcaccaatgagtgaactgtagttatttaaattgacttgttttcatgacaaaaaatcagcagcatgcctgaagaccaggaaaatattcatatcctttgacctacaattcctgctttgggattttatccagaggaaaatattcaaaagaatgaagatcttatctgcattaaattattcatcatagaattatttttaatatcaaaagtctaaatgtcttttagaaaagtgaataaattaacaatataaaaacttgttggaggggttacagccattcagaatagagactattaaaagcaacattttaagactacaacaaaatgaagaactagaatgcactagatttataacaatgtaaattacatatgaacatgaataaagatctgcaagaagaaatgaacatgtaacatgccaaaaaaatcgatattttgagtgatagtacctaaatgaaatgatatttaagatgaatatgctaggagaaatatacctgtttactaacatcatattcattactcttagctatttgctgtccaaaccgccagatatgccttggtccaaactgccagatatgccttctaaaagcctatttcctacttttattctgaaggttactctggatgcacttctaccctgaagtagctccaaacatcccagtgtgtgcctacctgtactgcaaggccagcctcagcgctgtggcattggattcgtattttcccaccagcatgctcatcctctcggcattgcttttacattcctccaaggttatggtcaggaggtcattttgggatttgaggtgctcaatccggctacaaaggaacaaaaatcagattcacactagggttacagttaatttgccaatatttcagttgtctcatttatattcagggcagaaaagcatgtgaggatgtgggcctgtcagattagtagctgacacagtattttgtcaaagaagcaactctacataaaagtatcaccaaactctgtgtgaattacaaataaaaaataagccccctggttaaaaataagccccccagccattgccacactcactccatgtctatcatgagcagggcacagtgctaggctctggagatattccaaggaaaggagacagttgtgcaacctccaggccgccatcatgtggaacgtctggtgggcttagataagtcaccctccacatgcaaggatgaaaagcagcaagacagcagtcatggctatttgttaagcctttgctttagtgattctcctagcagccttttgaattaagtgttgttactcccatttcagatgaggaaatggaggtccagaaacattaagtatcttgccctgggatttgaaccgggaagtgtgaccccaaatcccatcctcataatcacaaactacagagagaaccaaaggaagaatcagtgagtgaacaggaaacttcccctggtggcctttaagtgggaaatggacgaggagctatggattgtacccaaagctgcttttgggttacacagtctagcagctctaactagtggtaggataagcattgggaacttgaagttttacaagattcagaactgtagattcagggcaaatgagtctgtggcaaagttagcaaacaaatgaataatatgatccttcagcttctccgttttccatctcagggtacagatgctcttgatgccacaagtcattttccatggacacatctatttgtagtactctgaccactaactcttaaagagaaagcttcacacaaacaaactgcaagtgacttgaaatgttaaggggtttggaagccattagcttcaaggaaaaatcttagactcaagccttagagcagaatatggagacacttgccaacatgggagacatctggtgagtgtagaagaactaagatcactgccaggctctggccattccaaggtcacttcaaggtaaggtgccacaagaatgcttttctgcccctgttcacattaagacttcttgaaaagagtcaccattctctcacttttcaacttgctccagtctacagtctgtcccggctaattagataaagcctttacccaactcatagacctccatgtagccaagcccatctcagggcccttctcagacaacaccccactgatctgttactctttccttcttaaagagctcccctcacttaagccatggtgggtctctgctggttttcttcctgccctagcggctatttcctctcagtctcctttgctagatgctcattctctataaaattagtaaggcttgccattctcttggggctgtcccggggtcccctctgctatcaacactcccaccctaggggtgatttctatccagtcccatgatgttattaggcaggtatgctccgctggctcacaactttctctagcccagcgctttcttctgagggccaggctcacatatccagctgccttcctgacatttccttttgctgtcacattgccacctctagtttaacattccaaagtgggattcttgatttcccctgaacctcatcctcccttatcttctccatctcagtaaatgccaccaccgtctacccaacactacatgctagaccaagcttgtccaacctgtgggctgcatggggcccaacacaaatttgtaaactttcttgaaacattacgagatatttttgcaatttttttttttttcagttcatcagctgtcatttgtgttagtgtattttatgtttggcccgagacattgctcttcttccagtgtggcccaggaagccaaaagattggacacccctgcactagacccctgaggatcttttttgagaccattcctttctcttattcaagtgcaacccagctgcagtttccactgctttcagcaccacacatggcgtgcgtgaggcccctggccccatcctgccagagctgccctggcataccacaaagattgtgctgcttccactcttatcccatccttcccattctccacacccaggtaagcttccataatgtcaatcagatcttgtttttccacattcgaaaaccctttaatgacttctaattacacttcgaataaagagtaaaatttgtccgtggcatcaaaatccacagctgagccagcccctgctctgccacctcgtctcatgtagcttcttccccttactccatttcagttccgctggcctttggacaattcctctttcaggcctcatggttgttaagtggccataagaatatcagttcgccatatggctgcttttttttttttttcttttaaatccatctcaatgtaagcctcccatcttcagatgcctgccctgactacccaccgaaaaattaaccttctctggggtcccacgcccacggagcttcgctcactgctagcacagcagtctgagatcaaactgcaaggccacagcgaggttgggggacgggcgtccgccactgctgagggttgagtaggtaaacaaagtggctgggaagctcaaactgggtggagcccaccgcagttcaaggagacctgcctgcctctgtagactccaccgctgggggcagggcatagctgaacaaaaggcagcagacaacttctgcagacttaaaagtccctgtctgacagctatgaagagagcagtggttctcccaccatgcagtttgagctctgagaatggatagactgcctcctcaagtgggtccctgacccctgagtagcctaactgggagacacctcccagtaggggccgactgacacctcatacagctgggtgcccctttgatacgaagcttccagaggaaggatcaggcagcaacatctgccgttctgcagtatttgctgttctgcagcctccgctggtgatacccacacaaacagggtctggagtggacctccagcaaactccaacagacctgcagctgagggtcctgactattagaaggaaaactaacaaacagaaaggacatccacaccaaaaccccatctgtacatcaccatcatcaatgaccaaaggtagataaaaccacaaagatggggagaaaccagagcagaaaagctgaaaattctaaaaatcagagtgcctcttctcctccaaaggaagacagctcctcgccagcaatggaacaaagctggacagagaatgactttgatgagttgatagaagaaggcttcagacgatagataataacaaacttctccaagctaaaggaggatgttcgagcccattgcaaagaagctaaaaaccttgaaaaaagattagacaaatggctaactagaataaacagtgtagacaagtccttaaatgacctgaaggagctgaaaaccacggcacaagaactacatgatgcatgcaaaagcttcagtagctgatttgatcaagtggaagaaagcgtatcagggattgaagatcatatgaatgaaatgaagtgagaagagaagtttagagaaaaatgagtaaaaagaaatgaacaaagcctccaagaaataagggactgagaggtgacaaagtgctagcagcccttgcttgctcttggcacctcgtcggcctcggtgtctgctctggccatgctcaaggagcgcttcagcccaccactgcactgtgggggcccctctctggggtggctgaggccagagccagctccctctgcttgatgggaagtgtggagggagaggtgcgtggcactcgtgggccagcacgagttccagctcagcatgggctcaccaggccccgcacttggagcagccggctggtgccactggccctgggcagtgaggggcttagcacccgggccagcagctgtggagggtgcaccgggtaccacagcacttccggcccgctcgcgccacgctcgaattctcactgggcctcagctgcctccccgcggagcagggcttgggacctgcagcctaccatgcccgagcccccctcaccccctgtgggttcccgtgcatcccaagcctccccgatgggtgccgccccctgctctgaggtgcccagtcccatcgaccgcccaagggctgaggagtgtgggtgcatggcacgggactggcgggcagctccgccagcggtcccagcgcaggatccactaggtgaagccagctgggctcttgagtcgggtggggtcttggagaacttttaagtctagctggaggattgtaattgcaccaatcagcactctgtgtctagctcaaggtttgtaaatgcaccagtcagcaccctgtcaaaacagaccaatcacctctctgtaaaacagaccaatcagctctctgtaaaatggaccaatcagcaggatgtgggtgggacgagataagggaataaaagcaggctgcccgagccagcagcagcaacccgctcgggtgcccttccatgctgtggaagctttgttctcttgctcttcacaataaatcttgctgctgctcactctttgggtccgcgccacctttaagagctgtaacactcaacgtgaaggtctgcagcttcactcctgaagccagtgagtccacgataccaccagaaggaaccaacaactccagatgcgccccctttaagagctgtaactcactgtgaaggtctgcagcttcagtcttgaagccagcgagaccacaaacccaccagaaggaagaaactccggacacgtctgaacatcagaaggaacaaactccagacacaccatctttaagaactgtaacactcactgcgagggtccacggcttcattcttgaagtcagcaagaccaagaacccaccaatactggacacaggactatgtgaaaagaccaaatctacatctgattggtggacctgaaagtgatggggagaatggaaccaagctggaaagcactctgcaggatattatccaggagaacgtccccaacctagcaaggcagaccaacattcacattcaggaaatacagagaacaccacaaagatactccttgagaagagcatctccaagacacataattgtcagattcaccaaagttgaaatgaaggaaaaaaatgttaagggcagccacagagaaaggtcgggttacccacaaagggaagcccatcagagtagtagctgatttcttgggagaaactctaaaagccagaagagagtgggggccaatattaaatactcttaaagaaaagcattttcaacccagaatttcatatgcagccaaactaagcttcataagtgaagaataaataaaatcctttacagacgaacaaatgctgagagattttgtcaccaccaggcctgccttacaagagctcctaaaggaagcataaacatggaaaggaacaaccggtaccagccactacaaaaacatgccaaattgtaaagaccatcaaggctaggaagaaactgcatcaactaacaagcaaaataaccagctaacatcataatgacaggatcaaattcacacataatattaaccttaaatgtaaatgggctaaatgtttcaattaaaagacacagactggcaaattggataaagagtcaagacccatgagtgtgctgtattcaagaaacccatctcacgagcagagacacacatgggctcaaaatgaaggcatggaggaagatctaccaagcaaatggaaaacaaaaagaagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagacttagactcccacacaataataatggagactttaacaccctactgtcaacattagacagatcaatgagacagaaagttaacaaggatatccaggaattgaactcagctgtccaccaagcagaccaaacaggcatctacagaactctccaccccaaatcaacagaatatacattcttctcagcaccacatcacacttattccaaaattgaccgtgtagttagaaggaaagcactcctcagcaaatggaaaagaatagaaattataacaaactgtctctcagaacacagtgcaatcaaactagaactcaggattaagaaactcactcaaaactgcataactacatggaaactgaacaacctgctcctgaatgactactgggtacataatgaaatgaaggcagaaataaagatgttctttgaaaccaatgagaacaaagacaaaacatacaagaatctctgggacacatttaaagcagtgtgtagagggaaacttatagcactaaatgcctacaagagaaagcaggaaagatctaaaatcgacaccctaacatcacaattaaaagaattagaaaatcaagagccaacacattcaaaagctagcagaaggcaagaaaaaactaagatcagagcagaactgaaggaaagagagacacaaaaaacccttcaaaaaatcaatgaatccaggagctggttttttgaaaggatcaacaaaattgatagaccgctagcaagactaataaagaagaaaagagatgaatcaaatagacgcaataaaaaataataaaggggatatcaccactgatcccacaaaaatacaaactaccatcagagaataccataaacacctctacacaaataaactagaaaatctagaagaaacagataaattcctggacacatacaccttcccaacactaaaccgggaaggagttgaatccctgaataggccaataacaggttctgaaattgaggcaataattaatagcctatcaaccaaaagaagtccaggaccagacagattcacagccgaattctaccagaggtacaaggagaagctggtatcattccttctgaaactgttccaatcaatagaaaaagagggaatcctccctcattcattttatgaggccagcatcatcctgataccaaaaactggcagagacacaacaacaaaaaaagagaattccagaccaatatccctgatgaacattgatgcaaagacctcaataaaatactggcaaaccaaatccagcagcacatcaaaaagcttatccaccatgatcaagtgggcttcatccctgggatgcaaggctggttcaacatatgcaaatcaataaacgttaatccatcatataaatagaaccaaagacaaaaaccacacgattatctcaatagatgcagaaaaggcctttgacaacattcaacagctcttcatgctaaaaactctcaataatctaggtattgatgggacgtatctcaaaataataagagctatctatgacaaacccacagccaatatcatactgaatgggcacaaactggaagcattccctttgaaaactggcacaagacagggatgccctctctcaccactcctattcaacacagtgttggaagttctggccagggcaatgaggcaggagaaagaaataaagggtattcaattaggaaaagaggaagtcaaactgtccctgtttgcagatgacatgattgtatatttagaaatccccatcacctcagcccaaaatctccttaagctgataagcaacttcagaaaagtctcaggatacaaaatcaacctgcaaaaatcacaagcattcctgtacaccaataacagacaaacagagagccaaatcatgagtggactcccattcacaactgattcaaagagaataaaatacctaggaatccaacttacaagggatgtgaaggacctcttcaaggagaactacaaaccactgctcaacgaaatagaagaaacaaacaaatggaagaacattccatgctcatggataggaagaatcaatattgtgaaaatggccatactgcccaaggcaatttatagattcaatgccatccccatcaagctatcaatgacattcttcacagaattggaaaaaaactactttaaagttcatatggaaccaaaaaagagcccacattgctaagacaatcctaagccaaaagaacaaagctggaggcatcatgctacctgacttcaaactatactacaaggccacagtaaccaaaacagcatggtactggtaccagaacagagatatagaccaatggaacagaatagagccctcagaaataataccgcacatctacaaccatctgatctttgacaaacctgccaaaaacaagaaatggggaaaggattccctagttaataaatggtgctgggaaaactggctagccatatgtagaaagctgaaactggatcccttccttacaccttaaacaaaaattaattcaagatggattaaagatttaaatgttagacctaaaaccgtaaaacctctagaagaaaacctaggcaataccattcaggacataggcatgggcaaggacttcatgactaaaacaccaaaagcaatggcaccaaaggcaaaatagacaaatgggatctaattaaactaaagagcttctgcacagcaaaagaaactgccatcagagtgaacaggcaacctacagaatgggagaacatttttacaatctacccatctgacaaagggctaatatccagaatctataaacaaacaaatttacaagacaaaatcaaacaaccccatcaaaaagtgggtgaaggatatgaacagacacttctcaaaagaagacatttatgcagccaacagacacatgaaaaaatgctcagcatcactggccatcagagaaatgcaaatcaaaaccacaatgagataccatctcacaccagttagaatggcaatcattaaaaagtcaggaaacaacaggtgctggaaaggatgtggagaaacaggaacacttttacactgttggtgggactgtaaactagttcaaccattgtggaagacagtgtggtgattcctcaaggatctagaactagaaataccatttgacccagccatcccattactgagcatatgcctaaaggattataaattatgctgctataaagacacatgcacatgtatgtttattatggcactattcacaatagcaaagacttggaaccaacccaaatgtccatcaatgatagactgcattaagaaaatgtggcacacatacaccatggaatactactcagccataaaaaaggatgagttcatgtcctctgtagggacatggatgaagctggaaaccatcattctcagcaaactatcacaaggacagaaaaccaaacaccacatgttctcactcataggtgggaattgaacaatgagaacacctggacacacggtgtggaacatcacacaccggggcctgtcgtggggtggagggagcggggagggatagcattaggagatatacctaatgtaaatgatgagttgatgggtgcagcacaccaacatggcacatgtatacctatgtaaaaaacctgcacgttgtgcacatataccctagaacttaaagtataattaacaacaacaacaaaaaaaaaaaagaaaagaaaaaagaaaaatcacccctcccagagcttctgttggtgtcctatttatttccttcttggatctttcttatcatcttatttgttttctctttggtctattttccctaacagaatataagctccatgagagcagggaccctttctgttttactttgctttgcatgccacatagcctagcatatagcagatgcttaacacagatttgctaaagaaggaaaacattttggtgggtagggatgaccccccctcccctgccaatcatgaagttaaaggctaacatactttgagagtaataggcctccaactttgaggtagttagaatagcagacatcaggatatactggtagcttatttctaagaacccccaggttcccgcagcagctaggatcacagagatgacaatggaggtgaggtcaaagggtaagggttggaattctgtctcagctacttaatagctctggatttaaggcaagtcactcaacttgggacttcaaagcctttgttttctcatttgcaaaacaggactactctaccctcacaagctgaggattaagtggctgtctgcgagagccctttgtaagctgttaaacaccataataacatcagctaccagcaaaatatttcccccttctttggtctctcctgggtgtatataacggagtagaaagcaactgccctattcaaggtcagccacagatccaacttgttaaagcccagaatctgtagagaggagatcctcactaaatcgaggtccccctgaaggcatctgacttcattaaattgcaaagggcatatctgattcaatttttaagcactcccagggcagtgatactgaaaagactgcttctttactgccactaagtaatcaccaggattatcactcttaagtattctggatttaataaggaaaccatttaatttcaagatttaaaatgacctagattgccaatttaccttagttctcaagaactgtattaaacagcttcaatcaggcaggactaacatgataattcaatttattctggtttgccatacacaagaggaatggaattaagcaacagcggatggggaacggtatccctatttcttcctggttagctcataagtctttcaaattcttacaatgctctcccactaaagattggtaggtcaaggcagccacaccacactcggatgtgactcaacagtccattctgccactgcagaaccaattctgaggccaagtggtttccatggttttgccctggtcattctcctttgctttgttagcaactccctcatcactggcatgacacataagagagtctttgccaacaggcaaaagggcaaactgaaactacctcttttgtaagacttgaaaagaatccataaaatggggtatatggtaaaattactctaggtaggacagttaggataggatgtagggatccaagactgagcacatttgcgaagaacataaataaaactaggcaaccatcaggaagatgatctaaatcagcatgcctggtcgatgccaggaatggctctaccagattgcctgtgctgtttccagtagctccaagtgcctctaggatgctgactcaacattccagaactcccttctgtggttctctgcagcacaggcctgcatgcttggcagccacctgtgacctacttgccattctgtagggactgctcccaggactcactatgtaatttgcaaggtccagtgtgaaacgaaaaagtggggtccgttgtttaacaatattaagaatttaaaacgttgacagcagagcagtgaagcaagtatggcacctttctaagcataaggcccatgtgaatgccaggtcacagccatgatggcagctcagactgctgtgagcactcctctgatgaccaaggtggtaggaacttccatccccaccagcctgacggtactgctctatgtcacaatacataagccaccttgaacagatctttggaaagagaagtgaggagtagcacctcctccctgccccacaatcaaatcgatacgatctctcctcacctattcagccgttctgtttccacctcaaactctctaatcttgctttctgagatggcagatccgtgtgagtagagtgtttggaaaatctcttggatattggagcagtcctgaagtgagtgggccaggtgttcagccacactgctggatacctgcaaaaagaagcattaattcccctttggaacatatcatttcagagatgcatgttttgcatgcaaaagaatttaaagctgatattccgtgagaatcggggactgggaggatggttaccctgaaggttctcagtttgtaggatagaatcctagtatgaaaagctaactattaaatactataaaagcagtagaaaaaaaaaaccaggatcaaaatatggctccttccccaagcacgtggtgctgggcagccaggatggggagatcatgccttcttggagttccttaaattctgaatgtggaacagagtcaggatttctttcccctatcctgaattccctgccactccaggccactgtttttggtttctgtagcccaggagaggggctgactccttcattttcacaatttggctttggcacagaatctgaatgcatgcatttttgctcagtgtaaaattctaaattagggccttaaaatgctattcaggctctctctgcctctgaggatcaaatagctggctctctaagcctcatccccaatcctaaaagatcccttaaagaaatgaaactactccttttcaccatccatcagctcttacagtcccagggggtttccagactccacaaatgaaaactctggaactaaagtgaaggttctggtctttcccaccactgggctaggcttcaaagacaacattcctcctcagtggaaagcacatcccctttcaagatggatgtgcaaaagacaaagttattttagagctcttggtctctggggtagcagggtgatataagacagatacttcaagactttcatctatatcaccaagaactggacctaaatcatttgtttctgaatggtttcaaggaaaggaaaaaaaatctcccttaaagctgaagaagtaattcaccatatggatggaaatcatcatacattttaatttaatcctttggaaggaaatcaggtatgatttactattataactaactggtttattggagatagactttggaagttcttctgtcatctataatccattgtctgtgtagctctgccgggtactttcttgccttgcttctcatgaacactcacccctatgctactgatttctgagcccaggactggccgatcagatgatgacgattcggaccttgtctttgatagcttcaccctctcagcaatcttaaaaaagaaaacaaaacattatagaaaactacacaccactcctcagataaactgttgggactacgcttatacagggctactttttagccatgtcaactaaatgattaaagaacttaagaacagctcacgtccaatttttctaccaccagcttaagccagggcctttcaacttcagcactgctgatattttggcttggataattctttttatgggggtctgtcctgtgcattgtaggacatttgtcagcatctctggcctctagccacaagatgccagtagcactccaattgtgaccatcaaaaatgtctctagacattgccaaatgtcccctggaggatgaaatcacttctggttagaaaacactggtttaacctaacttattaaacttgatagttaagaatcaaccttattgtggtggctagcagagctaccaggcaagccaacaggcataattttaatcatctgagacagactcaacataggtactggggggctgtggcagtgagtcagtggggctacttctcacagctgccacagcctgtccatcataatctatttttctttttttgtggcagagctgtcagtcttgtgagtggggagatcattggttcattactcaaggtccctgactgggctgaaccttagtctttgagagcaactctgtccactgtgaagtactggagcacttgacaaaacgtctcactctccataatgacttgtcagctgtgacattctccagctggctgattaatgagagctggcgtccaggttgcagctgagagagacttaaaactattagtgggttatctctccttgcagctcctgcatagaaggcctgcgtaaggtcccaggggaagccccttgtgctgtctcagctaagggcatgcctgtacagtggctaggatgagcctggtgcttccagataacaggaggtgttcccgctcatcgggtccatccccaggaactcaccttggcgatgggaatgtcattgctgctgctgcttgtgctcagctccccagtgctggggttaatcgggcggttggtggaagtgaggcggccagggctggagggacctgtggcctgcacgctctgtagtcgagtttgaagctctctgacctgaaatcataatgcttttagacatagttggtggtttccctggctaaagagcaaaacagccagatgggtaggtggtggggctttcatttacattgagggatcagcccactgaaaagctaggttggttgagtccacataaaagtcattatattccttttttcggactaataatttttttttaatgaatcggtttcttaaatcacatgtaatacaaaaagtagagttataaaccaaagtgatgatattactagtttttatatttgcctaagagtcaccatattcttaacggaatctgccacagaccatcacctattcttcacaagcatgaggtgaacatattatgtaaggccctggaagcttccaggatggatgaccatctttttttatttttatttttttgagacagggtcttgctctgctgcccaggctggaatgcagtggtgcaaccatggctcactgcagccttaatctcctgggctcaagggatcctcctgcctcagcctcctgagcagctgggactaggtgcacacaccacacctggctaatttttaaattcctttgtaaagatagagtctcgctatgttgccagggctcgtcttgaactcctgcactcaagcgattctcccacctcagcctcccaaagtgctgggattaccggcatgagccactgtgccaagccactggataactacctttaaggaatgtttattctttcagccccacttgcctgactgtgctggggactgcggacgaggacccaggatgatatcacctctcatggaatcatcatttcagagcccagaggagacaggaatgatttcaagacaagtgcacttgagtgttataaatttctatgtcaagtgttacgggaagcagaaaaagggaagaatataactccagctgaagtcatccagagaaagctgaatgaagacagtggtacttgagcaatcttaaaggagaacaagtgaggagatggctttagtggtgatatgcctggggggttgaacaggtgctaggatgatatgctatgtttgaagaggtgcaagttattcaatatgtgtgttttagcagaagtgtctgtattggggaaaatattaggctaagagaagagacattgatggagccagcaccttttccccaagttacctacagatgagattttccctggaatagtaggtaggaacgtctaaatagtccttctatataaaaaagaaacacgggaccctctaagttacatttaaaacgtgcatttacctgcacagaaattaaatgtccaaatcctgctcctctatagttacaactctgtgacttccaaagagagaagtattccaagtagctgaagagagttgctagagattggtcttttataaccttggtcgcagtttcagcatgagagtgcagtgtctacctgaaagagcaaactaactacaacacccagcggtccttacaaatggacatcagactttgtcgggctgggaagagttagcactaggaaatttaagacagggctttctaaacagaatgtgtactagaatcccccagagggcttgctaaaacagattccagggccctaccccagggattctgatttagcagggtctggatgaagcccaagatctgcatgtctagtaagctcgcaaaagatgctgatgctgccggtcggggaccataccttgaatagcactcacctaagggacttccaaggccacaaagcactttaatcccatagacaggaagagtggagccatgccccggtgccagccctgccgccaaaagtcttctagacagggcagagaacaggcaggcacatggccccttctctaaaaggcactggaaagcttttcatattaaatgtctaggatgtctccatcctgctaacttgggaaccaaaagtaattgaaatttcaataattcatcaacatattagaagctaaaataggaaaattccctcaaagcaaattgcattcaatagtgcaacagctcaaaagtgcctaatgctctgccacggttccagtaacggaggatcgatggaaacgcttgctgtcctcaaaacagaccagacacagggctaaactcaaaatagcctaaagaataggaaaatatatccctgtagaagccaaatggtactgctgatgaaggattacaggactcgttctgaaatggtccctcacaaaccaaaaatgggtacaggggtggatacctcattatgccacaaagagagactgggcaaagagagagggctcattcatttcctcagggactgggggaaacctcccggtggagacttgcaacctccggtgaattcaacctcccggtgaatttcagtttttactgctgatgagtctgataaggtcctgaataattaacaatgttaacaccactccaaaacctaaatggtgtctgaattgcactcaagacaatcagtggtctgttcttagaatccctactggcctactcatctttttttttttttttatatctctatttaaaaaaaaatacagataaaaaaaatcctgggcaatttataaagacttcattaaaactatccatgttttaaaaacatttcttcttctaatcacaaaagtaaaacatgctcactgtggaaaatgtagatgacactaaaacataaaaacagtcaaagtgcttatgttctttcttactctacagaggcaatttactctaatcattttccttgctgtgtatgtgcacacatgtgcttaaaataatttctaaatctaaatatctactttcactttaaaaacttcggacccagagaatgtctttaaaaactaaagatgataaacatgtttattttgggctatgctttattatttaatgatagttgctagccagtggaaacaaacccagctgaagggagtgcagtgtgcctgtcagggaaagaaagacagctggttaagtggccttctcccccttcttttgatttgagagtgagaatcttaatttacaggaataaatgcaagaaactaaggctaaagccaatatgctgagtcagcttaggcatggcttcggaaagaggcagaaacatagttaatagagttctcacttttattctcacccattgtagtgggttggattatgtctcccccaaaagatatgtccaaatttgaatcctcagtacccgtgaatgtgaccgcatctcaaaatagggtctttgtagatataactaaattaacgatctcaaggcaagataatctgatttgggtgggccctatgtgcaatgactggtgttcttttaacagaaaaggaagggatatttaagacaaagacagagagacacagggaagaaggtcctgtgaagatgaaagcagagattggacacaagtcaaagagcaccaagagctatcagaagttcgaagaggcaaggaaggattctctttcaaagccctttgagggagtgtggctctgctaacaccttgagtttggactcctagactccagaactatgagagtttgtagtaatccaaatactccttcttcattgaagacttatttttttgagacacggtctcactatgttgtgttgcccaagctggcctcaatctcatgggctcaagagattttcccgttttagcctcccaagtggctgggactacaggggcatgccactgcacacggctatttttattgaaggaattatgtttctctctacaaaatatatattttggagtcaagagatagccaagaaccagggctaacctgaggcagggactgacacttgcgggaacatcattcagcacccttcacagcctttctcaactggggttcctcaacaccagaacatgacctgagaggctgttttttcacttctcctgaagttactgcgtgtctggtaaacattatgatgggaaacatgctctgaaagaggggtatcaacaaggagtgtcaaagtgcagaagaagaaacctggctggcctctgccttcctagagcaggcaacgctagaactcaatcttgaaggctgaactgttcaacaagcaaataaagaggaaaagataatggggagactctggaaggttcaagtagggaaatgacattaaaaggttgcagttgttaccctctggtatttcttcaagggttttgtaaaaatcatttgattagaggagaaaatggactgaagtaaggaagaaaaagttggtgagccaagagctctactgatggttcagataggaaattatgagggctcaaatacagtcagcgaagtgggaataaggatggcaaaatacactctagaccagtactatccaacagaacttcctgtacagacggaaatgttctagagtggcactatctgctatggtagcctggtgccacacgtggctgtaagcacttgcaatgtgcctggtgtactcaaggaactgaatttttaattgtattgtattttactttatttaaattcaaatctaaatggttgtatgtggctagtagctactgtacccatcagtgcagttctaaaaatattcaaggaggtgaaaaaacaaacaaaacacccaaacttgtagctggggtgattcagtggatcatggagttacttagcaatgagaaagaaaaacataaagagaagctgatcttttcggaaagaaatgaccagagctgacaatgtccggagctgacaatgatatcagctttggacatgctgaatttgagaaaacaactgggtatgtaagagagggcttatcagtcaacaattagagatgtaagtctgaaggaaagcaattagaactggatagatagatttaggaatgctgggcatggataaggtccaggaaggaggtgtggcagtgtggtgggcagagtgcctgtgtggagctggcaggagtggagggtcagtggaggacagggagatggggacacctttttctcggggagaaaaggaaaggaggtgaggacgggcaataacaaacgtgatttgcagactgtcaggggaagatgcgaaacagggactcccatctgatggcttctattttctctgctaggcatgaggggggaatgtcagaaatgagaaaggaggctgacctaggaccaaaaaagaaaaaaaaaaaggaagcttacacagcagcactgacagctcagttgagctctctttgaagacagtagactgaagaacacattgttttcttccaactctagagacctcaataaataatagtacaaaataaaaaaggattaaaaccacaacggagataagaatgtgcctggggcattggccgaaacaaaatttggacacgttcctcaacggccaagtgaaaagaagagcactgatgaaagacacagaataaaaaaagtctataatgtatacaaagagaggcagccagtctacccagaaggacgatggcagactctaattcagctttggcagagagcaggaaggacaagaatgagaacagaggctttcagaggttaacagaggttgcagctatgtaactgtacacaacaattgaaacttcccggcatatgacagcttcagctaaagtcaacaggtgctcctattaaaaatgcatagaaatcctgcattaaaaaaggaacaatgagaaataaattcattgccaaggtcaaaagacagcaaaatctccagatgccagaaatgagaaagaaggctgaaggagttgccaggaggtggtgccaccgcaagcccaggggctgtgagcagggcacagaatgagagcgtgggagggaggagatggagggcgcctgctagtctagctgcttgagctgatccctctgcctcacgcctggagcctctctgctcgacccataggtgaaaagctgaaagtgctgtccacagaaggaatcctgaggctgtgcagcggagtcaaccttcagaaaccaaaaccccagaccagtggcacctttgggtgtgaggtccaaatttatactatctgcatactgtgggactccaaacttgacatgaacactggaaactggtttggattttgccaggccacccactgcctcagaaactgcctaatttgtaaatcgcccagtatcaagagagaacaggagacttaggcttcccatgactgggagcccaggtccacaaagctgccagacacagagtgaggacaactacagagagcaaaagataaaacaagagagccagcagtctgaatcaggagctgaattcaccctaggggaaatgaaaataaagcaactggtaaaccacatcacaataggtacactgaggaaccttaaagagataaggggaataatttccttaagattaagaaataatgaaacaaaaatagacaccaaatcttaaaagccttcttgtggggctaggcacggtggctttggtggtaatcccaacactttgggaggccaaggtgggaaggttgcttgaccccaggagtttgagaccagcctgggcaatagcgcaagaccctgtctctacaacaacaacaacaacgaatcagccaggagtggtgcgtgagccagtagtcccagctactcaggaggctgaggtgggaggattgcttgagcctggcaggtcaaggccatggtgggctaggaggatcacaccactggactccagcctgggtgatgcaatgagactcagacacacacacacacacacaccacacaaacacacacacacacactgccttctcatgggatagaggcatctcaggttctgtgggtctgtgggtgttgttctgtttcattcactactgcattgccaacaccttcaacagggactgacacagtctcaataaaatctattgaatgccactaaaaaacctatcaccttaaaatctaatgcctacttagaatattgtggtaggctgaatgatggcccccaaaggcatccacgccctaaaccccgagaaatgtaaatgtagccttgtacggcaaaagggaactgagatgggtagagtatcatggatcatctaggtggactcagaagtcacaagacccctctaagagggaagcaggagtgccagagttagagctctgaagatgctatgctgctggcttgggagatgaaggaaggggcatactcaaaggatgcaggctccctctagatgctggaagcgacaaggaagtatattctcccctccagcctccagagagatgcagccttgccgacactttcattttagtgaatgagatgcattttggacttctgaccccctaggactgtaagatgataaatttgtgttgtcttaagtcactaagttcatgataatttgttacagcagccacaggagattacacagctattatcaagagtgtgggcaaaaataaagaccctctcaaagattaagaatctatcacctatagatctttgctgaaagaatttcctaagaatacatgattttcagtaccaaagaaaattaaacctgagaaaaagaatgagatgaaagaaacaatgaaagtacaagagctgacactgacgtaggtggtgaaatactcctttgctgctgttgggcggatgggctggccagatttcccaaaagctgccctggggtacttggtcaaagcaagactatacacactctgagactcagcagtttcactcctggacatgtgatcctgagtaattcccaccaggccggaggagacatgtgcaagggactatgccccggagcattgtttgtggtcatgggaaatgggaagcaatttgattgtcagctgctgtaaatgcaataggtgggtcactatagaatgctagatgtccttagacacacaggaccagatgtacacacagccatatggacaaaccttaaaatcagagtgctgaggagaaaaacataagagaaggcgacagcagagtaacatttaaataaattaaaagtaatgcaaaacactatcttaggacatgcacaaaatggggggaaggggatgggatattatatgggataaattatttgcaaggaataaattaaaagagggaccagtgaatgtgactagtgaatataattatcttctctctctgtcctgagtgccaaattacaacaaaagccaggcatggtggtgcgcacctgtagtcccagctactcaggcagcttgctatgcaggaggatcgcttagcttagaattcaagggtcgagcgcactgtgattacacctgtcaatagccactgcattccagcctgggcaacatagccagatcccatatctatcttatctatctatctgttgatctctctctctctctctctctcaatcaatccaaaagaaagtaaatgatgcaagccaggagcataagggattaggcagagtgggaaagtgagatgttggggggatttggccctagagctgtcaaacacaaagagtgtgcacagaagcaggtttccaaagtggtaggaaattccttggaaacgtgaggctaggcaagtatgagacaggtcagctatgcggatgcttcaatctctgagtacaattgtgggagcacagacaagagtcagctgatgaagtcatctgtgaatgtggctcacagatgagtgacaagcaggaaggcaaggtggcaccagagtcctgagcaggatcagaaacatttttattagccataaaagaaagagcctgttctgctgatgatacgtagcagtactcactgggtagttgtaatttcaggcaattaggctgtaattcataatttcactgtgtaatggagctggttgagatgagatgattcccacactatagaatggtgagaatcactaggctgggaaagttctacttaatgagcttcatgcagttagtccctgtgtagtttttggaaagctgctatctcgaagtccagggtttgtagatattttgccgagaaccacacctcttattggagattttatatgatttttcttagagccctcaaataatcagaatctatttacagcaaatatttatttctttctataaatcaaatttacatggtgtttcaggatagtggtattttattgttaatggcaattttgactagatggaaacagaagagagagatcacaaaatagaaggagaaaacatccaacagcatttccatctctcggtaagtttgatatgtgtgctattttctcttttgttttatagcccactaaagtacctggatgtgttataaaaatggttgcattggaaaaggccagcattttggcaatcttccttttttttttttttttgagacagaatctcacacgttgcctaggctggtgtgcagtggcgcgatcacggcttgctgcaacctctgcctcccgggttcaagcgattttcctgcctcagcctcccaagcagctagaattacaggcgcccaccaccacgcctggctaattttttgtatttttagtagagacggggtttcactatgttggccaggctggtctcgaactcctgaccttgtgacccacccgcctcagcctcccaaagtgctgggattacaggcatgagccaccgctcccggccaatgttcctaatttcttaccagctttttgacaaattgagtcagcttctttcatgacagccaagagctagccttgaagcagcctggcctcctcataggcacatgaggctggggtgagtaagcaaatactggtgcccacagcaggagttgcctcacaatctccgtggctcaagtgtgtgtaaggccctcatgaagtaactgggagctgtgtccatggaagaggtcaaagaaccagggttctggggattctctgccttggattccccctaaaactccctcagtctacagagaggaggggaacacaacactggactcaggtcaaggtaaaagcatgcataccaccagcttcctattttctgcaacaagctcagtgtgccttcatgtagcattagaatgccaggagagtgggtctgtgaaaccctaaggaatctggcccccatgttgctgtaacagaggacattttacccactgttggtctgcatgggagtggggctaggatgaggacaagggtggacagaaggctacaggaaagtggtctaaacaagagaacaatgacaactgcctcccctaataaggccaccagatcccaaattttggtaccaagagttaacatcaacgtagacttgggcaagattgttaaagcttttgtaggcctctgttttcccatctctaaaaagggtataataatagtacctatcagctaggattctggagcagattaaacaaaatgtgcataaatcatcacccatcacaaataagtgtttgaaatatgttctgggctattatcataatttaggttttcaaaattatttatttttagagacagggccttgctattattacccaggttggagtacaatggtgtgatcacagctcactgcagacttgatcacctgggctcaagccattttcccacctcagcccccgagtagctgggactatgggtgcacaccatcacacttggctaattaaaaaaaaaaaaattttttttttggtagaacagaggtcttgctatgttacccaggctggtgatttaggctttgagtaagtcccgctttgcctttagaggtatctgattttaatctggggggtgtctagtctgagaggagttcagtctgcaaatattcacagaatgtcaatactatcaatattattaacagagcctttcttaaaaataagccctactgagcttgcactggtaagtggctccctgtggaagtgatttccttcatggggtgagctgggggacttggcactgggccaggcagtgcctccatgccttgggagccccggggtgcctgtaccctggtggactccaccctccctccacttctagctcagatgaccctggtgaagggacagtgcagggcaggctccacatagcaggcagcttccctagcagatgccgggcttatcactgctacatggtgggcccaggaggagcaggctgggcatgaggagaaggcagaaagcctgtagctctttctctcagttcacctgcagaggggaagtagaggacacttggagaagctcttggcccatgtccagtgggtgaccaaaggacactgcctctcccttccttgtctccaagtgctgaccacaatcataatgtgggggagtgtgccagggtgctacaccccatttactgactctggctcatggaaaggcctgggcacacatcctctcaaagagcttcccagtgattctgacacacacgtgtggggtcaccacaagatggatgagtgaaactgcctgtttctctgcaactctgattcacggccaagcccggctggtatcatagtcaaagcatgtaaatcagctgcatcagaaacttgtactgttgaatatccacatgttcctaagcccctttatggttaggtaaagccatctgcctagttctggtcaacaggcagggcgcagaagcatttaaatgctgtggtgggagcctttgagtgggctcttaggtggtggatggccaacagtctgagtttctgagtgaatgtatggatcagagacgtgcacctgtcccctaacctgcactgaatatatggtgcaggcaagaaacaacgtgccatgccactgagatttggggagtgaacctgttattgcagaaaaatctagcctcatactgactaatataccagccatacaaaagaagagccacctgagcctcccatgtggaaggagcacactgaagccagacctggctcctctcagctccctcccatgcagctagatgacagctggggagagctgagaggagcggtgttgagacaggacttggttttacagaacttttatgaatttaaactcagctaatattggcatcctcttccttatcctgaaaagaaattcccatgaagaaatggaacaaataagaaatgaacaaagttccataaaggacaaaaaagaagactcagcttatatgtgaatatcaaaccattaaaagctgtgagatacagatcattctccataatccatacttttttgtttttgcttaatttgaaaattaaagaggacaaagaagaaaaaaagcaatcgcatacttccactgcccagatttaacctgttaatattttagcatatcagtgttctatttctatgtatatacttctgcatattaaaaattatacaatgatatgaatacattcattaaaaacataaattagaacattatagagaagtttaaggtccctttgaggccaatacaacatattaccattatgatgttggtttatatttttctggtctattttcaatatttttatatacatacatatgaatatctatgaaatggaaatttatacagctataaattcataataaatataaagtactattttgcagtctgcattttctctatatagccctgtctcaagaaaagcaacaccaaggggaggtagagtgggaccagctcagacgggactatggccaaatgaggctaaaagagatgtgagggaaaacatagatgtctctttatttaacctctgtaagatcacaacacttacacttccaggctggtctcaaactcctgggctcaagcaatcctcctgcctcggcctcccagagtgctagaagtataaacgtgagccaccgcacctggccgagggtgacttttatttggttcaaaatagcatgtctacttgtctcttgaatttactgtggcaatgaaaccagaagccagacccccaggatgagagaggcccaggagagacagatggaactcattccaagacatgcagaaaatacccaggtagagcacagtgtgtaaagaagaaattgttaacaccttatgacatgaacatgcagaagaattctgtaaatctgaagaatttctagaaaatctcagaaggaacttatgtggccgatttgtgttcaagtctatggttcagcgggacacagtttcatgtgcctgtggtcatatcaagtttgctttgccaaacacattggggaaagcgctgattatttttgccacatcatggctgacttaaacaatgtagctaaaaaaatgggaacaatgtggagaaagtggttcctgccatcacacgactctctggggagctctcagggcactctctgtgtttacctgtccccaccacttgacataaaccttgcaatgatctgtttacttgcctgtctctccaacatccttgaagccagggactgtgtcctgttcatcactgtaacccctctgtctggcacagagatgaccaatcacgtttgtgaaatgaatgaatgaagaataaagtaattcctttacagagtaattctcccttgcctacattaagcccaattctttatgtgtgaggaaatacatggttatatcacagagcaaacagaaataaatgattgcctcattcagtaatgaactaggaccaataataaaattgcctgttgctccttaggtactgctctgccactagcccaatttgttaactgactacattaaagatctaatttaattaaatcttgaacaaagctcagaagacctacagagagcactttgcttaattacaggcacggttcaagcaccaatcctattgatctggtcggttaaaattctatacaatgaatgtgggcaaagaaaaaaagaaaaagaaagtggccccaattgctcgtcaaggaactttgatgaactatggattcagagctgctacaaagacagcaaaggcaaaccagccttgtactctgtactgtcacagggtaaaaataaaatggtacctcagtcactctgcagagctacacatcgtcaagaacagaagacaatgacaaccacgaaggacagatccctcctgagggaaataaagcacactaggtgggtgggtgagtgacggctggaagaagacttttggcacttaaagtctagtaaacaggcattcaaatgcatctagtacactttttgagatctacactcatcttgaaataaaaagcaataaatccaattcatggtatgtatataaattcctgagaatatctctagttgaggaagagataaaagttaacattatttgaaggtaactgaaataaaaattatacaaaactatactagttgcacaaacttataaaaggtaacagatgtgactggaagaaaggctttgactaaaatgtgtctatgtgtgcaggcctgtatgtgtgtgtgtgtaattatccaatgtccatgttggagttcttcaaacatctaaggattcctatttaaaaaaatgacaggatggtgttcaactttccgtatcactcgacaggtaactatatattttactccaaagaactactactaattttttgagcatttactacgtgccagacatcgcctaaccactttacgagtattatctaatttttgctttgggtgctattattgtcccacttcgtggcagagtaaactgaggcacagagaggttaggcaacctgccaaagactcgtggtgacttggcaggtcaggctgtgcatgacccaggcaatctggctccagagccctggtacctagtgtagtgcctccgcactgtgctattcttaatactgacctccagagttggagaaaacactggaaagtggggaaggggactttttattttttgctagtccaccatgaagggctggcaagtgagagaagaaaattcattctaaaccacaatatgtaattacaccaaagaccaacaatttccctcacaaaacatgcaccatcagaatgcacacactaagagcaagtacatacctaattaggacatcagtgataatcatcggggagtgtaacccaggaaattacaggtggcgtgggctttagtgctaagcaaatttcatcatgctgcccagataaagcctttgctgactgggatgatttacacctgctgatgcaactatggagactgtcatccgatatagctgcatactgaaaatatgcttatgcacgtgagttaagacaaaatgatgttcagatatgagaggtagtagtgccagccttttaattatgacattagcacaaatgaagaagagttgataacattcaaaaatagtaatttcttccatatttttcaaatgaggaagagttgataacattcaaaaatagtaatttcttccgttttatataatggcaactaagaatacttacaaatggattaaaaacaaaatgatgtacacatcctgagctcgttgaagcatagaagagcaagttatttacaaggtcttttttatggctaagggagcaagagcaatggtgaaggatgatgagacccactagatgtatttttcccttttttttttttttttttttttttggacatggagtctccttctgtcgcccaggctggagtgcagtggtgcgatcttggcccactgcaacccccgcctcccgggttcaagcgattctcctgcctcagcctctcaagtagctgggactacaggcacacagcaccatgtctggctaatttttgtacttctagtggagacgggggtttcatcatattggccaggctggtcttgaactcctgaccttgtgatctgcctgcctcggcctcccaaagtgctcggattacaggcgtgagccactgtgcctggccagtatttttccccttctaagtcaactttatctgtgtacaaaattagcagtcagagcacaactagaaaacaagcttctaatattgccaagaccaagaaagagagtcaagtaagtctagtaattcaaagtgaagttctgagggaagtgtttgattgaggaattcattgcttcacccccagtccaatcacagatcaaactcacagccaaacacagaagtgcttgtgggttcctgggattaaaaacttcaccttggaaaaactgaggctttaacaattctgccgaacatttctatcctgaaacattagctccttcagtaatggatacatgtcctaaacaaaatgatactcaaactaggtcaggccctagggtgaatagcaggagtcacacatacacatctgtaaacacagagacacacacataacatgcacacttaaacagatgcacatacacacatacatatatgcacacaatgtacaagatatggctattttaacttcagtaagtctgcaccaggagagacgacattctatactagattcagtataagcaaatgagagcaggtacaataaagctaaataaaattttatagaaaaaaattaaaaaggtaaaattccatttttttttttcaaattctaaagactattagtttatcctaaagaacattttaattgagcttagaaaagatgtgcttaccctggaaagtttagaatcactgccccgatgtaattttatcaaccagtcagatttaagattccagagaaaagtgtttgctttttttttttaaatcttacctctataccttagcaatttcgaactactttcaagaaggacttcataacaggaaagagacagtgattcccaaaattacaaatgccacaaaattctcacggtgcccctggtgctatacaccagcctctctcagccccatgcccaggaagggcctgaccattatggatgcagcatgctcaccctcctccggagccggtcccgctcttcccggatggcattcatggtggccttagtccggttcagttcttcctctttgctgcacagcatggcagtcaggctctcattctcttccctcagcccagccagctccttctcccaccgagacctctcttcagccaggttgggatacaggtcccggccaagcaccccctcaatctcctcgactgtctgtaaaacacagccccaaagaaaagtcaagtaagttaccttggagaaaggggataggaagaaaataggctgaacaggaataaatgtccatagaggagtgtgttctagaaccactttgttataaatagtgatcatgactacagacaccccaaagttatcctgtctccaatttcagatgaggctctgtcacttgcctggggtacagtctgtgttacctggcaaccttcagagtaagaaaaacagtgagtcctctcctggcagctgagtctgtctgtggtgctagctgacacatccacacaatgcttatttccttcacttgagttccagagttggtggatacacacaaccaggcagaaggccatttagtgatcctggtaatgtgaggacaaacatgaggttgtaaactgcatacaaaatctaacttgaagtttcctaaattataggcctcccacatgccaactcagcgataagataggtcacattaccatttccagcttttagtgccacatccaaattcagatggtgcaaatgaggttcagtctcaagatgtgaaagacaaaaataaacctcattgacacagaaaagaggaagctcattgtggagatttctaagacagcagggattaaattaataatacagcttcaaaatttaaaggaaaatcttagtagcacatagttttaaaaaattcatttaaaaacatttaatgaagaagaaacatgcatattagggaaaaaaggaagaagtcattctgcttactcttataaactgttcattcacatttactgtcctttgaaaaaggaagcacaagccagtggataatgaaacaagagggagaattactatgaagaggtagaaggcagtgaagagatggaataagaaacagaagactggccgggtgcagtggctcacgcctgtaatcccagcacttgggaggcccaggcgggtggatcacctgaggtcaggagttcaagaccagcctgacctcaggtgaaaccctgtctctactaaaaatacaaaatttagccgggcgtggtggcgcccgcctgtaatcccagctacttgggaggctgaggcaggagaatcgcttgaatctgggaggtggaggttgcagtgagctgagatcatgccactgcactccagcctgggcgacagagcaagactccgtctaaaaaaaaataataaaaataataaaaagaataaagaaaagaaaagaaacagaacgcctccaatactaaaaaacataagggtacatcactcttggatgctcatgttggttctcaaatcttgctgccacttttcccatgtgctgctttgtccttcctttaaatctggagactctcatcctacttggctctgctccagaccctgtggctttgtccctagctggttggtagaggcccttggcctcctccttccctctcaactccgaggttggggctagacccaagttgacattacaatcaaatatagggcccaggagattccagagaaagaaacaccagcaattgcttctccctgccctgaactacatcaactacatatttgcaattgagatgaagaaagatggaaaaccagcagtgttacaaacatgcatcgtggtttaccttgtgacaccacagttcttttgtgcaatccaggattcctacttatagaaacttgggcctgcattttctctttatgggctcctcctagacttttaaatttgaattgctatgcccaggtcactaagttacgttgaaggaatataaagataccagaggcctagtatcagtaagccttgactttcccatcattcacaatgagtttgtgcagatgcaacaaattcctgtcaccatctcaaacagcaagaggaattgatgaatggactcctgaaatcgtattctagaggccttagagctttaacaaaacttccaagctaaacttacagcttacgagtggctctatgatgaaccactctaaaatgacgtggttcaatactagcagtcgaatggtttccaagtaaattgtcctttttaccgcaaagccagtgaacctgactgctgacatcatgactttttctgaaataaatcagcccaaccaaaatttctagagcccccgcttctacaccgtggctcaatctattgtatggctctcatggaaacattcatccctagtaagtatttaagaaaactgcacttcaagagaaggattggaccatttccctttcagaacctcaaagggcctcacagagggtgaggaaggtctaccttaatagccaggtcacagtgctcgctggctgtggtgagctgctcaatgtgcttgtccacctcggccacggagaggctgcagctgctcttcttcctgccgcagacaacattctccagccctgtcagcaccctctgcagttctgagttcaggtcactgcagttgtctgtgagtgaatgaagacaaaatgcgttacacagggcaacaaatgctgtctgttttgcttaccatgagggactcattcaggtaatgggatggcaatggagcctgacatttcaaagttcaacaccagccagcctaacctcacaggcactgcctctgagacttggagccaatgcaaagctctttttattaaagagtttcagatgatggtcattttctgaattctcttgtctttcactcaaagcagccacatcttgagtttctttagtaagaacaaagaaatgcccagaagaggctgttggcacttccagagcctctggtcaacctgtctgctgtcattcagacaagcactaactgcagaaagatcccataactttactaaatgtaacaaaaagtctcagaatgagcagagatgctaggtattttgaaaaacagaaactgtgtaagagatagtccttgccctcaatgagcctaaaaccaagaacttttccatgatagaaccaatcaatatgctccactgttgcaatttaatccatgttctttcatcagggggaaaaataaactgttctaacaaattccttattgttctccacataaggcaaccaattctaataatttgattttgacttaaaaacttgggttgctttgaaccgctggacatccagggcctggtcagagaaataaaaaataattataatgtgattcagatatatcttagaagacaattttgttgggaagaaaactccccttaaagtcaaatacaaattttgtaacctgctgttttggattctgtctatcgccatgccattcaattattgttgcagggcagatgctgactgattatatgtaatctttcagagtacattcttcacctacgtccagcctaaccctgcatgaaaattgctcagtgtcttccattttcttcttctctcctgcatgcttctcaccacaggttccatgtactaaaatggttaactgcttttgggacttacctttggaagacttcaagaaaactcttggcacaacaggaacaggacttctcagaatgttttagtcaacctcatctggttgcctctatttgtaaattacctaaatctagagagatcagcctaaggctttcactccaaccaatacacacaactagtctacctacttctcaaacctgttcctccccgatctctcccatctccatgaatggcacccctatccacccagttactcaggtgagctctgaggcaaccttctatgcctttgtctgacatactaaatccaattcatcttgtgaccacaacctccaaaacttatcctcaaactgacctcttattaccatctctactgacaccatcctgctctaaaccatcatcatctctcaactggaccactgtaacaatctcctgcctctactctccacgcggtcaccaaagtgggcctcctaaaagcgcaaatcagaacaagttattttcctagttcaaactgtctaatggcttcccatcaacattcatataaagtcccaactccttaccagagcctgtaaaactctgcatgatcaagactgatgtgctcagttcaggctgcaccatgtccctggggagcttttataaactacggatgcccaggccccaccccagaccaattaaatcacaatctctgggggttgggcttgcacaatggcaactttaggttcctcaggtaattctaacgtgcagtcagagtgagaaccactgatctgatcttgcctcacccatccaccttcccctgttcactatgccccattcacactccttcccctcattcactatgccccattcacactccttcccctcattcactatgccccattcacactccttcccctcattcactatgccccattcacactccttcccctcattcactatgccccattcacactccttcccctcattcactatgccccattcacactccttcccctcattcactatgccccattcacactccttcccctcattcactatgccccattcacactccttcccctcattcactatgccccattcacactccttcccctcattcactatgctccattcacactcctggccttcttttttccccctggaatatgccaaactcctgtctgctccacaggttcctttcctttgctgtttcctttgtctaggctgattttttaaaattttaattaaaaaaaaaatacaacctttttagagacagggtcttgctctgttgcataggctggagtacaatcctgtggagtacaggcaggggtacaatcctagctcactaaagctttaaactcttgggttcaacctatcgtcccacctcagcctcccaagatgctgggactacaggtacacatgaccacaatcagctcatatttttatttttgtgtagacacagggtctatgttgcctgtctcaaacttttggccataagcaatcctcctgccacaggcttccaaagtcctgagataattgacatgagccaccatgcctggccaaccaaatttctacatattgttcagctctcagctcaaatgctatctccccaacaagctcttccctatctaaagcatggagtttcacctcctcccttacccattccctatcttcttatcctatttttttcatggcaattatcactatctgatctgacttacatgtttgttttctctcctctactaaacgtaagttccaggaaagaagggactttgatcttcctcatcatttgtatctccaacagagaatagggtaggcggtcaaatattattttttaaataggcaaagagaaacaccacatcatcatttatttaatagacaggaaggctataaacagactcaatagtagcatgtttttcttttttttttttcttttttttttttttgagatggagtctcgctctgtctcccaggctggagtgcagtggtgcagtctcagctcactgcaacctccacctcccgggttcaagtgattctcctatctcagcctcccgagtagcttggattacaggcgtgtgccaccacacctagctaatttttatatttttagtggagacggggtttcaccatgttggccaggctagtctcgaactcctgacctcagtgcttttgttccttgttgtggacctcgacctgagctgctaagaactaggatgctcatcactgcagaggccctttggagatggaggcaggtggacaccaactggaggcaaaggacccaagtgaggagaagaacaactcagagaccacaccaaccagcctctgaatgaccacgtaccctctggtgcaggtctcctggtatccagagctggtgtgaatccgctgtcctgagttatgtgcattaagtgctcatgagtgagatattcatgaaatattcagacattctgtgctgacttccctagcgcaggtccacctgatgcaataatgacaatggacatgtctgctgaggggctctcacagcagagccggagtggtggcaacaggctgcttcctgagggtgctgggttacagggagcaggaagaggggctaggcatgtgactagtatttccttctcatacttaaattgggcagttgccgagccctgactcaggccagagcagagtgcaaagatgaataagagactgaccttaactgtgagagacccccagaagtacaaggccactgccccacctctctgctgcccaccactactgtaaggaaagtaaccatagaggccaggcgcagtggctcactcctgtaatcacagcactttgggaggccgaggtgggtggatcacctgagatcaggagttcaagactggcctggccaatattgtgaaaccctgtctctactaaaaatataaaaattagccaggtgtggtggcgcacacctgtaatggaggctgaggcaggagaatcacttgaacccaggaggtggaggttgcaatgagctgagattgcactccagtctaggcaacagagcaagacgcaacactctatcttaaaaaaaaaaaaaaaaaaaaaaaaaaaaaagaaaggaaagtggccaggtgtggtggctcatgcctataatcccagcactttgggaggctgaggcgggcagatcacgaggtcaggagtttgagaccagcctgaccaacatagtgaaaccctgtctctactaaaaatacaaacattagcagggcatagtggtgcgggcctgtaatcccagctactcaggaggctgaggcaggagaatcgcttgaatccggcaggtggaggttgcagggagctgagatcgagccattgcactccagcctgggcaagagagcgagactccatttcaaaaaaaaaaaaaaaaaagggaagtaaccatagataacacagtgcagacacaaggcagagagctggcaagatgtgaggtcatttacactgatgcacagactctgaagaatatctacccttcaaaccaatgagggctacacatactttctttggtcataggaagctgaatgtataaaaacacaggtgaggtgatgaaccccacaaactccagtttgtgctgcagaactctgcactgtggcttcacacaggcccatcagtgaccagttggcacttgactgtccattgctatttttccctgtttggagcctcacaggaggacgaggagactgggccgcctggagcaggtattctgtgtcccctctcaaggtactacgtcaaggtaccaagcacttatcaccactcaccgccagcatccacatggctccagacagaactgtctttcagagtctgtggcataaggtgccacagtaggtcctaagtataggagtagagttgctggatcatatggtaattctatgtttaacaaaaacaatgaaaagcagtgactcaaataattgtaccccgatgttcatagcagcattattcacagtagccaaaaggtggaagtagcccaggggtatactgacagatgaaggaacaaaatgtggtctctgaatacaatgtaatgttattcagccttaaaaaagaaataaaattcttttacatgctacaacatgaaccctgaaaacattatactaattagaataaatcagacacaacatgacaaatatttccactaatacaaggtatctagaagacgcaaatgcagagacaggagataaagtttaccggggtgggggtgatgcgagaatagggagttattgcttaacgggtacagagtttatgttggcatgaaaatgtcctggaaatgggtggtggtgatggtcacactaactctgtgaatgccactgaactgtacacttagaaatgattaccatggtaaatttcatgtttgttaccacaataaatataataaatgtatatcagtgagtaaaatgaggagatataagcaaataggctgatatgaaacagaaaacggtaaccttcaagaatggcagcacattcagaaaggatttgaagtattgtaatttaattaaaaaaaattttcccctgtgggttggagagcaagagaaggaagaaagagatatgggaagtctaaggacaagggggagtaatgtactctttagaaaaaccctggcccccactgccatgcaactccatgaagggcagctgaggcaggcccactggctttctccctcagcctctgctgtactttatttttttattttaaaaatcttttttttttctccagagacaggatctcattacattgcccaggctaggaacgaactcctgggctcaatcaatccgcccacctcagctccccaagtagctggggttacaggcgtgagctacctgtgctgtgctttatgcatcaaaggaaactgttctacatccaggagacagagaggaggcctttggtagcaaatacacattcctttaagtttatctgtactgtgcccctttctaaagaagaatttgaggttgcttatcacaagcagccacaaataaggggaaaacacggtgactggatcagggaaaggctgggagcaaacggaggctgacacagcagagggctgactcctccagctagccttgagcatcctggcatcctcagcaaatatgaattatctcctgacagaaaggaggaagcattccggtttcacaagggagacaaggtgtttttggcaacagacgctagaaggatttaggtacacggtacttcatacgtggtgtgaagtgatgtgatgccagtctcctcagccagtttcacacatatgtggatttcatatggtttcttcttatgttaaccttcagttaaaattaaagttgtagaccatttaaagcacaaggtaaagggaactctggggagtgctaagttcacgtaatcttggcactcagtcttcaaagctgtctgataagactgaacaggacccagaagactggatggaatggacctctccctttggccagcagatgcaaaccagccacctgcagccaaagatgtgcttgcatatgggatagggctatggtgtctggcatggccttttttttatttttaaaacagtttttgagttaactgtcaacattttaaaaattgttaaaatttatggctatccttgtaaaatgagaagatctggcaatgcggggcccagcttctcaaccacagccatgtgcagaggggccagccgcagaccccaggactcagcacgcccaacccacagtgctcctctgctctgcccgcctccacccaagtccatggctcctcctgcccttttcctcttttctaaatgcaattttcctcagttggcctcctgataagagctcaataatacacagctcaggttatatttttctaaggagaaccagagccttaggtttttatgttgctgtttggggaaagatccacatatggcaggtcctcaaataacattttgttcaacatcgtctcattataacatagacgaggagggaaacaggtattcccagctggggccactgtctgtgtggagtttgtacattgtcccctccccatggctgtgtggtttatctttgggtattccagtttcccctacaccccaaagctcagcacgttaggttcattggtgtatctaaacagtcccagtcagagagagacagagacagagacaatgaatgtgtgtgccctgcgatgggatggcacctggccggggtgggttcccatccagcaccctgagctcctgggataggcctcagctacctgcgacactgacctggaataaggggttaaataattatctcccttatttttattaatctgccttaaatgtacatatagttcaagtttattcccacatttaatattagaagtgctttgggtctctatttagaaattcactaacgtttcagtgaccacaaatacactacaggaacttaactcttcattatatcaattaaccataaaactggtatcgttacacgtcatttcatttaaagttgcattttccaggaacctatcaacgacgttgaggacttactatactttggaaatctggaaaggaggtaagaggacattcatggctgtgaaaactaagaatcctaatgagccttctggcttagttaaacacacaccagtggacaaagctggttttcttctttcttactcaggatcagctatgcctatgcccagagctgacaccattaactacggcagagttggttcattttgaatcaggtgttaaaagttgcttttttaaacaaacaagccctgtaaaaatcctaactcaaataaagggcagctccaacaggtgagatgttacaaacatctcccctggtccacctgattccaaccaagcagtcccctctttaccagaatgactttgctccaaagtatggtcccagcttccaaaagcacgtgttcctggggatcggtacttgcttcacactagtggttaggtatttgcctagtttggaagccttccatgctgggtctttattaagctttgcctttgatagggcttgggtttgtgtccctacccaaaaaccatcctgaattgtaatcgccaatgttggaggaggggcttgttgggaggtgactggatcatgggggcagacttctcccatgttgttctcatgatagtgagttctcatgagacctggttgtttaaaagtgtgtagcacctcccctttctctctttttcctccttctctggccatgtaagatgtgcttgcttccccttcaccttctgccgtaattgtaagtttcctgaggcctccccagtcatgcttccggtacagcctgtggaactgtgaatcaattaaacctcttttttaaataaattacccaatctcaggtagttctttatagcagtgtgaaaacggactaatacagccttgaaatctcattttccaggaagccttcccagccctttggcactcagccctaaaagttgatgatttcattcattcaacagtgtgtttccagagactcacagtgctgggcatgtcccagagacttacagtgctgggcatggaacatgtgctctacaaacactggatgagattaacatgtaaaataaatggaagactttttataagccaactttttaaagtcccaagtttttgttaatttacttgttaatccagtgtcaaatttaaaacctatcaaatgacattatcacagcctgctaatagggcagaaagctttcaattaagattcccaaggtagaaagctgtcagtgaagttagagacataagtcacagagaattttagccaggctaagaaacagaagcagctgtaggcctgctacgatgtgggctatagcaggactggccattcaccatatccctgccaccttctgagggccagcgcacaccacccacccttcttttctgactgggcacacaccatgcctggtaaagcaattcaaagtgggagaaagacctacagattctttcagcctcaacacagactttctgtaaaggcaagatgttatatcccagggatgtaatagttcagatctcgttgtagctctacggctgaaaccaggagggctgttgctttcttttgagcattcctctgtactctgcatacagcaaggccctctttaattccatcgaggaacaaacacaaaccgaacaaagtaacatagaaaattagaaaacagaatagtcaacttttagggttgaacaccaaagagaagactgaagggtctgggaggaagggagaaagagtatccacagaggttaccccttgctttgtgtcccatgttgcctctgtctacctaagacaagaggacttatgagaacaatgttgtggtagtttaaaaactcctcagtatcacctataatggacaaactgacattaggaacctcccgctgcaacatggtaatgaggaccataacccacatatgttcttgcaaaaaaaaaaaaaaaaaaagctaacctcaagtcttgtaagaaaacaatcagatcatcagattgagggacattctatgataccactaacctgataacactaacctgacgtcctcaaaatggcaatgtcacaagagacaaaacagcaggagggaggatctgttctagattaaaggagagtcaaaagacatgaaaactaaatataatgtgtgagccttgactggatctgggactaaacaaaagcaaccaaagacattaataggacaattggggaaatttgaatatggattgtggactgtcaatgcttcatcagtggtaaaattctcaggtgtgatgaaggtactgtgtttattataggagaaggttccttcttaaaaggtttacacatatgcctttagggggtgaagcatcatggcatctgcaacttttaaatggcttagaaaaaaacgtatacacaaacacaaatgggagcaagagagagaaaaaaatcaaaatgtggcgaaatgttaacaattggttgattaagatgagtggtttatggaggtttgttttaccttttctgtaagtttgaagatttttaaaataaaaagttgagaaaacacatacttcaacattctaggcaagaaggtctcacaaggtctggatatgctgcagtggagatttaacacggagagcgcaagatgactgattctcagtgcagccaccagaactggagagctctcctgtaagtgtgtcttccacatccaaatgatcaccaagtacacaggcacaagttgacagggacaggaggcagagaaattctaggcagaaaagggcaaggtccctggcgaagccccaccctgaagcctataaccatggcccaaagtgagaacatgcaaccttttttccccactgaaatgctgccttttcaaaaatcacccatggcctaccccgccccccatcctatacccataaaaactctgaccccactggcagagagcagagaagggaagaagaggagaagcagctggatgtcagaaactgtggtttgatgtcagagagcagcagcttgacttcagagcgatggcttgacaccgttgcttcggagaggagtctggctggggacagccagaatccaggggaagattaccttcccgttccatcccccttctagctccccttcctgctgagagccacttttattggcaataaaatcctctgtattcaccacccttcaattcttcatacgacctgatttttcctggatgccaaacaagagtttgggtgccatgggcgcagatgctaaagggtgccacactgaccctctgccttcagtggtggagagcaactgcctcacatgaaaaggcagagggcccactgagctgcttaacacttaagctgtccacgaacagcaaagcaaaaagagcactgtaacacatgccctctggggctttgggggtcacagatcctcccccctgagacgctactgtggggccatcacggagttttgctcctgctggtgctcaaaagcacttgttccggcccctgcacacactcacctgtgtgctcctcctcccttgaggggttgagagctgcagcctgagtaagcgaggcacccctgtcacgaggcctgagaaggggtcaagaaaaatttcctatttcaaagtcagggtgggtgacctgagaagcgaaagacgccaccccaccacattctgactatagatctctgtttcttttctcaaagcaatcgaggctgcattttcaggacttctattttagtaaaatcttaccagctggggatttgttttcattttcactgttgtcactttagatttctgacacaatttgtttctgtgaaacaacaaacttggtcataaatatgaagggataaggaagataacctaacatcaactccagggagctgtcctccaggactgcgagcctctactgaccttggtgcccatctaggatcccctgctctgctctgttacgcacccccacataactcctagtcatccacctccagcctcggtggcagaaaagttccgtcagtggtttctgccagaacttttctgccagaaaagttctgtttcacacatatgtgaaaagaagttcaaatctacgtataatcattttacttatttgactattgatcacctgaattggcacagctttaaaataagaatgatacccagttttgaagaggatgagaggaaatctttggggtagagaagggacagcaactgacaatatacaagaaaagacttaatcattcaatacctttgagaagtaatcttgaagaaatagttacaagtatgtttagaggataaattccaaccccttcactgtgcctccatggctctctgtcatcactgaccacagcccagctctcaggcctcacttctgcccactctcccccaggctcactaacctccagtccaaatggccctttcttagtgcctgggtcacctgcggcagctccagatcccctttagataggctgtctcctgcccttgacagcaaacagtggatcctccattagcactcatcccaggccctgtgaccctcatgctaacaggagtgagaggatttccacgccaccaggaggagggggaagatgtggttctggcatccatatgtgatctgcaaaatattttctcatagcagcaatgttcacaatgatggctggggatgcggtaacaacactagcaaggtcccgaagttatttccatgacagattacacaggctttccaaggctggtttcaggagctaacactcctttattataatgctggttttaagaaaaattatgtcatgaatttcaaataaccaaaaccaaatcaaccttaaaagacatggtctatttagaaaataaagactgtttatgctattaatagaagagaagttcatgaatcccaagaattgtgggagctcattttgagtaaatgctgtagattaatgcctttccatttccatcttataccccaagtctcttttggggactgaaaagttatggaacagcagaatttggggaaaatattccaaagtaacacaaactgaagtagaacaataacctttcctgctctcaaccctggttactctaaggaagattctggaatgacttcagggggttctcctcagtcacttagctctgctaccatttgcagacaggtcttatttgaccaggctcagatccctaggagaaaacacacagtcaccccagagagtgctccagtgaatcaatgttcaaactgttaactggttctcagggatgatccctattgtgaccctctccagagaaattaagttgcccacataaagaaaagaaaaaggtaacaaagggcttggcctgttacatgaactagttagagtacaactttcagtccggtctaaccctttcagtctgtggactagaggatcactgactatctagccacctcattcctagcaaaaagtgagtattctccagacagcttgccttacctgtgtaaacacatttctccaggtctgcaaaaactgtttttggcagaggcagggctgcctttccctgccccgaccctctctcctcactctgagtggctgcttgacacttgtaaacattttttcctgaagccattaagcctcatcagccagtaagccaggagaatctggctttagcatcaaacatatttcacagtcacaaccgcaccaaaaaaccaggtttcatgtggaaattcttccttggttgtcctccaaaacctattcacacagaggaaaaatctaagtgatcacaccagaaagcaaggtattctatgcataggacaccttgcgggtataagagtagatttcaaccctaagggtataaacctcaaccctcagggtataatggtttgatatttcaaccttgagggtataatagtttgatattgctaaattccagaaaaataaaaatttctcacccaaaatcagaagagatctcaaaataacagaatgcttcactggctgtgcaaaggcccataccatcagggattttgtttgttttggaaacagttgctccagaaaagcactgctgttgcgttaacagaggtggggaaaatggtccacaggaaaggacagcaaacatgctgtaacatgcaggatgcaatgagtctgtgtgcacacatctgtgctctgctctattgcaatacccagaatcattgggtccaagagtgttgtttctattttaatatgaagggccgcaaaatctgattgcaaatgcttcactattaagccaggtgcttgtgatcacacagctgctccctaattcccccatcagccctagagacctcaaaggactgcagtaagcaaatgacatcaaccactggcatgtcttcctgtttaaaccgaggagtatcaaaggaaagccatctatagaaacacaggcggcaacaacaaaaacaacttcttggctgtgtggccttggacaagtgacttaccctctccaaacttcattatcctgattttacagatgaagagacctccagggcatccttccaggttggggattaaacatgagggatgcatgtaaatgcttgacacagggtaagtgagcaaagcatgttagttggtatacccaccctctcttttaacggcgagcctttgccagatggaggacataaaaattctaagcaataactcctaccttggctttgtccacttaattacctttattttctgaacaatgtgtgacgaggtttgataagaggtaatttttttaaaaaaaacatgcagtgtgacagaggctggcacctttctcctttatttgactgcttagtaagtcaaagcactttttaattggatcgtttattcctccaggcttggaagacagtgtccaggaaccagcctactgaaggggcagctggactctgatgggtggttatgaaaacaaaagaaaagtgctttttgatgaagctgataggctggacttagtcctgttatctttggagatcggcaaatacactgcagcaaattctgcagctcaagaaaacctctgggttgctaatgcaggtttgcaaatatagcaactataatgaaatggctacttttaaatgatttcctataatggtgcttacatatggaagcttttttcctgttgaaaaaatttaattggaaaatggcgaaggaataagaagagggagacagccagttccgatgaacaaacacactgacggcactgtgtgagcagctttaatgaactcctccttgttgtgcccaagtgtttgtcctcctgggggatctggcagagctgcccctgcccggtgcaccctcctcctcatgggctccgaccccactcagttcccagattcctgctcggctgtgacctctggcaagcattcttccatgctcctccccgaggttatcaccagggccactgcaggcctgctatggagtcctaactgcactgtgaggtcttccctgtggacctgtctgcatcctccaaacaactgtgagctttgggatggggttctttcactgctgctcaagtatttgagtatctcctacgtgcaggaactgctatgctggtaaattaggcaggtgaagtccctgcccgcgtggagcctgcactctggcatgacagccagataaagcttgataacacacaaggaaatgagcacaaacacaatccatcctcagggagtgctccatgttatgaaagaaaatgaagcagggaaagggaagcaagtggctgcctgagagtgagggatgaggcatgactctagaggggagggcggggggccttggtggagacagctgccgaggaaggagggctccaggcggaaggaacagccagcacagagccccgggcaggagaagcagctcaggctggaggaacagcaagccaggaggccagagtggctgcagctggaagaaaaacaggacaaatggccaaggaggcggccagaagcagggaccgccctgttggctgcgtgctgaggaagctagaagtcactctaggcttgaaggatttgagggtgggagcacaatgacctgacagcagattctgtctttcatccccagtacctagcacagccccaagtgagtttgctgactaaatgaaaaaaaaaaagcttctatgtgtgggcagagaacatgtgtcaacactgggcagggaaggtcactcccctccaggaactcagtcttctcaggaaagaggctaccaccagttataattaacccatgtatttttaaatgagggacggaatgaaaagaatggtttgggaaaatgaggatgccccatggcgcagataggtggacactgccttctgtgtgaggaccagtgcaacagacgccacctcaagtcaggaggtccaagaagccccacaggaaagacatccatgtaaatgtgtttatccttgcacttcccaaacttatttaattatggaactttgttggagtacaggtcatttattaattccataaaatacaatttgagagaagtgaatggcgggatcagtatagggctcacattctacaatgataagcaatttctaggctgtttaaatctgtctggctaaggcagaagacagagtcctgaagcttggggctgccagggttagagatttatgatgcccttatgaacttagcatgttggtatgaacttagcatgctggtatgaacttggcatatgcatggtctggttgcagggagttgtgtgtattgtaacataaagcccggggactgggttcagtttagttgggggaagtgtcttcactcctcaacataattctgcctggcttaagctgtaccaacatacagctctcaatggctttgatgtattttatttggccttagatgcaatccagactactgatcgctccttccttattagagcctcctctgccccactggcttccagaataccactctcctcattttattccttcatctttggctggctgactggtggattggtttattacctcattcattcattcccactactatctttaaacacatgttatgtgccaggccctgtgataatctctgaagatatactaggagatgaaacaaacatgcttccgcctagtggaatttagtgggagaatcagtcaagcaaataaatactattacataatttaaaatgtcaacgtgatagtaagatacaaatggggcaatgacagagtcaacagttatcatctgcaaacaccctgatgtctcccagctgcttttcttcagcccaggtctctcctcttggtgttttatctgaatgcctactgccttctgaagcacctccgctcaaatacttcaagacactataaacccatgggcaaacaaaacacgatctccacctatcatatagttcctgccccaagcaaaacaaaactcaaagcaaaaccacctggtcctacttcctatgtgccctattggcgaatggccctgttatccatctgttgtacaaacaaactcttatggggcatacacaccccccaccttcaatcggtttccaatccttcagcaaatcttgccaattttacatctttattaaatctcagctgccaccaccctaatctgagcaacaattttgcccatctagagttctgcaatagtttccaagctagcctccccaactcattcttcatctatggattctttctccacactacagtgattgattcaaaatgcaaatctgattatctcattctcttcccccactattaaaaaatctttcagtagcttcttgtggatctttgggtaaaggccaaacatggtctctgtcatggcctgtaagactctgcatggcctagttcctgcctacctctccagtccccctctcacacctctgtgtcctccatccatgaggatcttcagtcacctccttaaatgcattcctctccctcactggatgctattctcttccttgacctgcttaattcctactgatcctccagctctgaggtcaaacgccttcctagaggaagccttcttgtaaccctagactgaatcaaatttctttggatacactctcatagtactgtgttccataatgttgtagcacttataggattttaattaaacccaaatatgtaatatttgattaaaatccctctccccaacaaaattttaacttccaagaaaaactcattataaaactcaagaaaactgactatatgcaactcttctttctcctggttcttcttccatctctcccatacatgtaaacatgtctgtcctaagatatgctgctcctccctcttttgactccacacccttcaaccacagggatcaccttagctcagataacttcaaagcctcttccctcaacctcgatctctttccaaatatccaggtaggcaagaccagtagttttgtaacattttgactgcaacccagttagaacattcatttggcaacttactgcctacaaggatgcaagaaacaaatttcatgaaacaatactgtcacttgctttcctattagccttcatttaaaaatactttttcatgtaatttcaagacccaacagtaggtcacaccctgcagtttaaaatacatcataccagatatttacacatggatatttctctacaacctcaaacataatatgactatttcccaactcacttctcaacacaacttcctaaggaatatatgatcattctcttagtcacttaggaacaacacattggagtcattttggattcctccttcttgcccaatccaagtagttgttaaaacctattgggattcttccactgcaatgtgttggcccccatcccatcccttcccttcccaccatcatagttcagatattactgtaatttggaatactgcaatagccttttaaactggttccctacttccagaattttcaaatagaagtgacttatgtttgaatcacaattgtatcagagcagaaagcttcagttccattttgaccaacaaagtaatgtgtaagggactgaaatacatgtgacttcatccactcagcaaaccccttgaaaaattaaattttaattcaggctgcctcacatttctaaaatttctattacaatccagaaaccaaactctggcttggtggcaagggcaggcagactcacccatgtcagcagtaaccatggtagactggttttcggggatagagacagaggtctggtcttggtccatgcttcgagagtcctcgttgacctcgtgttggctctggctgagttctgatcgcagttctgagtactcatcttcctccctgagaaaaaaggagaattggcaaccactaacagaggatataagacaaccccctagagaatatgtcttttaaggacaagaaaaagacattgagagagaaaacagatttctcccccaggccacagggaccaggatttctcccaggcgaaatagatagtcacatctatgctcagtgagtgaagctgaaaggttgcctctgtgtccacaaaacatacccatgtaccaaacgagattcatctatcagcctgcagaaactcttcccctttaaagattcctgaagaaactagatttcttcgcctcctcaaattccgaggagaataagaactaaggctactagcactgaggctgctgtgaaccaaataactaagagtctagcgcacagcaacagcatgccctacaatctggaggggcccacaggggcttccttcttgaaggaggctggaggttggagatggggttagagctattgggaaaccagcacctcatctgtgcagatcaaactagacttttttgaaaggtatatggatcagcatgtataagaaagactaggctaacttcccaaagaaagtaggtagaactagggggtaggaagagaggatgcaatgaggagaaaacagaacactgaatgagagaacaccattcaatggtctatttcctttaatttacacttgctaacaggaagacaacatttaaaccccactgtgttttatttgtatacacacatctacctcttctcagcccttcagaggtccctcaacctctggtctcttcactgtactattagcaagctgagaaacttagaattgcagtgtgtatttcagagcacgtgtactgtccccttcccacaccaccaccatcaccacacatacactggacacaggtatggagacagcaaaatgaaccgtctttgaaggatctattttgcaagtgaaccagtagggggaactgtcaggggatttaactgggagtggaatgcccacttgggtctgctcagcttcaagggcaggttgtctgtgaagaaagctaggaatcagagaaatctcagcctggcattcattttaagttgtcaacaaccagaggagaagaaagtctacagtgttggattctgggtggaccaaaatgatgagtggcgatcattagggtttagggaggcaagcgggagacacatctataaatcagagaaatgtgaagaacagaaatcttggttctcttaagatatcaaatttctcccaggaaagggattcagctgagcccgtgctttataaggtattgttaataaaacctacccagaaaactgggaaagctttatgtagatataaagccccatgacatggaaaatatgaattagagagtggtgaagacaaaaaatacaggctaatgttctatgaataagttaattattagacatctgcaaaagtcaacaataattaggtttaggaaagaaaatgattaaaaagcactcttaagtgcctttttggtctacaggatgattgtgcactgatagatacattagctctcctttcagtcagcacttaaaattctgattttagttaagggagattttgtgtatgatgaataaattacctttgttgcatggccaacgtaatcagctttggctcagccgagacttttttgcagccaagaaagcaagtgataaatgctgctgctgtttctttggtataaatggcatttgtaaaatctttaatagccaccttaaacctggcttggcagattcgaaaacatatatttcctgccaaatctcctgctttgtacaaaattacttctagagattactaggatgaactttataaagcagtgaattgggaaagtatgggaaagggaagctgttattgcagaaacattccctactgaggtcagagcacagtctgaaggagaaccataccacattaagcagtaggttttctgtgtcacaaaatgcaaactaaaaattcccattcaatgtatttgagcaccaaaacaaagataggaacacaaagactgcacagattctgtcttcaaggagacaaagatgttcacaagaaggatgctgtgggtgaacactggtggaatatctggggctgccagtggggagtgaccaaagaagacctcctgggtggagcagcgctcaagatcagttaggacctaatttcagttacgtcacaagtgtggaatagcacaggcaaaggctcagaggagctgggaacgtgcagaacttggaggggagcaagtggttcactatgactgaaaccaaaatatggcacaggatggaaacatgaggctggagaggcactcatactacttgttgactaggcagtgtgagcaaaaggaaaatatattgcaccggaggatgcaaataatcagggttagatggaagaaataaaaatacaatgtggaaagtctaggaattcagaggaaggagtaaatgttgccaagatcttgtgtggaaacagataaaatgagaagaagagaaatgcattccagctatggtaatcattataagtattctagaacaaaaacgacacatggcaacaaagtaaatagtcatcagaggtggaaagctaccttgcgagaacagggaagattttgtgccacaaagagtgaggtataaaaatgttaaactgagcttaaatattagaaagttcatgcaccctgttgtgtctcccactgactttggtaaaaaaatcatggagctgcatatccttatctctcattggcatcattcctgaaagggggctggaacctgggaccgggaaatgacaaaagcaattctcagagggtcctctgtaaactaactcgatttatgattgcagtatgcgtggcagactgcatcaggagtattgttccatcaagagctatggagtaagtaaaaaacaccaagagtccctggcagttttataaagacaagattttgagttgtgcttctgcagtggctctgcacagcctagaggatgcctggtgaggctaatgacacagcacaacagcatctcaagatgacttctgtttgttgtatatacaggcattcttctcaagcaataacttatttctttggggaaaaaatgcctcccaaaaaaacaccaactgctattgctggtgatgaagaagaggaaaatgtaaaaacatggaaaaaaagtgtccatttaaaaccagaaaaatagcacctctgataaactgataaatgttgaaagtgacactctgtagtggtaggtttataataatggaatgacaaagttctcaggtgtttctccttggaacataaagggtcaactcacaggattccaaatgcatattctttcattcatgtagaagcatctgcgaagtgcttccaagttgctttaagagatgcaaccattaatgtttgctcctagcttaaacaacaacataacaaatgttcctcaggagacaggcattagattgtacacttgcctatgtaatgaccagcagtggcagaaaaatcacaggctggcagactggaagggattttaaagactgttttagccaggaccactacctttattttacaaacaagataaatggggcttcgagaggcaacttacctaagattatgcaaccactagcacagcctaattcctaaatttcataccaatgagacaatatgtacttgacctttgaacaacatgtatttgagctgcatgaatccatttatatgcaaattttctttccataaatatatttgacaattttctggaaatttgtgacaacttgaaaaaaactcagatgaatcgtatagcctagaaatacaaaaacaaactttttttaaggtatgtcataaatgcatgaaatatatacattaggttgatgcaaaagtaattgcagttttgcttttgaaagtaatggaaaaaaccgcaactgctttcacacaacctaatagatactagtctatgtgttaattgactgcttatgttatccgtaaggcttcaagtcaacagtagactattagtagttaagtttttggtgagtcatgagctatgtgtggatttttaactgcacagtgtaggggttggtgccactatccctcatattgttggggttttttaaactcttattttaggttcatgagtacatgtgagggtttgttacgcaggtaaactcgtgtcttggggggtttgttgtacagattatttcatcacccagcccaatacccaatggttatattttctgttcctctccctcctcccaccatccacccgcaagtaggccccaatgtctgttgttcccctctttgtgtccatttgttatcatttagctcccacacacagtattcagttttctactcctgcattagtttgctaaggttaatagcctctggctccatccatcttcccacaagacatgagcttgtattttttatggctgcatagtattccatggtatatacgtaccacattttctttatctaatctgtcactgatgggcatttaggttgattccatgtctttgctattgtgaacagtgctgcaatgaacgtttgcatgcatgtgtctttatagtagaatgctttatgttcctcttggtatatacccagtaatgtgattgccgggctgaatgctagttctgcttttagctctttgaggaattgccatactgtttcccacaatgactgaactcatttacactcccaccaacagtgtgtaagtattcccttttctctgcaacctcaccagcatctgttattttttgactttttaatagtagccattctgactggtgtgagatggtgtgtcactgtggttttgatttccatttctctaatgagcagcaatattgagctttttttcatatgcttgttggctgcatgtatatcttttgaaaaatgtctgttcatgtcctttgcccgccttttaatggggttgtttttctcttgtaaatttgtttaagttccttatagatgctggaaagacctttgtttgatgcatagtttgcaaatattttctcccattgtgtaagttgtctgtttactctgttgatagtttcttttgctatgcagaagctcttaagcttcattagaacccatttgtcaatttttgctttgttgctattgcttttggtgtctttgtcatgaaatccttgcccttgcctccatgcagaatgaaattgcctaggttgtctcccataatcctcacattgtttgagggtcaactgtaatgtcatgactgaaggaaaagatatttcattgtttattaaagattccttctcattattggttaggggtaaaataatttaatcagaagagggaaaagtcaatggaagtataattcttactatgctatctagacttcaagctgaaagtactatggagtcaacagcatttgatagactgtcatgtcactaactatccacattatctatctcattttgggtgcacattcatgccttccattggattggaatgatttgtggagaagagccagatggtcatctgcctgctttgacagctgtcaagctgtcagtcagctgtggccaactaatccaccctacttgacctggtgttttttgggcgaactgcattctttcttaaattaagagtagacttgcctttaaatggctggctttcttttaaagaacaaagttttttgttttttgttttaaagctattggaaggaaatgtattccttttagttctctgaaagaatctattacatacaggaaataagtgatgaataaagtcctcgttctttcttcaatactatctcctcttattttttcagatagcatagagaagatcagactcatctatgaatcttttggtgaataattgaacaaatgggattttgaaatgctctcctatgaatataacaatccatttttgtcttaacaagagctcatataagatccatattcaagaacttccaaatattaaaaaagagattgatacagaccacacaggaaaacagggagagagaaacactcttctttctgggttttatttttatttcattgcattatactttttagactgtaaattaatcagaacaacatgttttgctggcagacaaggaggttttggttacagtttttgaaatgcaacaacatgaagatgaacagatgcctgtgtgttttgttggctgcatgtataccaagatgtacgtgataccaacaacacacaggtaactgtgtgcccaaagatcaggagaaacatcaagctcctagtgcaggcctgaaatcttagtggtcagattatattacagtagatagagactctgggatgttttctctctctgtcctcaaatgagggggcattttgtagcagacccagtaagcagaagggttgagtgccaatcctgagatcacagagataggaggggtctgtgccttggggctgctgctgtatgaggttaaaggtgtgagagagagagtttaggataggagcccaggctgaggacaaacttggtggagggaagagaagatcaactgtctgcagggtcctagaggtttaagaagagtgccgtcaggaaggaaagagggcctagggtcaaatgccatagaaagagaccaatgacaaaaaaagtcactggatttttcatttaagaaatcattggtgattttcaagaaaggtgtttcagtcagctcaggctgccatgaaaagataccatagacagggtggcttaaacaacagaaatttattttctcacagttctggagcctagatcctccaagatcaaggtccagcatggctgctttctggtgagggctcttcctggcttccagatggctgacttttccctgtgtccccatatggctgggaggaagagaatatacatgcaagccgtcttatgtctcttcttaaaaggcaatacaccaaaaaacaaccccatcaaaaagtgggcaaaggatatgaacagacacttttcaaaagaagacatttatgcagccaacaaacatttgaaagaaagctcatcatcactggtcattaaagaaatgcaaatcaaaaacacaacaagatactatctcacaccagttagaatggcgatcattaaaaaggcaggaaacaacagatgctggagaggatgtggagaaataggaacacttttacactgttggtgggagtctaaattacttcaaccattgtggaagacagtgtgccaattcctcaaggatctagaaccagaaataccatttgacccagcaatcccattactgggtatatacccaaaggattataaatcattctgctataaagacacatgcacatgtatgtttattgtggcactattcagaatagcaaacacttagaaccaacccaaatgcccatcaaggatagactggataaaaaaaatgtggcacatatataccatggaatactatgcatccataaaaaagaattgagttcatgtcctttgcagggacatggatgaagctggaaaccatcattctcagcaaactaatacaggaacagaaaaccaagcaccacatgttctcacttataagtggaagttaaacaatgagaacatatgggcacagggaggggaacatcacacactggggcctgtctggggatgggggcaaggtgaaagacagcattaggagaaatacctaatgtagataatgggtccagcaaaccaccatggcacatgtatacctatgtaacaaacctgcacgttctgcagatgtatcccagaacttaggtataattaaaaaaaatgaaaaaaaggcaatataccttcttgagagcctgctatggtttgaatgattgtcccctccaactctcatgtagaaatttcacccccaatattggagatggagtctagtgggaggtgtctgggtcatgggagtggatccctcaagagattattgcccttccttgtgggtgagtgagttctcactctattagttccttggagagcgagttgttgaaagagcctggcacatcatccctctcaggccatgtgatctctgcacagccggctccccttccccttctgccatgagtagaagcagcctgaagccctcaccagaagcagatgccagtgccatgcttcttgtacagcctgcagaactgtgagccaaataaacctcttctatttataaattacccagcctcagattcctttctagtaacacaaagggactaagacagggccccactcttctgacttcatctaaccctgattctctcccaaaggcctcatctccaaataccatcacaataggggctagggcttcaatatatgaatttgggtagggggaaccacagttcagttcatagcaagagggttttggtaaactgttggagtcagatgccacacagcagcagtgagctaacgagcaaaggggagatgaagcagagaacatgaacaactcatgagacttggtagtgagaggctgatgttatgagagtagcttatagaaaagaaaataacctccttgggaaagaaaagatctcatgtttaatttgcttagaaatccttttttattttcttttcacatccagtgagctactgatatatttttccatttcccccatcccactatataatctccccaagtcaggtgaacatttaaaaaaagccacccataacagttaagagaaagagcacatattacaaaacagtgcgtgttatatgatcagatttgtttaaaatattcatgaatacaatttttcagaaggccttatgtataaagtgtttagtgtttaatcctaggagataggatttaggatacattaggcagggttcagttaggaaaacaaactgcactgcatgtttcaagtagaaaggatttaacttagttccatgcctgcaaaattgctgaaagggctgcagaaaagagaggtgagtaaaggccaccaagagctgtcagatttgccatcgtggctgtgatcccctcagagatcaggaactgctactgactttgcaccaccacagcctgagggagaaaggttcccacctccctctgccttccaaacccatgtgagtgcatttcatcggcagagttaaaactctatccagaacccagctggtaagagaatctgagaggtagttcccaggccctctttgattctggggagaatagaggggtgggaatggtatcaagtgccagacaacagctatcatagtctccaccctctttagctactcagtgaccaaccatatgcaccctcttatccataccacaatttctaaatcgcaatagcaatgatactaaccttctctgtagtcattccttgattcaatttaaataggttcaacttttgaaaatgagagatccaaagtaccatgatttatagtgtgggatataagcgtttttttaaataacgattaattttttattttctaatttataatttttttcttttgagttttctattaactggaactttacaaggattcaatttccttaaaattttaaacattattcctaacaatagtattgtaaagtgatcttcattcttccagttcaatgacaaacccacctagatatcatgtaacctacctattaaattatgagtttcaccagtaccaactcaccctatatgaaataataggagaaaataagaggaaaaagaaaagtgcatatgtgtgtgtgtgtgtatatatatacatacatatatatatacatacatacatatatatatacacacatacatatatatatatatatacacacacacacacacacacacacacacacacacatacatatatatatacaagcaagaaaatatgcacagcctagccatcttttctgcaactggtcatgaggctatagctgatatttataacttccctccactgggaaatccatattttatttgtttggctagcatctcagctggttagaattagttctttacttaatgaagtaatccaaaatctttattcctcaagggcctagcccttagtggactgacttgtatttggcctgacttgtattgggttgttctaatctgctaacttttaccactggataattactggaaggtatcctagggattcccatgtgtttcagacatagtactcagtgtcccaatttcctcttgatagttactccagccagtagagtaactcccttctttgcttgttggctcagtggcatggggtgtcccaaagggctaaacaggtggcagtcaatggaatcatttttgtattctctgatggagaactccctaagatttcaaactagcagagctcaaagttgcaaaaataagaatctataactttcttttttttttgtttttactgataccggatagatacgtattttcagggtacctgtgacattttcatacatttataatgtgtaataatcaagtcaggataactgggatatccatcaccttcaacatgtatcttttctttatgctgggaacattcaaattattctctagtagctactttgaattataaaatattatagtcactctattgaattatcaaacactaggtcttacttcttctatctacctatatttttgtacccattattcaacctctcttcatccccctctcctccctacccttcccagcctctaataaccaccaaaatactctctatcttcatgagatccacttccttagctcccacatgagtaagaacatgcgatatttgtctttttgtgctttctggcttttttcatgtaacatagcaacctccagttccattcatgttgctgtgacaggatttcattctttttttttttatagctgataatattctattgtgtgtatcttcatctattcatctgttgataggcactgatattgatttcaaattttggccattgtgaagtgctgcaataaacaagagaatgcaggtatctcttcaatatattgatgtcttttcttttggatatatacccagtaagggaattactggatcatatggtagttctattttgagttttttgaggaattttcatactgtcttacatagcagttgtagtaatttacatttctgccaagagtgtatgagacttcctctttcttacatatccttgccagcatccattattccctatgctttggtagaagccattttaactggggagagagaatatctcattgtgattttgaatactttttcatttacctgttggccatttgtacgtcttcttttgagcaatgtctattcagatctttcgctaatcttttgctaaaaaaaatcagatttgttttttgtgctactgagttccttatattccttgccaatggacagtgtgcaaatattgtctcccattctgtagtttgtcttttcactttcattatttccattgctgtgtggaagctttttagtttgatgtaatcccatttgtatagttttgctatcattgcctatgcttttgaggtcttactaaaaattctttgcccagactcaatgtcctagtgcatttccttaatgttttctctgagtagtttgatagttcaggtcttatgtctaggttttaatctgctctgatttttgtatatggcgagagattggtgtctggtttcattcttctgcatatggatatccacttttcccagcaccatttattgaagagactgttctttcccccattgtatgttcttggtacctctgtcaaaaatgagatgactgtagatgagtagatttatttctggattctctattatgtttcattgctctatgtgtctgcttttgtgccagtactatgctgttttggttgccacagctttgtagcataatttgaactcaagtagtgtgatccctccagctttgttctttttgctcaggattggctttggctatttgggctttttttttttttttttttttttgtagttctataaacattgtaggattttttttttcttctatttctgtgaagcatgacattggtattttgatagggattacattgactctatagatcactttgggtagtattaacattttaacccatttgtgctggagcctgaaatttttttgtgtgtgaaaaatcagacgttggtgatgaccttgagcagtaggatataaataactcccacaagcttagcgttccagtaatggaacactaggcataaatagattaacaatattaattcttccaatccataagcatggggatctttccacttgtttgcatcctctccagtttctttagagagaattttgtaattttccttgtagagaacttttacttcttttttttttttttttaaacagagtctcgctctgtctcccagcctggagtgcagtggcccgatctcagctcactacaacctccgcctcccgggttcaagcaattctcctgcctcagcctcctgagtagctgactacaggcgtctgccaccacacctggctaatttttgtatttttagtggagacggggtttcaccatattgcccaggctggtcttgaactcctgaccttatgatccgcccacctcggcctcccaagttgctgggattacaggcgtgagccactgtgcccagtcggtcttttacttctttggttaaatttattcttaggggccgggcacagtggctcacacctgtaatcccagcactttgggaggccgaggcgggtggatcacaaggtcaggagatcgagaccagcctggctaacgtggtgaaacaccgtctctactaaaaatacaaaaaaaaaaattagccgggtgtggtggtgggagcctgtagtcccagctactcgggaggctgaggcaggagaatggcgtgaacctgggaggtggagcttgaagtgaaccgagatcgtgccactgcactccagcctgggtgacagagtgagactctgtctcaaaaaaaaaaaaaaaaaaaattattcttaggtattttataatttttgtagctattgtaaataggattgctttcttgattttgtgttcagattcttcactgttggcatatataaatgctattaaaacccacctagatacgtaacctacctactaaattatgagtttcaccaataccaactcatcctatataaaatgataggagaggctggacgtggtggctcacacctgtaatcccagcactttgggaggccaaggtgagcagatcacctgaggccaggagttcgagaacatcctggccaatatggtgaaaccccatctctactaaaaacacaaaaaagtaggcgggcatggtggtgcatacctgtaatcctagctactcaggagggggaggcacgagaatcacttgaactcaggaggcagaggttgcagtgagcccagattgcgccactgcactccagcccaggcaacaaagcaacactctgtctcaaaaataaataaataaataaaaattaagtaggagaaagtaagaggaaaaagggacatgcatatatacataaaagcaagaatatatgcatagcgtagccattgcttctgattacaggctatagctggttacaggctacagttgatatttactccttccttctcctactaggaaatccttattttctttagctagcatctcagctggttagaattctttatttaatgaagtaatcaacaatctctactcctgaagaagtctgcttttagacctagtgatgtaaacagagatctgaaataagaaaatataaataaaaatagacctactgatggtacagctcatgggtgcaagacatcttctgataagattcatacatgcattgatattcctataggtagaattacttggttgaggactttgagtaatcgtagctctcctggtttaggagctgctgtaagaattatataagaatcaaaatttatttatttatttattttttacctgctaggagtgcaagcaaggaatcaaaatttaaacctttttagatctaaaatttagatttttgtagctattgtaaatggaattgacttatttgattctctgattgttattggtgcatagagatgctaaaatgattttaacgtgttgattttgtatcctgtaactttactgaatgtatcagttctagaagttttttgttggagtatttaggggtttctatatataagatcatatcatctgtgaacaggataattctgcgaacaaggtgaatttgacttcttcctttccaatttggatgccctttatttctttctttcctaattgctctagccaggacttcctgttttacgttgggtaacagtgatgaaagtgggcatccctgtcttattccagtctttagaggaaaggccttcagtttttcccccttcactatgatattagccatgggtttgtcataggttgcctttattttgagatatgtgtattagtctgttctcacactgctataaagaacttccctgagactgggtaacttataaaggaaagaggtttaattgattcacagttcagcatggctggagaggcctcagaaaacttataatcatggtggaaggggaagcaggcaccttctcaaggcagcaggatagagtgtaagcatgtgcaggaggaactgtcaaccacatagaaaaccatcagatcttgtcagaattcgttcttatgctatcataagaatagaatggaagaaaccagtcacctccctccctcaatatgtgggtattacaattcaagatgagatttgggtgggacacagagccaaaccatatcaatatgttccttttgtatccattttagggtttttatcataaagggatggttatcaaatgcttttctgtcatctactgaaatcatcatgttttttccttgattctgttaatgtggtatattgtgtttatttatttgcatatgttgaatggtatttgcatccctatggtgaatcccactcgatcatggtgaatgacctttttattgtgctgttgcatttggtttgctagtattttgttgaggatttttacctctattttcattagtgatattagcctgaaactggtgcttttgttgttgttgttgttatgcccctgtctgcgtttggtatcagggtaacagaagcaacaactttttaagtggatttttaggtgtattcataagaagggccacttccattctctcaatccacaaaacacagcaccatatactgttgctagttcggagcatttaccacatctctagggcattgaaaaaggttacctctcagatggtgccatcactaggtccactatgatttggattgagtccataatgcgacttaccacctgactttcagcaacctgcattgtctgattcttggctacattaccctgtagctataagggatgggagagtcttctagggtagtcacagaaggtcccaggcactaaattgcgtcccaaaattctttttttttttttctctgttacccaggctggagtgcagtggtgcgaccttggctcactgcaacctccacctcctgggttcaagtgattctcctgcctcagcctcccaagtagttgggactataggcacgcaccaccacgcccagctaacttttgtattttttggtagagaggggtgtgttggctaggctgatctcaaactcctgtcctcaagtgatctgcctgcctcagcctcccaaagtgctgggattataggcatgagccaccacgcctggcccacgccaaaattcttatgttgaagccttaacatccaatgtgatggtgtttggagacagggcctttgggaggtaattaggtttagatgaggtcatgagggtggggtcctcatgatgggactggtgccctcatatgaagatacagcagagagcttgcttcctctttctctcttccctccatgtgaggacacagtgagaaggtggccatctgcaagccaggaacagagcctcaatggggaaataattagcttgtgtcttaatcttagacttcccagcccccagaactgtgagaaatacatttctgttgtgtgagccaccttgtctatgatattgtgttatggcagcccaagctgactgatatgccttcctaagtccctgctctgacttgtgaaccacaaatattttgaagctccatgggttatcatcagtttagattcaatgtctagtaatctacctaagaatatggttctctcttttccccactgcacactctcccttataagtacctgccattctctttgaaggggtaaaaggaaagtttactgtactcacttgtggcatgattgatacatcttccccttcatccaggggactctggttctataactggcctgttatccaggtaagggaattggatgaggccatgattattcattgtgatgacaagtaaagtctctgttcaccagaccagagtttgactataatgatctagtaaaactttagtaggctgcccatttatatcagttctagagatctcaagcttagccactacaactatccctagcaggtcaaacttttttgattactattgtgcccttgttgaccaatatagtaaccaagcccacttcgactctgtttgttcagtggtaccaaggaccccattttaaggacattatctcccagtcaacatcgctgattcctcaggcttctaaactttttctagattatactagcaaagttctggcatttcaacataatttaatgcagagtcctttgttgagcctagttttcagttattcaaactggtgaatactagtttgattagtataacatagtaacatactcaatccagaatctcttacaggaaaagtcctatcaataaagtcgtcatcggtccaactgagttcctccctccctggtctagaacccttagttcctaatctcacacatgaattaatatgaacatatgaaaaaaagctcatcatcactggtcattagagaaatgcaaatcaaaaacacaacaaaataccatctcacaccagttagaatggcgatcattaaaaagtcaggaaacaacagatgctggagaggatgtggagaaacagtaatgcttttacactgttggtgggagtgtaaattagttcaaccattgtggaagacagtgtggtgattcctcaaagatctagaactagacataccatttgacctagcaatcccattactgggtatatacccaaaggattataaatcattctactataaagacacatgcaaccttcacctcccaggttcaagcgattctcctgcctcagcctcctgagtagttgggactataggtgtgcaccaccatacaaagacaccaaaagcaacagcaaaaaagcaaaaattgacaagtgggatctaatgaagcttaagagcttctgcatagcaaaagaaactatcaacagagtaaacagacaacttacagaatgggagaaaatatttgcaaactatgcatcaaaggtctatccagcatctctaaggaacatacaataaaacttccccgagttttattaaatgtaaattaatggaatcttacaaatcttctggtgctttacttgtatctttccaagttggattttctacttatctctttgggacatgatgatatttgaccacttttaggcctaaagataaagatgaatgaagtaggaatgggacatgattatatttgccacctcctacctgggatgaaatagttacagagtctccaagcaaaataggacttgctttattagatgaggagggagaattgtttctgtaggagggagagctcagtggaatttgtagtttccaggtatttgaatttatttgaatctacccaaatgtccctgttcaaattctcacgatttcaccttttcctaccaatgcttaatcttcacttaagagatctgacgtggccatgaattcaactcacattagcatctgcaacctgcagtatctgatttttggctacattagcactgtgactgtaagggatgggagtcttttagggcagtcacagaaggtgcctggtgctttgattgtgacctgagatagaaaactatgagattgtcattttctttccttaagcaattcaggatagcttaagtgtggatatatcatagcttatataaactatgcccttaataatgatttttagcttctccaataaattcttaactgaggccagatttaagtgacaccaaagtctacaatggtaccaccactgtgtctgtccagtatgacaagcaattctgtagaccgtgggtatgctagggcagttagagttcatccacggtgcctagttcctactgcatttggcccatcacagcatattaagagctgagactgtgatggttaattttaggtgtcaacttgactggattaaggaatatctgagagaaatgttaaagcgttgtttctagatgtgtgtgtgagggcgcttccagaggagactggtgtgtgagttgttggactcggggaagatccacccttagtgtgtgtgggcaccatccaactggctaggggtctggatagaacaaaaaaggaagagaaaagacaaattcactctccctcttcctggaggtagaatacttttctcctgcccgtggacatcagaactcttcctgcccttggacatcagaactcctggctccgtagcctttggactccaggacctgcacttgcattcccccaggttttcaagcctttggcttggactgagatttacaccatcagcttctctgttctgagcttttcaaacttggactgagtcatgctgccagcatcccaggatctcaagcttgcagtcagcctgttgtgaaacttctcagactccataatcacatgagccaatcttcctaataaatcccctttcatatctttacagatgtctatctgtctctacgttctattggtttctgtctctctggagaaccctgaataattcagaggccaaaccaatttgctggagtgctgagggctggggagatgcctaagcctcaggagctcagaggacaaggagagcctttgtctcattggtctacacgtctaagtgccttccagccttgcagggaatcccctcgaggaggggccagctcatttacataacaaaaactggcagaatttaatatgacatctccacagatgtagtcttcctttaaattaaaggcaccaataaatgtttgtagtcaagaagctcactgcatttcaaagtgaagcagtttggtcattacattcaatttaaacatcttgaaattgagatttctaggtgatgtgtattttttcatattttgtatttttcacaacttactgagcccatttgctttcactttctcaagtgtttaaaagtgcataaaaatcacaaatttgccagtgtcctatgccaggctcctttacatctgctataatcattcttttgggctaaaaattcttctctgctcatgtacttctaacctacaatcactgtgaagaccaatatacaatttaaaagccttgaggttctaaattagaatatgcagtttattgtgtggctccagctcagtgcaaacttttccacaattttgcccagaaaacagatgcccattagtagcctcatcaagaagccccgccattactgtgactcttggtgttggaacaaaatgcatccaaagtttcctctgacttctagaaggagagtttaaagtagctgcctctgaaactgttttaaaattgtggcttgtgtaagcatttggtgaacaaagtgctctttctccaaaaaggtaggtgccagccacttgctgtcctcaggctgttcccggagcatcgccaggaacatgaaaatgctctcatccacggcttagtgtcatttaaagcaaacctctcctctgaggaacagggcagatacaaccaactaatcactgtggcaggagacttagaggccaagtgattaataagtaaggaaggcagaatccctaccagttattgttatgaaaagaaaattcagtaaaagcagagatattctgggttctgacccacctctatcctctcctaattttaactacaaggcagtcactctctttaagctccagctttttcaccagtaaaatgatgggtcaaatctttccccctgccttatgagtccagtaagaggataaatccatgttggtagagcaatttgaggtaagctcaaaatataatcagattatctggaagcctacataatgcttagttataagctacattcataaatctctcaaaatctccaagggagggacacagtttgcatatttagtatcaacccagtgaatcaaagcagcagcagggatgctcgtctctaagatggaaggggctccatttagaactcatgactaaagcatttcactcaacttctgatttcatacccttatcaacaaactgaggaccacaacctccaccttgtctactttccagggctactgtaaggacccaaatcagaacagaataagggaggtaaaagcacatgattaacaaagcaaagagaaatatacacttcaaaagccttagatacaaagaaaacatcattataatctagtttataatctacaaactagaacttcggtcttggagttaaaatagttggggctacttcagctccaagatggagggtttagcagaaggggcagagtaaaagccgaatggagccgcgtacctgatggtggtgccttgcagacggtctatcttcttgttgagctccgcaatgacgctgtggagctctgtgatgcgttcctcatagcgaagtgtcgttcgctcctggacatcctcatgctctctcatgaggtgggactgctcgcactgggaataagggaaaaggacagaagtgctgatgaattcatgcacctacaggtggatgattccaagctttgtggccttaaaccattacaactgccaacactgagtatgccccaaataaaatgtatgtcagctcatcggctggcaatcccaggaaacatatcaatggctaaattttataattcccccagtggatactggagtctttgcctttctagcactccatctctctttgggaaacagtccctttgccattgcacactgtccaagtggggctattcaagtcccccactttcccgtagccaagaaacaggcaagtggtccaagctagatccatcagataccttctgcaggggatttcaatcttgagccaatggatgtaaggttgcatggagttgattcagaaagccttgaagagcatctctcttagttcctgctacctacagctcccttcccaagttcctttatggctgttcagtttccctttttaccaattcacccctcctttgctgaagtttgtcagggtttgtttcagctatttttcaaccaaataatcctaaatggtataataccacttcttatctggatggattatctgcaaatttaatgctttccaatatcattatctcccagactacaagctcctggaaggcaaggactaggtttctcattatttagcctagcaccggcaaatggcctggtttactgtgggtgatctaggagtgttatggaatgaatggatgacgatatatcatcgtcatgaaaactgcttagcagaaatagtgataaaagaggcagaggagcttcccttgctcagcatttgatggactaagaggcagcagagttatagaaacatttctgtagccagagtttaaatcctgaggaacctgttcacctctcacttctctccactgctctcaatcccttccagtcactgtgcatttaatctcatttacataataataaaatactcctcagtgatggaacaagtagcctagcttgcgtccttgtctactacactcggcttcgattaatttcctgtcagcagaggaactttaatttcatcttcaacaaggttttcttagtgccaagagccatatgtgctttccagcgttgcaggttggcatctccagtgagagtaggacttctcacccgctacctcccctgtccctccctaaatcagctaagcttccaatggcataacccagggcagggacaaaaggctttcaacgataaactgaacattatactaagcctaactccatactgaaacagaagtactcaacaaagaagtctgacaaataatctggtatcaatcatggtagggcctgcacctcaacaacagctggatcagtatttatgtaacttcctgggggttaccttggagctccagaaacaagattggaggcaacaaggttgttgaatgctttatcacagccttagagggatactttcaggaaaatactcatgtgaactactactcttagtgacaacctgaaacatcaaataacctccactccaggtcaagcacacaaaaaataagcgggaacaaaggcaaggatcaaggttgaatgaggggcacatctagtggaagctttcctaaacaaagatgctgtaaccagccacagacactctttccatgaagttaggcctttctcatccatgatcctacatacttaaggaaaaggagaagtccacaaaaattacaggatctcaaaggcatttctatcaataaatgaaagagcttcatatttctctggaacaaaccaagaacagaacactgttcctctcagacctgcagcacatctacaaactcttgctgttagcctctgttcccaacctcagagtgtgtgcgtgtgttcatgttgtatgaacatgtacagatgtagtggacactctcatgcaggtcaccagttccagatcttagtgtgactgtaggataaaattctgtctctgacctggatctcatcaatgctgtgactcctatgttcccatgttgcttgttcctcctcttttgttttccatattccgtctagggctacaaattactgtgaaacatttccacttacacactcaatgagctctcactttcccttatttctctactccttcttttttctttgatgtccttacaggtcaacaggccactaccaccacctgggctgacaagaaactacaaagtccaatgaacaatgaagatgttcaagggtttatatagagaaaggcacaccatcaataaaaaccaccaaaagaccacccttcagcatccctactgactgatatcaactgcctaaaagatgtaatcctggccaaccagcagccctcgctgctgctctgcctatggagtggccattcttttgtttctctaataaacttgcttacacacacacacacacacacacacacacacacacacacacacacacaaacacacacacacacacacacaaaagaccctgtggggctgcccaggataccagatggagagggagagcttgctctctggtattgcaccatccttcccctgcctctaactgagaagcctgcctggaggatacctgcatgaacaagaggcaacatgaagcctggtgattcagtcagatggaatagggcttgtagctaaaggaaaaaaagactcaatgtatatttgaagctcaagcactgatttaggagaagtaacaagaatatattagaggaaaaaaacctcctttaactaagggcaaaggtatttagtttacattcctatatttttccgtaagttttaaaaaaatagcatacaatgtagtactataatgtaatacttcctctacacagatcagacatttcttaaatgagactgtgctgggtgctacaggggaggtgattacaacacattttgaaggtaactgtggtcacagcttccagtggactgaaagaatcccagacttctcttctggagaacaaatacccctctgattcctgtttttgccatcaaggcactgaagctgttgcagctgcaatcttctctcctctatgtcttcctcccccagctccctgacctgagtttatatcctcttcaccatttacctaaaaatcttggctggtgccttggtctcagaccctgaaacgcctctgtgaactctagggagcatgaatgttaggccttatgataccaaagagagctaggaaagcccaaagagctctctcttcaacccccagagaggataaaaacagaaaaagagacacaagggggtgtaaaacagggaattcaaagtctctctagcttccaacaagccagctttagcttccaaagtcaattattcagtgataatttacttagcggcctctgggaccaaaggcagtttcttctactacaacttgtaagttagagactattttcttctctctactggacagagacaccccatacaatttcagctgaacaaaataaaaattggtctcaaataatatgctactgcttttttttctgtcattacaggtaattgcatccagggttcttcctcctcccagcccatattcaatttttgactgaaggtacagtaccacaaagccagaaagcctgtggttgcagtgtcttgcctgccataaatttctggaggccattatcattaggagtctagatttgtctcacaactacagactttcagtttgaaaggaaaagaaaaaaatgattgacattggatatgacgaaattttgtttttcccaaatttcatctggtgctaaatacatacccggagtttcttcttgagatctcagctttcctatcatgatgatgaagcaaattaaacatgcatataaatacttgtgtctagccacataaattggtgaaattgcctatatgcaaaaatgtgtaataaaaacaagcaacatcgtcatttcaaccactgagaataaaatcctttaggctcatccctgctatggtgcaatccagggataaagccctgagtcagccttgagacagtctggcctgagaacttgagcccctgttggaaaaaccctgtgcaatgtggtgatgctaagcagctttatggttttgttaatgttcttcaccgggttttatcttactccaccgaggccactgatctttaatcatcgcattagtgtcagctgtcaaacctaagagcattatgaactaggttcttggaaaatgcaatgccatcattaatttgttaaccctctcaaccatcccgtgaagggggttagtaccactctcttttaaaatatgctaacaagagatgttaccctctcaaggtcacacaggatttgtcacaactaacactattcggggtatttccaccctcactctaagttcttgcccaggttcgctcgctaaggggaaagtggaccagctaaacaaagaggcaccagcacaaaaggaaatgccattaaggagcaaaggagctagaggagtttaccaaagagaagcataaacgaataggagaggaatggaatgaggcgaccctaacaaaaatacatgccgactacatctcagaaaagttatctcagaaaacaagagaaaaagaaaaaactctttccatttcacttaaggaaaactgtgtgtgttctcttcctgaatgccaagaggtagaaaattcaggagacttgttttccaaagataaggagcttacgaagtattccacattactgctcacctattttaaaggggttcataagcttgtttgacatatctccttctgaagtacttaaaaatgcagttaatttaaaataattgttggtactaaataaatagcaaatatgctgaaagcatcaaatcaggactatatctgatcttagccagtttcccacaggctcagttcccactgggctgtagaatgttgatgcatgtctgtgcccgtattcaatttgggaagataggagtgtgctgttttcagccagtaagtttatggcaatttattatacagcaatagaaaattaatacagaagcactttgtcttccccatcacattggtattgggctcttcccttcatatcactattttcaaaactctacctacaggtggatgtcatgagcataaataagacaccttcttttattcaaccagttccagtgtcaccattaataattattcaacagatgttgcagctctcttggtaatgtctgttgaacataaccaccatttacattttacattttaatcatggcactataatatttagagagctggtaaaacttaatagagccacacagcgtaagtttacacatgaatttgctcttctacaatctggtaaagcctcaaacatgaatcttttaccaaggcatataacaccaaaagtgcagcacagtcatttcattgttcttatatttttcttgcataaatttcatgtttttaaagatataagtctgacttttttttcatgttctctttcctaggttccagtatatgaactgggaagaaaactccagtgagaagagcagagagtaatttttaaatctattttacataagaatgcaaataagagagtcaataaatggttctatgatgtgaccattatcatcaagggtaaaatcagtcatcaaaagctattacatgaggatggcttgaccacaggtaagtaaaaaaagagctgaatcaatccttgacttagagaaaaaattttccattatcctcttaccatcctctgtaaaagctgtctttgtaggcttaaattttaataaataccttcctggtcactttttaaaatccaagactactgtacatgccagcttccaattaaatgcattcacaattttcttttttaaaacaaattctcatcaataagaattgctaatgatggctggctttgggtgggtataaattagaaaacatagtcaccaccattttgttgttgtttttaaatataaaaataactattttctcttaaaaaaaaaacactgtaaaacaaaaaaagcactgaaaaagtttcagtttggagaccaccactgaaacattctaatgctttccagttttttctatcactattttattacttttataatcagaaggaaaatattttaagtaacattttcatctaagtaaaaactgaaaatttttttatttcagtatgaaataaatactatgaaaatagtattaacatcctatagtgggaaaaggcactggtggccttgctgagctactcatttatctttgggtaatcaagttaatcttcagatgcccgtcaaatgtgaaagtggatgatcttaaatacagagaatcctttccctctactcaagcagtctttgattatgagacatgaaagtttccaaaaattttccataggtcattctggaaagatggctatagcagccatctttccagatattaatttaataccagcctggtattaaaatttctctgaattcccacataaaaataaacaaagcacttacacagtaaagcccaaagcttggagacaaggtgtgccattgaacaacaaaatacaagcaggtaagaacaaaccaacatcatccataagatctgagtggcatcagcttggggagaatcagaggaaaacaaggctgatgtatctgagaactggaaaacccctaaaaaaccaaaaggaattcacaggaaagtaaggatgcccaattggagaatagtagctaaaactaggaggggttttgcctgaccaaagagtcagtgcaaggggcccacaggaagatttgaagaggctaacctaggctagtccctgtgaactttggagactgccctcaggactgccttccaggaagagaaactgctgggagtggaaacaaaattgaacaggatgggaataatagagacaaaggaaagaaaaggtccagataaaagcaggtaaaaggaacagagccagacagtgacagaaagcaggctgccatttttgacaagaaaacaacagaaggctaggttctaaacactttagaaagccattttaaaccctgcctcctgaaagttcaaggaaattatttttcacatgaaaatgaaaaacagaaaaatactgacgtcaaatcccatacaaagttatacaaaacaagggcagaacatccttataaaccataaaagcatgccacaacacagaacaaaaacaaaatcccccaaacaaaaacactccagataatagcctactatttcaaaataaactaaaagacatgagacagaaaagaacgttaggaattagaaaaattcagaagtgagaagagttagaaataaaatgaaaatgcatttcagtaatgatgactacactggaaggcaaaaaagaaaggctaaaaacaacacataataccccaagagaaaaggaaaagaaaaaattaaattaaaaaagatttaaaatatttaagatagtaacagataaagataggcaaagatgatgtaacatacaaatgatagaagtccttgaaaaatcaaagcaaaggaagaaaattaatattaacaagataattaaaaggccaggcacaagggctcatgcctgtaatcccagcactttagaaggccaaggcaagaggatcacttgagctcaggagttcaagatcagcctggacaacatggcgaaaccccatctctacagaaaatacaaaaatttaactggtagtcccagctacttgggaggctgcggtgtgaggaatgcttgagcctgggaagttgaggctgcagtgagtcatgatcgtgccaccgcactccagcttgggtgacagagcaagactctgcctcaagaaaaacaaaaaggtagccattcggaaggaatccctcggtaggcaccttggacttcgtagcttctggaactgtgagaaataagtgttgtttaagccacaaatctatggcatttgttacagcagccagagcagaccaagacagagtatttgctgataaagctgtaatttgttttgtgggaatttctgtactcatgttttatcttaagattaaatatttaaaacaaaaaacaaaagcaaactaaaaacctttccagatcccttacctgtgccttggccaatttcttttccagaaggtcccgttccctctctgtttgctggagacgtttattaagttccactatatctccctttagtgatgccagggctgctgaatggagctgtggtgacagaaaggaggagattagagtattgtagcagagatgtatttccttcccttcattcccgcaactagtataaccaaataaaaagcctatcatccaaaaagcaacacttttgagaatgaaggtaagtgttatgagttttggggacaacaggcataagtcaggtgtgctaccagcaaactgggttatatggtcaccctaaatattatgtgtgggacatgggacctaattttgcatggtataatcaggccagagaacaaaacttctctttccaatggctttccccaagctactcagtgaggatgagcctgacagctgaagtggagctgcctgattctaatcatgagagtcaagaaaatcagaaccatattaattttcaccttcggaaaatatgaaagctgaatagggcaatttggatttctggaatccagtcatctaaattgctgcatatgtgacaggcagacaggcactgagcattaaggggaaaaaagcagcagagctcattttttagatggtctccttgtacagttgacccatttattttcttgttgggtcttccctcctctttgcctccccacttcccccgaaaggctgtactggccagacagatgcttatgtgctagcaggccctctttcaggagcagcaccagaactctgacaaatgacgctgtgaaaagacaaaccaaggatcaactgaggtatctttctgcagccatttctctgggttaactggagttagaaagaatgttcttcaaaagattaacaggaggccccacgtacatccagaatctccatctgttcaacttccaagttctaaagactggactttggctgcacacacacctaccacacatgtgccttctgtgattttcaggccgacggatggaactatttttaagacccgttcaacacactggtcccaaagcaacaccctgaaacgtcctttgaaaccttgaaactttccattccaggtggagctcagaccatcccctcactgaattccatactacatttgggtgaacaactggaattagaacaaaccaacccctggctttataggctttttgtagtctttgccaagaaggatttcaagtaagaagtgagcaaatacatttgatctttaaagatggacacaggacgatggtacgtaactcaactttgaagattctcatttgaggcttagaaaaatgtgcttttctgcaacctgccctccacacacagcatgttggctggcaggcttcagggtgagggtggggtgggtgttgagtgagggagaagcagatataaggcagagtgtggggtttcaaagcagttgtttttgttagactctaatagcagtaaatgtgacttcacttaatcgcatcggagcagcaaaccaacagatcaatagccgatttgaaatcaggaatgcttaaaattaaaaaaagaaaatgtcaggcaatctggcagtatttgtcttctgatgtagggctagggtggcttggaaaaggtcactgtgggtttcagatacaacgttttgtgtgacgacttctcagtacaaataccacagtgttcccgttgtatagtcttgttgagattgttttgtttggtggaaggggaacgaattcactccctttgatggttggttgccccctcagcctttgaactgtcagtctgaggatttttcttcagcatctgacactgtggcatgttacgctattataccaactcttgagaaaggatttgccacctcacctccggcgaaaaggataaaatacgtgagagctgacatgttcttgaagaaattgaggagtggggataaggatcccagctctgttagcctagacttgcttccttcctcattatatctcccctcctacttctgggggaaagggctgcttgaaggggttgggggaggcctggagggaaaagctgagagaatgctgcatgctcccccacagactccatgaactgggccagatggagacacacacagagtacttacttccatcacagacttggaagaggggtccaggatgggtcactatcatgggggagagcaccgggcttagagtgataataccttctggcctaccagctctccagatttccaggaagagctgtcagatgcccaagggggcaggtcccttcacttctctggatggaaggtgcctatgtatgaggtgagaacagattccttgagaatctcatgaatgcaatggacccttctactagggcagagatgagtttgggatgcatgcatattttccacccaattatggtgatgacacactctggaatctatctatgggcccctcaataagaaacatctggacttgatgtcagctctgtgaccccacatcagtttcagagactgtctcatgtgtcatcatcacagatgtctgagtggggaaaagaactttggtactgatgtccccgactccataactgcaggttaggatctggaatccagagactgacttgcttactcaaggtctcacagtcagctgagcaccagggccaaggccacagcactcttttctggctctctggtattgtacatgacagagttttcagtttgttacttggatgaaaattttacttaacatatcttctctgattataaaagtaataaaattgcaacagaaaaataaaccagaaagagcattctcatgttttagtgatgggctttgggtggttttaagctgtttttttgtttgggtactttttgtttaatgagcattttttcctgagttatttctgtattaaagacacaataaaataaagtgactgttttctgcatatgcaggctatagcataaatattgtacagggttattttgcttccttgctgcagtctgtccaccaactcttctgacagaaggaaaacctgtaacaatgaggtagaataaaatatgtctcttactgttactgacaattactccgcagaggctacaactagagagagcagaagttggagtgggggaagccaccaaccagccataagccacactgcctagaattggctgacagaccactccttgacctcctggacggagtaggtgaggagaggagtggacttcccaccacaagtttgagtgctggacactcaatctctgtgcgtttgagttcagtggcactccctgtcccactgcatcatcaactcaagtcatcaaaagctgacataacctcccctcttttggggtttcaccagtctctggcttattggtggcattcctgcaaattcaaaagctagagtgtttgtgagcgatgctacatgaaggaatttgtgtagttgtgtgttggcaagcatgaaaaaattagtttagaggtccctctaggcagttaaaacttttttactgaaatataatatttatacatatttatggggtacatgtgatattttgatgcatgcatacaatgtgtaatgatcaaatcaggatatttaaaataaccatcatcacaaacatttttcatttctttgtgctaggaacatttcaaatctcttctagctattctgaaatatacattattgccagctatagtaaccctactgtgctacagtaggagttatttcttctaactgcatgtttttacccattaaccaacctctctcttcatccctcccccactatcctcacattcttccccacctctggtatctatcattctattctctatctctgtgagatcaacttttttagctcccagtatgagtaagatcatgtgatatttgtctttatgtgcatggcttacttcacttaacataatgacctccagttctgtccacactgctgcaaatgacaggatttcactctttattatggctgaataatattccactgtgcatatgtaccacactctgtatatccattcatctgctgatgcacacttaggtcgattccgtatcttggctattgtaaacagtgctgcgataaacatggggatacaggtgttcctgtaataagccgattttctttgctttgaacaaatacccaagtagtgggattggatcatatggtagttctattttaagggtttttttaggaacctccacactgttttccataatggttgtcctaatttacattcccaccaacagtgtataagagtgcctccgggtgattttttaaaggactaccagtgggtttaaatcttggaaagataaatgtactaaagcaaccaaaattgtcaagtatgtataaatgggaaattatatttatgccaatttttgggatccctttaatcatattctggtttctgaaatggcctctaacttgagagattcagacatatgaactatgaagtatgatgaaaagaaaatgttccatgaaccaaagagaaagaaaatacatgctgtttagagtctgtgctagtgtcttcctcaacacatatttctcttcatactcaggagtcagatgctgatttttagctggtcatatttctgctcagcgaaaatattccagttcccatccttcagtgtagtttgcgctaggtatagccatgtgacaaagttctggccagtgcgatgtaagcagaaatactgtgtgagaggtatgggaaaatctttttgagagggcacatcctttttcctttcatccatccttgctgtttggtatcttatgtgatggatggagctctagcagccatcttgtgctacaaagctgagactctagggagcagaaaggtgcctcagtccctagcaactttgtggagccaccccaccagttttggaccacctaaccccagacttctgttacagaactgcaagaaataaacctctgttatacaaagcgctatgaagttgagagtttctggcaaatgaagctgatctaatcctaattcacagaatcagataaagctgggttcaaatcttatctatgccacttgttggtggactgtctttgcacaatttaatcccttttgttgtagggctgtgtcaagacaaatgatggcatccagaaagtgactagcagggtggctggaaccaggtaagcactcaacaaacgggtttgtttgaagtcaacaaccttctcaggcagaccaagccccatcagaggtgctagggacactcagactaggaaaacagtcctgtcctggagaagcgttatcacctggtagatagcacaggactaagaagccaatagctgcgttgccagattctgctgaaatcctaaggcttaaggagctgacagccagggctcttagttctctgtgaaattttaacatgaggcctaaacgaggttggatagaaccctgacactttgtatacaaatctggatctagtgcatgaaggatatagatccacacattcctcacatttctggagataaaaggccctaattccctaggctgttttgagccctgcttcacattcattttacagtgtgtatccaaacgaaactaaaccacctggacatttggctgcaagctaactgtcaaaatggttatttttggataaaacataacttgagtaaaataatttcactgttcaactgactctaaggacaagccctcttagcctctgagaggaaaggtgtccagcccccctgagcccaggtaagaagtgagcagtgccctcatgacagactctcccaggggtatctcctttgctaagtgaatagatgtctattccgttacatatctgctgtgtgacaaaaggcttcacacttcataaggtgcccttgaactctgcagtccaatgactctgatgagagcccctccaggagtgtcactgcgtatttctggttattaggtgcttctgcattttgctaaccctggcaataaacacagcagacatgcctacactacccagtgcacacaccactctccaggcaccatctcctctgaccttcatcacgccaggactctgtggcctaagggcaagctatgcttcccgatttgctgagggacaactatttttcccatgaaacacagttggtaaaaaggaatacgatttgaataaaatggtggagaacctagattcatctttgtgggacttcagtctgtgctttgaacagcacagtcttcaaagggcccaaaggcacctgcagccacaggtgaggcagaggaatgagttcatccccacaggccctatctagatacatgcacctcatgctgctgaggcacctcatggtgctgagggctgggccagtcttcccggctttgttgggaagtgagttcatctggggtaaactgtgcttgttctctttctccttaacttggtctggctacttgaagtgctagtttaacactcactgccagcgtgcatctattgccttcccactgagtaatgacaggagttacagtggtctcccccttaatggagggaggtctgctccaacacctgcagtggacgcctgaaacctcagttggtactgaactctatatacactgttttttcctatacatacaaagctatgataaagtttaattcatagtcagagattcaaaataattaatagaacagaccaattattaacaatatgccagcactgctactcttatgcttcgggccattatgatgtaaaataaggatgacgtgaacacaagcactgtgatgccatggcatttgatgtgataacccagctggctaatgggtggggagcacagacagtgcagatatgctggacaaaggaaggagcccttccccaggtcggacaaagcagcccagcacgcaaatgcatcagcctactcaaaacagcttgcaatttcaaacctgccaattgtttatttttggaattttccacttaacattttcagactgcagttgactgcaagtaaatgacactatgggtaaggggggactactgtactattctgtctttctagctgagccacttgctttccagatacaaagtatgcacaatttttgcttatgttttagtgatgacaatgggtagtgccaacttctctcatccagtgacaatgggtagtgccaacttctctcattaaaggacacttaatttcactgaacttaatttcattgaatacatatttttggcaggttccgcactgcatgcttcatacactttacctgttccatcagctgcagaggaaaggcagtgtcaaatcccaatgccaaaatctgcgaatattcttgagaattccaggtcaccaggcagtaataatgaaagtaataatattaatagttaccgtttgctgaatatttattggtatcaggggcttgggctaggcacattacatgccatatcttatttaaccatcaccacaatgctgtgagatatatgttattacctccttctggcaaacgaggaaaccaaggcacagaagaggggtagaaaatcagccgaagtgaagaaaactaataaatattaggttggtgcaaaagtaattgcaatggcaaaaactgcaattactttttccaacctaacagtaccggagataataacacacaaggaccctatgctcaaatcttctccactatgtgcatcactggcacctccaactcaacataccacggctctcccttgcccgagggatgcgtaaacctgcttgtgtccatgtatgtgtgtgtggaggggtggatgtggggcgggggtgaggtgtgtgcacaggcagggctgaagacatgggagaagcagggtcagggttttcgtgatggcagcacccatgtgattttgggtgggagcgagaagggtggcagggcaagtcctccaatgctgtgatgaagcgtggggctcagcttggtataaatgtgggtgattctctttgtcctttctgtgcttttttgtcctctgtagaagggtttgtatcggattacctctaagattcttctggttttaaacttgtaacatgcttgcctggcatgttcacctgtccaggcacctgagttctgcactatgggctttgcatactttatttgtccactggtcccagaaaaatctgctgaagctcaaatatttaaggaagcttcactctatacagaactgttcacccaagatcttttccctaaaaatggaatgagttttcagaatcacacatcgtcttaccactggcaagggaatttgagaacatctagtccaattccttcattgtagagaaatgaaactgagactcagagaggttcaaggttcatcaaattcagatttcctggttccctgtccagaggctacctctctcccaatggcaatccaagagctcgtgggtagtcaataaaatatgtatgtcccagctatccttggagacagcaagaaacatctgcacatgaaaaagcctcattcagcttcccatccaagactccacacccaggtgttctaattcagatacatacagaacaaaatgcctggcaaaagggtagtgttccctgctagatggataccatcaggcctgttcagtgacttctaggactggaacattcctctttactaccggaattccagctaggggcacctgctatgtagtatttcaagaaatgctgctcatagtcttgaaagttaaaactcattaaatataatctaaattataaattaaagatgtctcactgcatggaaatcacttttgtgtgccctagatcaactcagaaagcagcagcttttcatctttccttttacctgataatttcattgagaggtcagtggcccctgaattatttcttaaacctcagctgaaattcagttgctcaaaacagcattcaaaggctccttcaacaccgcagcagtgggacaccatttatacaagaaagattaaccctacccaaggatggctgatatagggaacagtgccagatcacaaagcaggcccaggtactcactgtgaaagctgtcatactggtccctaggacccacttaaagccacacctccccttcttcaaataaatggttaggaaatggctcccaagggggagaggtgtctgagactgacaatcagctttaaagatgacccacaatcccatcccatctgtaaacatatgctcccctgaaaatatgtcccatcgtaatttttactggctaacacaactgcttgctatgtgctagattgctatactcagcatataacatgcatttttctcaactattcttcacatagctttatgagatgggtagtgctgttatctccaatttaaagaggtaggaattgagacttagaggttaagtaacttgtcaagctagtaagtaacagagccagaatgaaagcccaggtctgtctaaccccagggtcttgttcataactaccaagtcccctgctttgcaacagaatatcatagcacttctgagatccttgcaaatacccacgaaactgttgagaagaaagatctcagagggttattctgttaagagaagaaagcagaattagcacaattagcatgggggatagacaggtattcattctttaaaactttaaacattttgagaaatagaagaccattcagctggtatcagacccaggaaggaatccgtgaaaaattaatctccagctattcctacattctatgtgggaaagttaaagaggacaaaattgtagtataggtaaaacaagcccttacaaacacctaactttgctgcttaaagactacagaaaaggaaaggttattaccttcaactgatgtgatctttaaaaattaaaaatctaaacagaagaatattttatatattttgtaaaaatttcctatacaaatattgtaagacaatagtagctattaaaaataagttattattttccactaaaaaatcctaacttgtagtaatatttattttcaagggaaacgaaaattatgtggttatacaagggtttttggaaagaaacacagacaaaataaagacactgcactaagctggctgcaccaacttaaatttcaagggggctgcatcctaatgacacatcatggaggagatgaagatgtaacaattaaatccagctaatcaggggacatgaatatttcagtgcacgctaaatactgatgtgattccccaggcggaaactcccacagagaattctatgaacatgaataaaagggttctctgacaaggtctgaattgttcataaatttttatattgatccaatttagcaggtattgaattccccattctagagaaaccaagtacctttagtggtgaaacagtcaataaactccacagatcaggaaaggccaaagtatttttacagcaatggttgaagtgctttgaagagaccctagattttaatggattaaggacaatactttttgtttgggaaagcaaatggaggtttagatttatgtgtgtgtgtgtgtgtgtgtgtgtgtgtgtgtgtgtgtgtgtgtgtgtgtctacacatacccatacacacagacatgcaattaccaacatatacacatacagagtatatataaaactcaaggcacatgcttccagacttctaattaaagtgtaagagttatccaagatgtcagctatttagatattcaatacaatcatttttaaatgcattcccatcttttaaaagatactttaatatgcattatttcatttaaagaaaatcagttttaaaatgcttgatgccacggcatgctccgtttcagggaaggcccaggcaggccctggcttgtcttgcctcaccacagggctgctgacggatgggccatttaccgtttgctggtacatctaatccaaagcaccaggagaggaggagacacatttcaaatctgcttcgtgttccctctctgatggggccctgctgactgcttcagagaacagtgtgtttagatagaaagaaggaatggcttttaggtctgaatcttctttcctttccaatcactctaacccagccaacaatagtcccaactcggatcactttgttcccagaaaatgaagagaatgggaaagagattaggtagaaagaaaacaacatgaaaaaacagtttcatggttaaggacataggctttgtcaaaatgcaaaaacaaaataccctggacttgagtattagttcagctttgggtaactcgtttaacttttctaagcctcagtctactcatctttaaaatgggaacaacacccactcattctagttgagaagattagatgaaatatttcaggcaaatcacttaaccacaacatcagctggcagactgttagccacaagggtcgttgcaatcttcttttttttttccctgagacatggtctcactctgtcacccaggttagaatgcagtggcaagaacacaactcactgcagcctcgaaatcccaggctcaagtcatcttcccacctcagcctctccagtggttgggaccacagtcaggcaccaccacgtccaactaattttgttgttgttgttgtagagatggggtatcaccatgttgcccaggctggtctcaaactcctgggctcaagtgattctcccaccttagcctctcaaagtgctgggattacaagctagagccactgtgccttggtccactgccaccttactgaccacaattatcatatgccaccccttctgcctgctaaaaagtgtcaaaataaaatcaggctttgaaaacagtggtacgttactatcctatctcattttcacaagtcctgattaagcaatcagaatgattcaacacattggagcctagatcacattaatcagagtaatctagagtctgcctttcaacacgtgtaattgaatcagctgctccctgcacccaggctgggccagcaggtaagcaggcaaacacattcatcctaaacagcctggaaactggagtagcctcatgcccgctttgcaccctctgcctcatgggtcctcatatcattcaggtaagagacagtcaagaaccaagcgggacatacataatgaccccaaaatcaatttccataaaaacgcatctcaatagtacaaaagagaggaccaaggaagttattgtaagcaaggacacacacaaaggtcatctattcatgatagaaaaataatcaaaaataataagtttttgaataaattgtgtggcaggaatagaataatcctaagttgtcaccaaaacagagaaatatataattaacttagcaatcattatttcccacatgtatgactcatttcctaagttctttcatgttggtttccaattgtcccccacagatcacctattctcccccatccactttctctttcctccttttttcctgtaacccttagtatgacctgacatcatatcctaacatttttttttgttgactcactgcccccataaaattatgagttccaagaaggcagggatgtcaagaggctggggaaatagctcatgaacaagaagaactgtacctggcacatggtagaatttcacgcagtatttgttgaacgggtaaagttagcaaattagaaaatacagataaaggaacattatccttacctcttcccaccaccactatgagatgatatcacctgcaaatatctgtcagacatttctgtaagtgtaactacacttaagatagtttatgcaaaacaatttttaatatagtattatttttagccaaaatatctaactagaaagaagtccaaaaatacatgtaccaaaatgttaacaacatccccaggtaatctctgtgtagtgtgattacagatgattttctttctcaggtttattgtattttttctataataaacatatattagtattatacaatttttaagtgttttcttgaccctatttacaaagtcttatgaagaatacaaataaataggtaatccttgctctcaacaagctcccagtgtattcagagagataaaccaaggattttccaaatctaggagttggaaagatcattaactgtcctcttatccaacagtccagccagtgccagaatcctgtctacagtgctgcctgcaggtggtcactatgtctatgtgctaaaaagctcggcaactcctcagacagccaagcctgctcactgttggatagctactggcatttgcaaattttaccttacatagcaactctgaaattgcctccttgcaacttgtcccattggtctagttccacaagtaggataaaattagctctcttttatactccaaactctccaagtaactcactctatcagtaagatccttcctaaatcatcaaacctccagaacaatccttgatcgcccaggggcccctaggatgtcaatgttccttttggtaaatggtagccaggaccaagcacagtactccagatgaattctgcctagctcattcttacgtgtcgatcactttacaagagttttcatagaattctcacagtaaaccgagataggtgctacaatgaactcatttcacagataaggaaactgaggcacagtcagttttctagtacttgaaaccacaaacttccaagctgacctgtcacatttaccacgggtatccagggtcacacattttgagatcccatatctggtgtgggctaagggagagagcctgaggactcaagactgcagacttggatggtgctcagcaccagatggtttatagcagtgctgctcaaattggaaaggccattggtaccagagggagtttcagtgggatccccatgcttgctctgacagtgcctggcaccagaggtaagaagctcccctgtataggtaaagggcagc[450 bp omitted]gccagttctcttacaaactgacttattccttttttgtccccttaatttcatgggctaattctgaaattaataaagtatggcaggggtagtggcattactcgctgcagatgggatagctaaggacaatgcaaggtctcctacatcggcactcacctctacccttctgccgttacagggactctgtgacacccttgaaagagaaagcagcaggaagaataaagaggaggccaccatgatgggctgataaaagaaacgtttccttggggtttacgtttattggttgtttctgactttctctaaatggcaggagcacccgacccaatggcaccgtcttccaacctgtaaccacccaaaaaatccatattaggttccagacctaatggtaatagaaacagcttcattgctgagggaggtggggagcttttgggtaatcacaaatagcacacagcttcccagaagtaagacttctttcatcatatatttttgggaatgacacggctttctgcccccaaaacatacattcatttgcaagctaaatttctcctgtgcttattaagaggggtgggagggggcagggaatgaaggctgcatattttcccaagctcatgaagcccagcctaatcattacttcaaacatgccacagcaaaagaagtgacatctaatcctgattttcttgtcatgtctaccattcccccatctccttgtagacatagcactaggatgcaaacagaaaaattccctaaagctgccttattttgtttcctgaaagcagaaaggcagtgagcaaagaaactatgaaagactcctaggctgtttaggaatgatacatttccaacctagataaaaatatcaaaagaaaatctaagtctggcagtgactagaaatactgacatttttacaatacaaaaactaaaatttacccaaactcttaaagttaagccccactactaaagaagtttacactgaccatcattaggcatgggaccaagtacagcggtagaaaaaatgttgagtaagcttttgcctgatatccagatggagtgtcctaagagtcctgcatgagctaccctgtgaggtcaacattctgaaatgctaatcttggaacagcgtgggtgataatacagtttaaatgcaaacatcactctgagatggataaacaggactataagatccgaagactctgagtcttcgtaatagagtttaaatgcaaacatcacttgagatggataaacaggactataagatcccaagactctgtgagtcttcccattaccctcaatacagggcatcatttatttaaaaaaaaaaaaaaaaacaaccaaaaaaccaaaaaaacaaagcttagttttgggctctcagaaaaatatcacaaatttgaaatgggatgattttgctcagaggtaaggagaacagaggcaaattagcactagctgccaagcatatgatgaactcttagactgcagggactcaccagggtatgcagcaagagataatgggtttacatttcagcatgagggattcaggcttgctctaaatgtctttcctgacagtgaagcttggtatgtcttacaaggtacagcgatggctgtggaattactctcccggaaaacctttccagtcggggcgagtctcatctctctgggataatgtgggtgcagccctgcctgggagtttggtcggcagcctctcaagattcattccagtctgatgattctctcactttacaccaatagatgcgctgtggcaaaaaaggtgagtcaacacacacagaacaattatggagggcatttcttttcatgtggcaaagaaaaacagtggttattccaaaggaagcacaggaacctcaaagctagctttttgttttattttcttaaatcctggcaattgtgactcataacacagagcaacatttacagaagtgtgaaatttgcgcacttcattccctgatgtgcttcagcctgggagctatggcatttacacacctgcagggctgagggctacccggaaaagtgacttaaatagaactggaaatttatttaaagtgattgatacataaaggaacagcttcctcatccccaaaataacaggctagagtgaaaaagggaaagagaatcaccactttaaattttaacttcaacagactgaaactctctagacttttaaaacaatttttttctggggcagagaaacatgacctacaaccaccaccttcccctttcaataaccatttttattttatttttgagacagggtctctctgtcacccacgctggagtgcagtggcatcatcaaggctcactgcagccttgaccttataggctcaagcaattctctcacctcagcttcccaagtagcagggactacaggtgtgtgccaccatgcccgactaatttttaaatttttgcagagttaaggtcttgttatgttgcccagactggtcctgaactcctaggcttaagcaatcctcctaccacagcctctcaaagtgctgggattacaggtgtgacccactgcacccagtcaataccatccttaaaagaaaccaaaattattcaaaaattgcctgcagtctcaggattttaaacattaacaattgaacctatctcatttcagatatcacatttttgggaggcaacagttgtatgtccgtgaagaaaaagtgcaaacatggcaaatcatttcctagggaaacacacaggctttgagtatccttataaagcaacaaagttatgctggattttcttatatacctagtgcgatactaaaccaagggcatgccacaacaagcctatttggagctttatatacactgtacatgcttgtggaaacaaggcaactagagagccataaagaattcataacttacatatggaatattaaaattttgatgaaaatgtgcccttttccagataaatgccagatgttaagagtactttcatatccattcagacaagtgctttaacatgattcagttctttgaaactttctgaagaaatatacttgcacttctttcccccattacatttatggagaaagattttcacatactttttattaaaaacttgactaagaaaagatgagctgtgctacataagttaaatgatttccatagaaatacattattagagtatacaaaaggataaatctatgccatgaaagaataatacaaagcaggctctttctatggtgagttcaaattccagaatataccacaggcacaaaacccttgtggtttacagaattctgaatctcgtagtttgaataatgggtgcaggccaaagcaactgtgcttttttgccatgtctgtttttttaattaagccctcctagtgggtggtgttggggggaaaacaggggcaacagatctgagacaggcagcagagaacggggcaggggcaacagactagtccacaaggctaattctatattacccctaaagtctataaagcacaaagactctaaattcaggcttgactagtagcaagcaatagcttaggcaggcatcagcccccatgatatccaccaactctcttgcaggcatccaacagacataatcggtggatgtaaagattgtgttagctaagcaaacggctttaagacaagccctctgtgcctccccatcaccaatccccagccccagagcaccctgaatgcctcccttaaagaaatcttgaaactcccaccgtcccagactccctgccctctgtcctaggaagacagaaagaagggacactgatttgcattgctcttgctgttttataggtaagatgggaggagaaaaaggggaaaagaatccaaagagtagggggaagagggaaatagaatggataggctgtatacatggagataaccattaattctaaaggaagccaagaaacccagaaggagaaaggaaaataataataagcaaattaacattataggtctttttaaaagtctttttgaaagactttcctctgcaggaccattcctgcacccaaatgtgtcaaagccttaatcttgcatagtctcctgtaatgccaccccacaccctataaccagcatggaccagcaaggccaagcacaccaaggaatgctgatgtttagataattgggtggagatgaggtgtgcactgagaaacaagtaaaggttgttcttgaaaaaatgttctctcattaagacccagtcaaactgctcaggtgtggtgccaagggggttaatgtacaaattcagaagctctatatggggtcacattctggccatggggagacacaagggtaggtttcttaaaatgcattgacttgacctcttccccaagagcagtcaccttttgaactgctgtgggatgacctgggaaaaaaacagaaagctctgcaatcaggcactctgtgtgagtgtttgtagtcaacaatcagagggctgtctagaaaacaaaatgcctcatttctttaatagtagctattcaggcagcaagaggcaatttaaagactggccagcaaagtgcactgtttgggagatcggcataaatgataacatttctattctactccagcttttatgcattgctcaacttcacattgcttaaataaagtacttccttctggggatggcaagtacatgatacctcagctacagctactatggtagaattagatggatataccccacacatctaagctccaatacaaaattcttagggatttttagtaagatgcacaaatgagtatttttaagcacaaagtcatgggcaggtctggtcttcatagaaagaagcttgaccattgatggtagtgtcttaatctaaatttcttttttcttctttacagcacctacttcttttaaacaaggacagatggagccatagggtgctaactggtccctttactcctttcacttttttgtccttttcttcaatggactttacttctaatccatggcagaatcatcctctccttgtagaattgggcaatataccatattcctacctccttaggcaagaagggacatttccaaaattttctgataaaccacaactgcatgaatggtgagaagcttggatgctttttatttctgtggcgtcattaaagtcccacagtacccagcctttgctatgcacacccacccatgtccctatctgcttgtgggaagctaatatttactctacccacttcctagggataccggggtctcggggcattcctataagtgttgtttgttaaaagcactacaaaaatgttacagttcaaggtagtatttactgacttttatatataactctccttactggtgttcttaaaattcatctctaacatactttattatgtttgcctctgtttacaaaatttgacaagaagttatagacttttcgtgatgtggtcagtagttacagtataagcaagcaactcatatgttttgctcccagaaaagagcccttgggaatacttatctctaagggcaagacttgaaatctgagagtcagatccaaatattgccagatggctggcaatacctttaagctgaagagtgggtgtttggctcccacactgggcgttctgcatccagaactgagactctgtggaagcaccgagtacatgcgtccctaaagctttggcttcagtggctctcctgaaccatttctgtttgtcaaaggcatgtgaccatgtcctggcagttcactcagatatctgccctccacacaaaaatttgatcacaactgcctacatccacaagaaagctcctgagtcaagtttagcagagtgctatcacagcatggtgcaagataatttcccatcagacaggcagccattctcttgaacctaaagacaaaaggaggaagcatagaaaatagagctgtttcatcacttgggtacttatgagtttacatctctgccccaaaatgtattaagcttcagtcgggcaattacctaacaagggcaaaaatgcacagagacaagcagaaggcggaaacctcttattttttaatttttgagacagagtgtcactctgttgcctaggctagagtgtagtgccacgactcggctaactgcgaactctgtctcctgggttcaagctattctggtgcctcagcctcctgagtagctaggactacaggcatgcactattacacctggctcatttttgtatttttaatagagacagggtttcaccatgttgcccaggctggtcttgaactcctggcctcaagtgatcagcccatcttggccttctgaaatgctgagattaggggcatgagccaccgcgcctggccctggaaagtggaaacctctttaacccagaacatctaattggtggctctgtggcctgtatcatttcacaggtggttaccgggcagcctccaagaacggaagcagctgtggcaagggaattctccagaatctgtgaggtttctagctacgaagagcttcagtgatatctgcttgtcaccagcaagtcctggaactcatcagtaactgaccctactacatgagcccctacataaggaaggctctcccttctcaccctcatgatccatctcccatggttcttagcaaaccatcagtgccatgttttgaccaagaaaaagtaaaatggaaagctatccaaatgttgactgacttcaggtactatgggagcactgagggggaaaagaactgttatgtaggggaaggattctatatgagaacaggtaggacccttttctccaaatgtagcagtggaagagaaaagagacacataccaatggacagttcatacccaatagacacagttcagctcacacaatccaggcacctgacttaatattgatcaagtctcactggatcacttaagacaggattcagaggtgacagcaatgtttttgtctgtctgaacacaaaacaactcaaaaaagggtctcaggcatcaaactctcacctctttaaggttatttaacagcctaggcaaaattttggaggttagaacaactattcagctgctttagcacttcatttgcatagagaacaagcttcattttcccttctcactgtacttggtcagcctcaagttgctatttcctatagctttacagctgaaaactctactctgccatgcacatcctcttcttttaagtaacctcgtttgactaaaaaggctttggggaggcaaatgtgaaatgttctttccccacctcttacacactttgacataacacagaacaaatcaggtgacgagaaagactccacccatggccatctgtccatcttaacacaattacctatgtgctgggcgtaccataacttagccaacagccaattatagaatgtgtaaccaattttccttgttgtatattgctacaatgaagaaccttagaacaaattcgtggaaatagagttaattatctggccaaggcttctgactgtgaaattgccttctaccgaaagctattgcaatatatatttctcccagctgtatctatttcactttactcctaacatgtgtagatatatcacatattttttttttgccaatttgattccaaaatagtcttcattttcttgattatttcaggataaactttttgtcgtaaatctactggacacatgaatttgttttttaattgcctgtttatgttctttgcctgttttgataggatgattttttagagtttgatgtatataacagatattaacttttcaccagatacactgcaaatactctttcccagtgaactgttcgtcttttaatttatatagcattttatcacatctgtatgtttcatatttttatgtagcttccataaaccttttccttaacagatcctctctctgatttttgtttagaaagacatcctccaccccactcagattccatagctaccaacattttcttcagtgtggttttcttttatgtggtcattttttaaaccttttattcatctggaatttcatggcatacatgaattagaaatcaactttgtacttttcatttattgtttgtcctattactactgaataattatagctacatctttatgttactctaaatgacaatattatgtttaatgttgcatagtgtaatatctccccctttgttttattaaaaataatattttagctatttgtttattcttcctgataaatataaggtcactgtaaagatttgttttgaaatcccatgaggctctggatcacaacaccactaaacttctattctcccccaatcagtgtaatcatgtgcatgactgaatcccatctaataacatgagcactccatttatcaaattgtatttttctttgcagaggctctctttaacctagacataaattccttgaggacaaactttatttctgttttctcagtatattctattcctagtagctagtacagtgtactagaatgaatgaaatcaaagtgacctagaacatttgtctttaacatcttatttagtatttcaaaccccaattagctaaaacagcaccataaccctgaatgcacttggtgtgtgtaactcagcaaaggtctaagtgcagggatttacagcccaccacaccactctaacagcataaccaattccaaagacagagacctttctacattactgcaacagcaacacaaaggggaaatgaacatggagggtaacactgggtagattaagatgaaccaaaatcaacagaactggaactcatgcttgagaactacagaaatgtgtctagaatgaggtatatcactgccatggtgaagtaaagaagtcagaacactgctttaaaaagtcctagacccaatgctaagagagatttaggacattgagatagcaaagatccaaggtaggggtgggtagacacagaaatatcctaggtaaaaaagacctgaatcaatgttcccaacctgtcttcttcctggctccttggtaaagggactcagctaacaaaaaccaattcactggtggaggctggatggagtcattgtgaatcgtacctacactgctggtatggatcacctgcactgtttggcacctaaggagcacctcttttgatctaatgatttactagttttaagatatatttacaaagatatttattatagcagtataataacaaaaactaaacgaacacattaatgcccatctacaggagagtaaataaatacactgacatatccatactttgcagctgtaaaaaagaatggtatattgaagaccttggagaaaaaacccacgacatatagttaaaaaatattttttttcttaagactttttttttttttgagggtgtttctctgtcatccaggttagagtccaatggtccaatcacagctcactgcagcttcaaactcccaggctcaagcaatactaactcaacctcccaagcaagcatctgggactacaggtgtgagttttgtagtttttgtagagatgagggtctccctatgttgtccaggctggtctcaaactcctgggctcagacgatcctcctgccttgtcctcccaaagtgctgggattacaggagtgagccaatatgcccagatgacagattttttttttaaatgttaagaagagaattaacatagtgtgatctcatttttatgagaaaatgttcaccacatttataaatacttgtgtattttatatgagcttagatgggtattgaagaataaacaccaaattgttaatgctggttaaggaggaagacagaaatttaagaggagaaggggcctgagttagctcttccgtgatatacttctgtgttgtttgacttgttctggtggccatgtgtagcttttgtgctttgaaaggagaggctaataagttactattcttgaaaataaatagacatgtcaataaattttgaaaaatggatattaacaatgcaaatgtaaaagtatctcagatgtagaacaaacaaaataatgaaccccattagaacatacttgagatggtcaaactttgatgacttaaagctggaaagaggtactacaattagttttcctttgatttcagggacgtatttattctgcttatcttaagacagaacagaccaaatggttttgaaaggtcctagatggttctcaacatttgggtatattccaggaagactaagttaatttagctattcacagagtggcacatttgacagggaaaatgcaaatttgatcactgtagttagtgttcaattagccactcaaactggacggggagtagtgacagataaatagatatgatgctagggatactgcaatgtatttcacttttgaaagccttgtttgactttctcaggaacctatctaggaggtcgtatgaaatttgtattagattgtaaatattgttttggtgtacccccaggggattaaatagcaaccacataatattccttataatctactctaaaatacattcaattttaaggaagagatatagtcatccccaatcatccctagagtacttttcatgaatatttttcaacatgtgggtcatgatccataaatgagtctggagacaaatttagtgtgttgtgatcagcatagatctagattaaaaaaaaaaagtttgaaaactactgccttaaatattcccttcttttctgcatcctaccccctatgtactgtaccaaccagcagggaaaaaacactttctctcaagtctggataggcatatcctaggctgattttcaaggagctgattttgtcattaagaaaaatgttaagtttaagtatacatttgaaaattcaggagctaattctattttctctacttcccagcaaggcatttgttataatgggtaaatggctttgccttaggatttcttgctgagaaatagctcctaaatgcccatttcttgtactgtatattaaaacatgacataagaacaagggggatcacaacaataaggtcataaagctgcaatcaggccaggcccctaaggactgtattaacagcccagcactagcagtggatgtacagagaggagctgtgtgcaccctgagtacaacagctagtaaacgtttaattgaaaagttatctcttgcagctgtgctgccaacactcagacatctgaagacaactgtcaacagaattctcaggaaaagacatctactattgaagctctagcatgttcctcaacacacagagcaagacactgttctcaaagtccaacagctaagggtgacggctcccttgtgctccaggcttgtaccaccagctgctgaccacactgctgcacccagaggatgacacttgatgtggcccaaactcaacttcccttctttccctgcaaactaacccaccccgtacatccagcttgctaggcaattgaactgtcacccagttcaattaaatgaacaaatatgggccatgagccaagttctacaggcccatttacccaaaccagagacttgggtatcctttttgaattcttcctccacgtccctcttatcgatttctgttgatcttgcctcacaaatctttctggaaaccatccactcctccccatgccagcatcaccattctagctcagggtccactgcttgtctagattgcaggaacagtgtcttcactggttccctacatctagccttctctctaaactgttctccaaaggaagcgtagacactctgaggtgcatgtctgatgacatcatttctcttgctaaaagagaaatataaacaataacaactcttcagtggctgcccttcgccctcaggtaggtccaaattcttttaaatggacctacctgctcccacccccacaccatcttcaggtggcctctggaaagacttcttgagtcctagtggacccctctcctatgtagcctcctagttcccataaagcttctaacacactctttcggtggccttgtttctttggtctcctctagtagtctgtaaactccttgaggactagcattttgtctgactggtttccaacagctagcactgtgcctggcacaaaggaggcactgaataaccacatgttaaagactaacattgactagttcctctaacatgggaactatgataaaagctaaaccaggcgttggaggtcattgtgtgccttgtgcaatgacacaatgtggactttcagcaatggttaggaaaccatcccaacaaatctctcaggtacataaccatggaaaatctagggctagacagtccaatgacttcagtcacacaatctgaaaacaaaaaggagcactgaaatcaatgatataagtctgcttatgatgataaacaatgttaacattaagtacattttgccattaaagccatttcacataaagacattataccaaaaaacaaaattgttatagcaattagatttcttcatgatcctttccattttttaaaatccatgtttgcatttttctttaaaaagctgtaatcctaacatacatatatggcgaattttgtgttattttctataggttttctcaagtgggtacacagtcttcatatttgtagttttaatgcctgagtaaatgccatcaagttaatgtatcatacttaatcatatttaggtagtttctaatctttactaatttaaaataatgctgtaacaaacataaaatgatttccttcttttcgaattacgaaagaattttttctccttatcttagaagactatttcactatgttaaacctgcaagaacacatacttggaacaccatctgcaaaacaatacccaaaacagtgggtaatgtaagaatggaccaaaacagggcttgcaaatcagaacacatgcaggaaagtggggtatgagtggcagcggaagggaagagaagctgcagaaatggtatttagaatgcgttcctgaatgacacgggaggagcatttctggagtcactcttgtcacttagacagttaacaaagacactacctgcagcagtccctgttatggaaccagataaggcagtggcgagtggaccatctcagtagctctgagcatgcagcagctttcctagcaaggtggctaggggtcagatttagacataaagtgtagatggcattagtgcagcaaaggattctggcctgtttccagtagttgaggtactagaaaacaagagaaagagcaaacaagggtagatgggggattgccagggcagaagatttatttatgagggatatattgggaagggttagccagagaaataatagaatcccaacccactctgcctatgacaagtggccactcaaccacatttcctcctcacccccaagtctggcccttgcagagatagctaaacttctgccaacaaccggattcctttctataattaaatttaattcagcactcatgtaaatattatttctcacactactgtcttctatcactgttgcgttaacctcaacaattttaccattccacttccactgtcaaagaataataaaatcctcaaaaatacccactcttaattaacatgttctattttcttttcctcctatcctaccctcctgccttctaccagaaggcaaaggggatctaaagtcttcctgcaaacacagagctgtggtctcttgtgattacagtcccatttctatctctctcatttatcttatcaaaaaaaatcttataatatttacacatactctaagaagccaggtaactgttaagacttaaattcagcagagcttaaacaaaagaagagcaaaaatgatccagaagtcataatttactgttaaaatgctactatctcatgtaccatcccccataccacactcttccatgtctcattcaataccttacagagaccctttaagaacacaggctgtgctttcaggaataactgacatccctgtaaatccatgtaatgttcagaatataaagccagtgctctctgctgtccatatagcaccattaatcttatgaacagtaccacagaacaccctcccccagccccctccatctgctttaagtagggcaagtgttttactcatgttaatggttctgacagatgaggatcaacactgctttaatccatttgcagcctagcacagggaacatttgtcttctcaaatgctgttaggggcaagtacactggctgttagtaacaggagaagtacttcaggcagtgctcagtactctgaagtgactggctctgctttcctcatagagggaatgcaaaggaaattcttcccaaaatgggttcaagatgttctggctgccattgtggttgtgtgttgatcctttaaaaacagcagatagtagaattttattaaactaagacacactgaatcaatttctattgatttcttttaaaatgccagtgtatcttctcatttaccaattaataacatgcaagttctagaaaagacaaaaatgaatgcagttgaatttttcaaaaggattttgctgtaaaatgcaacagcccaattaggaaccacacacattttgcaatgatatacctagcaccaatttataacacacacagggaacattagagccaaggcctgccgtgtttacaagagcatgggccttagatacaggcacacacctgtgtccaaatttcagcttcaccatcttttgtcttctcaaccagctgctatgggtattgcaggaatccctggtcaagagacatacatacctaaacatatacatacctacatcttggttctgaattacctgaagatgtagcttcagacgatgtgctaaatatgccctagagatttctattctcaccccagaagtacaaagaggatttccatggagaatgaatacagtggcccgacagcctcctcccccgattttaggaaggggtcgcctgcctggtctccatgagaagtacttctttatcagcatctggacttcacgggcccatctctactacttatcgtcacgtgtttttttatttgccatgttctcatttctactccctttgttttattgctatttcttcttcaattccaccctgtctcccgtgcttccaatttataataataatcttatacatttcaagacttcagtacagtgcttccagctcagaaatctaatgaagaaaaacaaatatggcatgactcagatttatggaatatattgtatagagaacccaccagaaaaacccacttgttaccccttataggcaggattactgatttcttccttctgcccctcctaggctttcaatgctgttcagggtgcctcgatgagatgagaatagatggacaggagactattcttctagtttgggggctctttcttcttcaacttctgggtaaaagcatggcccaagattgaccacttaacaaaaatgcttactgacatgagagaagtttatgttataatgccagccattttctggtaagccatttttgcccaagaagagtatacatttatgtatatgttagatctcagcagtataaaagagatcaatttttcctctatacaacagagaatattaaaacattaatggcatgtctatctggatgtgggatttaaggtaatttttattttaatatttttctgactttctacattttatataatagttaacaattacattttaatcagaaaaacaaaataattacgtaaagttacttacgtccttctaactccattcagcaccctactttgaaagtcatcatttatgtctttacagtttaatctaaaatcatccaaaagtcaactctaattttgaagaatcaaaagattccaacctcccaacttgattaaattagatcaatgttgcaatgccctaaaaacctatattcttatattgagaccaacacatctctatgtgaacgatgacacttattaaagataacctagtctaaactcccagaaacaggcaatttagactattcctaaacatgaattttgatgggaagctttgattttcaaaaaggagttttcctcattctgctgcttacagaaagcctggatgtgcacaggcctctttaagaccattatcaggcaaattttagaccaccactatcggtcagaacaccattaccagccttgaaatgtactgattagaatttagaaaaggattctgaagagattcacttttactgggactcaaagaaatttggctaggctgttttattgtttataatcatagaggtaaatatttaggaaaatagaagacaacatgttatgaactccaaagagttatctaaatgagtaggatccaacaaaagtaccttgccatctataactgtagaatactatacaaaggagagataatgcacaataatcttagctaccttctgactgtgcacctgctgtcagaaaagtggggtcaaatctgactctgcttctctgggtttgttttctcagctacaggatgaggtaactagtccccagagaggaataagcgagatgtgtaagaacaaatgaaaatataacaaaaggcaaacctcaaaccaaaatgaagatcatctgcctggagagttcccttcttcacatataaaactcacaattacaaaaccaaaaatagaaaaaaagaaagaaaacaagctctcagacactgtgctgaagtatgagtgagtctccttacctgtgactgcagctcactgtaaattctgaggcccaggggggttttaacagttgccacgcagatatgttgctctccaaggaccccattccctatcaggtgcattatctgctcatcagcatcacttgttccttcccacagctgagccaggccctgatgtgctaacatggaggagaggtgtcatgctccctctgtcagctcggtgggtttagctggaagcatcctgtgtgtaaggtaaagccacaactctcttcttcaccagagttgttccttacctgtcaattttgtttctatttaagggtgatttcacccccaccaatgaaatgcttttaagggggtttttatagtagagaagggactgaactgcatttacacacattatacagattctcttcattcagttagtatttaccggatggcctctgcagcttggtatctgttcttccatcactacagtcaagccagacccagtgttctaatgtggttaagtgggcacataccctttttcctcagaccacactaacaagatggtaagtgactcactcaaaacacacatattgggtatctactatgcaccaggcattctgttaggtatgggagtaaaagattaagatattctcctaacttcaaaaggcaagactttcaggaggctgaggtaggagaatagcttgaacctgggaggcggaggttgcactgagccaatatcgtaccactgcactctagcctgacaacagagccatcctctatctcaaagaaaaaaaaaagagcaagccttcaaaagctacatgaagatactcacagggaaatattaatgcacttgatacttcctttcacatacaacatatgtcacagtgagttttgcatttacatgccagtcttcatacctgttggtgaacttctatatttatctacttccggtgcctcgcacaaggcctggcacacaggggcactcaatgcatgcgcatccaatgaggaactgacaatccagatggcgggaaggtataaacacccaatagccacgctgtcacaggaggcttgtgacgaggccatagtgaaggtctcagtaatgtgccacagacagcacaggagagttcagtgcagttcccatttgagataattcaggaagattttcttggagagaaggcatttgagctaagtttgggagaaggatttcaacagggaggaagaatgagagctggggagggtgtccaggtgggcagagcaccttaaatggaaacatgataggatttataccaggtccgtggctgccagatgatacgcctcacgcagtgggggctccagatctctcagcggccccatctgctcctcagtgtaattgatttaaaaggtcagctcccttatactcctaagacaagagctctgattcacaccagagaggtctggaaaatctaagctgtgtgtgcgtgtgtgtttgtgtgtggaggggaaggagacagagaaatgtcttttaataagcttctctaaattttagctttttcaatatgtgcaacttaattcaaatctatcttttcttccttcaggtaccaggtcagagaaaatttgtcagactcctcttaaaaacattctttcttgtctcagaagaaaggagtgtggattggtattatggcctctaatggaaacatggtgacaaagtcagctacctccctcccccaaacatccccctcccaagggttttggttccaaataagcctggaaggggacattcattggctgcatcaaattacaatcccccctcagctgcattaattggaatactgtatctagcacacagcaggatgagagtctcatacgcagagagagttgggcatctggagaagtgtgcagacccaaacagcccatctcaagagcaccaggggcaaatgggaccagtccagagggatgggaactagctggaaaacatgactagcaggggcaaatggtcagaattctctaggttctgtctgaagcaagacttgtggggagaaagggggccaaaggaatagagggctgacacccattagccctttccacatgactgctgctctcctccctcctctgcccgcccccacccatcttcacaattccccatgcaatttttcggttgtgcaaactgaagcccaaagagcttagaggatccaaaatcacaatgctggtaagtaaaatgaaatgtctgatgccaaaatcaatttttattcccctctaaagctcattaggggagacagctggcatttaatttttaaagtgatctcaaaagaactgtaatctcttaacattagaatttgctcttataagattgttttcccacttattagcaccatgcatttgttgagacggatttggataatatcgatattctgacagaacataatgggataactcaggtccttaacccaaagctctgtttctatttaagatagtctaaaagagctacatcagcatctgattctttgccacctaccctccctgaaactcaactggttttccatatgctaagcataacttattttttctggtttggatgggttagaaagatgctggaagaaaaattagaccaacttgtaaaactttactttgctgatctatggaatagcacacttttcccacatagcaatttagtttctttcttcgttttttgttttttttttttttttttggagacagagtcttgttctggtgctcagtgctgagatcatggctcactgcagtctcctgggatcaagcaatcctcctgcctcagcctctcaaagtgctaggattataggtgtgcacaaccacgcccagcttatagcagtttggtttctataaccctataggaacagaggtcaacaaggattatttttattaaaaatatcaaaagaagagatggacaggtataagtaaagtggttaagtctgaaactgtagaacatagaacttctgggtaaaatccttagagtccactgatggaggtatgttagaaggctaacagcttcaacttcgcatctccaattctataattaccaactgaaatagatgggcaaaccaccttaactttgtataaagtactcatgacacacactgtgcagtgggagaagtaaagaaaatgttagcctgagagtaactttgtatttgtctacaaacccaaatcttatctcctccaccttttaactgaaagggtcaagagagaaaaggctgcaaaggcaccagggaagctggggaaatcctgaaggataatgaacaaccacaccacgttaggccactccacgtggagacagcctctgcacgatggttcaaacatcaacttaatgaagagagagtgggcataaggggttgaattcatccaactttggatcctgactatctaagctgtctctaacatgaggtcccaattctctagtaatcagaggggttgagagggtgaggaaggagagttgtaaatgggagtggacttactttatgcagtcaaatcttaacaagacacaagccctagaggaaacaactctatggacctgaaaactgcaaacacacacacacacaccatacaaattgttctgaccagcaaagaaggcatgaacacttgacttcctaacaagggtccacaggcagagaccatctatcttgtttgaaattcttaaaatcctggttacatgattctaaaattcctggacacatgatgtcccaaccaacaggagattagaagtagcagattgaaaggctagagaaagctacacagatatcagcaagaactgacagctgacaaaaaggtaagaaagagaatcattattctcaaaagtgagcatattttaaaactcagcagtctaggagcattgagaggaactaacagctttacaaacttcaacctctcttgagtcattgccatccccaggcatgtgaaaaataattacaagtgtaggaaagaaatacagcatagtagcataacatattaaagagatttaggaattctagttcacactaaattcattgagaatgaagcgtgctgtagcatgacactctgcaatcttagggtatagtaacagaggccatataaggaaatgaatgaggaggtcacccctccttcagtaagttgaattctggattccttaatttgagaagaaagagcaattaagtgtatattcagatgagagccaccaagaccctgaggagatctgaaaacaaggactgtatgatttttttttaagtgcaatgacagtggcattgaggggcaacaatgcataaacctagtttgtgggactgactgagagctgctgctgaggcagcatagaggtccctgggatttccggggtattaacatgcctgtgcggcaatggatccttgcaactactacaggtgatctgaccatatctacacagtatccctggctcagtctttcagccctgcttctcacacagggaaatccagagcgtgggtggcaggggacgtgccagcaggaacttgaaaacacagtaagtgcagctccaggggctatagacacattttgtttgatttgcagtctcccttacaccccctcatttgggcctgttttaaatatgaatgggtttgatataaaaatgtgtttctgaatttcccaaggcccgcagcagccatggcgacaatgaactagaaatgcggtcagcctccctgtttggctactgccttccaaaattaacaccacttatttttcaacaaaaacaaatcaaacctcctagtctacttcatctatttaacctgccctgcctggcacttgagtgtgtaaagcctgccctacagcagcacttgatgtaaatgcaacttaaaatatttttatatttaagatcaacacatatattagagaataaagcaaaacacatactagagaaaacatctacctattagccctgggatgtcgaaaaagcttcaagcctatgtaccttttcaagggtcaccatgggcactttgcttactgaggggtagaagtttcctatcttgctttatttcagagcagtggttctcaaccacatgcaagtttgttcccaaaggacatttgggaacaatgtctgcagacatttctggttttcacaaccgggggaggatagggggagctactagcatctactgggtagagcccagggatactgctaaacatcctacaataaacaggacagcccccacaacaataattatctggcagaaatcctactttagcagaaatcctactttaggaaagttttcaggaagtgctggcctataagatacaggatactttgaggctcctcaacatctgccccaaccaaaccattccaaactcatttaaactttcacctcctatagtttatcctccactcctcatatgccccatcactactagcagtttttttcaactttcacctcccaggttcaagcaagttcaagcaattcttgtgccccagcctcctgagcagttgggattacaagcatgcgccaccatgcccagctcatttttgcatttttcgtagagatcgggttttgccatgttggccaggctcattttgaattcttggcctcaagcaatccgcctgcctcggcttcccaaagtgctgggattacaagtgtgagccacagcacccggcctcctctgtttccttttaagaagatgaggctaaaagcactgtcaactcactgggttgttctgaggatcagaggaacccaggatatttcagggcttagtcaagagttttccatgttctggggctcccaaacttaccctagaaaagaaagctgtaataaaacatactgtgaaaccccgtctctactaaaaatacaaaaaattagccgggcgtggtggtgggtgcctgtagtcccagctacttgggaggctgaggcgagagaatggcgtgaacccaggaggcggagcttgcagtgagcccagatcgcgccactgcactccggcctgggcgactgagtgagactccaactcaaaaaaaaaaaaaaaaagaaagaaagaaaacataccaacaaaagcaaacacatgcacctgtgaccaaaatagaacatcaaagactctctcacatcacaaatgtgagccatactttagacagaacccacgttacaaacaaggtcccttacagttctagtgcatgctcagaacaaattgaggggcaaagacctaacaagaggggcatcaacaaatctggtatgtggccctgctcaagcatgatcctgttatcattctagaaaggggaaagcagaagtaaaccaagccataaatgagcctctctcactcccggggtttttgaaaaggggatgtaaaagaggccatgtattatttacagccgaggaagcaaggacctcagatggtactgaaacaacgaatatagcctatatcaatgccagcttgtccacattacatgcaagccttgtggttgtctctggatgccccattgtctattacaaattcatcacaaccatgattggatactgtcaagcttcacaaaaagacaagagccagctgtcaaactaaattcttctcattgtttaccaaaaggaggcaaaaaagattctaattattctagccccacgaaacaggtaaataagaaacacagagtcacatgttctgccatagaacaactcacagttagaatttattctgcttccaaggacagccacagtgactgcaggggtatggctgcaaagttcatattatttaataagcaaattggatcaagaggctgaaggctttatgttttcatatttattaagtaaagatgtattcaaaacacaaaagcagaaaggggaagggaaaatcatggttgagggcacacatgcttttcagaggagtatggtataaagagaccagcccacatctaacctgaatgtcacctgtgatgtagtatgcacacatcaccctgtttaatcatgatgtaggcctttaaagtagatgctgttgattcttctcatcttacaagtgtgatataactgagtctcagaggaagaataatgtgcccagggccacacagctggtcagtggcagagccaggaattgaggtgtctacctgactccacagtttttaatttagataaactctaagcttatctaactacaaaaacagagcaaagagtattaggaagccagtattagctaacataaatgagaaatggatactaagcaagagaaagtaaatgtgagaaggggaacccttgttactctgtgagacacagctgaccttggtgcagcaagttttctgaatgcaaagcccagagacagcttcaccttggaggagtgaggccgtctaccaagccctgtgaaaaggagcacctgaacagaaccgagacaacctcagacttgcttcaagcccgtgttcacaaaataatccaatgggtgcactgagcccagtgacagcggctgccctcaccttgccctacatgtcctctttggaagagctggcatcttatatcacaactcgacagtcagctgccccttaaacagtgagactctcagttatggctctgggggaaggacttactacagaccatctccatagtttcataggtcagaagaaagcacctttgaagtgttagcccaattttacagttaaacagaagagaatgctgcttgaaggatcagatgatcaaagcagagattgaccatgctggtctgcaaaagtatgccctttaggtgtaagcccattttacaggtagcaaaactgagtccgagaatttaactggataggccatccaggttcactatgacttgcttaaaagcagtgttggactcaggtgactctaagcctcacagtctatcactaggttgcactatcttacccctttatagtcacacgatacagaataaataaaagtgaatcaactgagcggatcaaaataaaaacagaagtaaatcacttgagcaagcaggaggctggctccaagtgctcagagtctagtggaatcactgtttaacctttgaaaaaggaagtaggttaaatttaaggacatggatggatactaccaaacttaaattaaataggcaagttcactcacttttaattagccacaatcttaattaagcagccacctataaaaagcccagtaaccaccattaccagtgaagctatataacattcctgcaggagaagatccaggcttggctcttggatgtaggttatctagagagcctcattagtccactgagatcccactggctaatggaccactcaggggcctgtgtccgcctgaagtacccagcctcagtctcagcctagccacctgcagcccaacacccctcaacctacagtcttctgttagcatctgattaggtgttaaggtgtctataaggtccccttatttcctgcctgggcagctgctataacagtcttggccaaactgcagttgtaaagtgaactaagtccatagctaataggtcaggtgataagatgtgagagaactagctgtcttttgcttgtgttcacagcctgctctaaactggtagggctctaacaagccacttgatctatttccccaaggaactaaaaggtctaccggaaaggatgataacaacaaataggggtggcaggcaatcgcgcttccctagatccaggctctctggcctacatagcaaaggcaaaatcacatgcggaaggaggggctataaggattctccaagtgttaggaagctttaaatgatgcacaccaaaggaggagcttaaaataccaaggagaaagtctccagattaaaacaaagaaaagccctaattctaagggggaaaacttgttcctgaatcacagctaaagaatgtagagctattcagtattagtgtcccttctgctgaaaaaaccaaacagacaaaacaactacaaaacttagaatggggtggggtgaagagcaggagctagcacaacaatacagagatatccgaatggtttcagaatctgagcatgtcgagctgcaaaaaggtggtgccaggagaacccagggcaggggcaagaggaagtgtatgaaacatcctctgagtggattcccttactgggtgtggggaacaagggattgtctaaatctaagaggcagagaaaaataaatgtctctcaagtttaccatctcttgaacacagccccattaccatgtgcatggccatctgcaggaccaaggcaagtactctgaagtgggcaaggaagatggagtggagggcagagcatggtgcctggcacgaagcaggcatgaccctgatagctggatctcagcagcaggctggaagggcccatcctctctggattatatagatgacttaaaatgaacagaaatcatcaaatccaaaaacgataatcacctccttttagcattctccattacattcaagttctcaagcatcaccgagcagaaggtaggaggctgcttacctgcctttgctcctggtctcttcccatccaatgttagaagtgggaaaggctggtctcccccatctgcctccgcaccagtactccacatttttctgacccttcttcttcttcttgggtttgtgagcctgggctttccttctgtcattctcttcttctatctcttcataggaataagaggaggtcccctcactttttaacatctctccttctggccacagcctaaccaggaacatcgttggtcattgtggggaaactggccctggaggcccatcctaggcatggccctaccgaatccagagggcaggcacctagaagccttcctgctgggccatgttcctttagacaggtggaagccctcagctgagcaaaggggagaaacaggagtgcaagggaactgaagatgataatcatggggctctctgacctcacagtgatgcaggcagaggtttcctcgccacatctccgtacatcagagaacagaaggaagccaggtcatggggctgaggatgggcgacttgatttttaagacagcaggatgcaacagtttcttttttctaggacagttaaaatgacgcaattgattatagaacagcgatgagaaagagcagcccccagtgggccaccactccccatgaaggccaaaggctttaacaccttgatttaggtgtagtgtcaagttgttgtttttctctcttctatgggacaatgttggactttaactgattcaacagaaaattctcaagaatgtctgcatgtgctaagtactgtacaagccctggataagttaggttaccaccatgcacacctacctgctggatgcctagatttctttatgacgtatgcaagacagattcagtcatttgtcaaatatgaccattttttgttttccccccactacagaactagaagatgatgtttatgtcactttttgagcttagatctcattccagtgtgctggggctagtgccacatgccccttccttcaccatggcacccacccaccaggctctaaggaagcacccacacctgagagtaaccaaagacaatacctgaaatgttttggtaaggccaagctattagatcaaggtcaccctttgaaaacacctttgagatgtgcagtctagaaggctttcccttcagaaaagaacattctctggacaaccttgttgtcaacgttgataaactgtgaaacacaaggcactgttctttcactaagaaattttccctcttctcaacatgggattacatattgtctgtaggaaatttgtgagttaaaaaagcatatgcagaaaatagcacctataccccctacctttttataattagcatatgtcttcgtgtgtacttgtatatgtggattaaagacacacatgcatgggctttggatcgggtgtgccagaaagaatcctagctctgaaactaacagtgtgatgtgcaatttaacaagcttcacagttcgcttattattaaaatgggagttacacctccttttccataagtttgtaaggactaagagatgatacatgcaaagcacacaacacagtccaaacaaggaagaacctgctaagcctccttatacctccttctccataggtttatcaactaagagatgacacatgcaaagcatacaacacagttcaaacaaggaagaacctactaagtagtagatgtcagtatgaaagtttttccattaggccttgggattgttttctatggctgctgtaacaaatacatgaacttagtggcttaaaccaacacatgtttattgtctacagctctggaagtcagaagtctaaaaccatttcgttaggcctaaatcaaggtgttatcagggccaggcttccccggaaggctctggggtagaatttatttcctcagctcttcctattctagcttctggtagctgccagcattccttggctcgtggccccttcatattcaaggccagcagcacagaatcttccagtctctctcagactctgactctttgcttccgttatgacatctttttcttctgactctcattttcctccctccctcttatgaagacccttttgattacactgggcctacctggataatacaggataacagcctcatctcaagattcttaatcgcatatgcaaagatccttttaccatgtaaggtaaaatattcagtaattctggggattaggacatggacctcttggggtgggggtgggcaggcattcaacccaacagatgttcttattatattaagctatttgagaatggtaacatggggttgttggaaatattttctcctgtttgtctacattctttccataaaagtaacatgtttgttgtcaaatcctcttatctacacttttgtcatttctcccactaacgttaagcctaggaattctctccgtatcttgtcaggatagtgtttgtgtatgcgtgggtgtgggtgtatgtacttcactcattgttacaaattcaaacgatagagaaatacataaagtaggaataaaatttgttccccacctccaattctgtttctcctaggaaaccgcttcatagcctgggatccactcatccagagtttatgctattcattcacacactgcacttccatttgtttatggggtcaatttgtacacctaagtctatagtccagctgggatttactttagtgaatgctacatatacacctaggaattcctcctctcatttgttttttttctaaggaatgattaactgaagcacaatttgggtaatagttgttatttttctatgaaagtgtattttgtgacctattcctgtttttgtccagtaccacacctggggatcatctacctgccagttctacctcatgtttacaggtaccactattcacatggtggcagctgcacaaactgaagaaacagcacttgggaaaaattacgcaggctccagaggactcctatagatctaagcttataaagtaacataaacatcatcgtctagtcctgtgattggcggaaaacaaaaaatggtcatatctgacaaattactgaatctgtcttggatatgtcataaagaaatccaggcatccagcagggggacatggtgataacctaacttatccagggcttgtacaatacttagtacatgcaaaacactcttgagaaacgtctgttgaatcagttaaagtccaacattgccccatagaagagagaaaaacaacaacttgacactactcaaaaggcctcctggtctgcgtgggggctcactccctgaataccgacaatttaggaggcccaggcaggaggactgccttaagtcaggagttcaatatcagcctgggcaacaaagtaagaatctgtctgtacaaaaaaataaaaactaaccgagcatgcatgtgtgtagtcccagctactcggaaagctgatgcaagaggatcacttgagcccaagagttggaggctgcagcgaaccaagattacatcactgcacttcatcctgggcgacaaaggaagaccctgcctcaaaaaagaaaagaagaaagaggaagaaaaagaagaaaggggaagggaaagggaaaggggaagagaagaggcctcctgattccctatgatgagtgatgaatgctgctccgtagaaagattttggcaatcttgaattccttcatctatatatagtcattcctcgaggactcattgtgaaaatgaatctagatgtagtgtacaaagcaaacgcaataaaccaaggccaaaatagccataaaatcaaaaagagaacatggcccccacagcaggcctcacttctgttgtcagtgacaacatcacagccaggctggtggttccactgttgggagcagtgatgtttaactctgaatagaaccaggctgccccagaagcatccatgcccatttcagatagtgattgtgccctaggctttcccagtgcacagtgtggactaaatataccaaagcgtttgttgaagggaacagtaaaggaagccagctccaagaccacacacagatcacacttggtgtgaagacagcaatggacctcgtgagggggtcgatcaatatccatgctgcaacagcagcattctcaacagtgtgtgctcggaaggggtgaccagtgttccttaatggcacccagcatcgggaatgtagaacctctaccagcacatacaggcagaaagcaaattataacaaccaggacacagtgagtttcactaatagaattagacctacaatttggtctcaaccagatacaaactgtctgcttaggtctggtgtaatttacaacagcctcaaacatgtttctcatctcttcgtatgacaggcaggttaaactttctcagtgtcgccactcccctttaatgcatttccaattgcatgtgaaatttatcacccatctgtgggctctgggcctcctgagatcaccaggactctgcaaactgacacagccatgggcctgagaaagaaaggtaatcttaagcacccttagaagaaatgggctggaagaaaaagccagatggagggtgcagaggacatcctggcaaacaggtcagtaagccatctctggctctgggatgtttgctaacagttgaagatattttcacttctcaaactcctttgaccacaatattccccttctcaaaaatctttggtggcagtgcccttctgcctgtgttccaaataccaccatctggctttcagggtctctcatctggcgcctcctctctctcagctccctctactcttctacatgtgggtcatggtggtcaagtcacagctggcttcttttgcatctgtcaccccctcagggagaaggatgttttctcttccaactactgaaatcctaccatccttaaagagctagtgccaaatgacctcatgcatgaaaccccacaggcagctcaggcagcagtagacttcattcttttcgattgtttacttgtgcctcggttggcacatagtgtctttcactggagtcatgctgggagtcacttctattggtgatatacctatgggtgagataccgtaagtaatgggaaatatcttcattcccatctcccttgcttgtgccaacacctagtgctgggttttagaagcattgctggatggatgaatgaccctctttcctgacatcaggctctcatgacctgggtcacagtcaggtgcccaggaggttagcaggtgagccctgatggaagtgggtgaagtgagcaagagggagcagtagggcccatagcaacctggagaggtcatgtctcatttactaccaggcatctgcttctcaactccagcatttgttgctaggtgggaatatgggccccatgttgctagatactatgattttgtaagaaaatccagaaatagggatttttaagtgaaatattttgatgtataagggctacttaccaatgttaatttaaaaaatactcggtcgggcgcagtggctcacgcctataatcccagcactttgggaggccaaggtgggagataatgaggtcaggagatcgagaccatcctggctaacacggtgaaaccccatctctattaaaaatacaaaaaattagccgagcgtggtggcacatgcctgtaatcccagctactcaggaggctgaggcaggagaatcgcttgaactggggaggcagaggtttcagtgagccaagatcactccagcttgggtgacagaacaagactctatctcaaaaatcaatcaatcaatctgtgggcaaacagaagcacgtctgcaggttctggctgagtttgggccctgtgatctggaacctccactaatggtctttggaacaattaattaagggtgccatcctacatgtaacattgaaataaaagatgcagtgtctgccctcatggagcttaaaacctggttctggaaatgtaagatgtatacatggaaatctgagcaagaaacggtggcatatgttgatattgtggaattaggacttcagactttttggagccagggagctgtggtgggctggggggtccgctccactgtcacgggcttctttcttaaatacgttctgggtcgatggggagatgttggtcaaaggagatataattacaattcaaaagggggaatttttttttcctaaaccagttttcagacccccaatttttttttaagcccaaataggcaaacaaagagagaggagataggtgactgcttgggctaggggagaggataggtaggtagcggggaaagaagtgaagaatggctacctatggttatggggtttcttttttaggcagtgaaaaggctgtttgtggtgatggacacacaactctgaacacactaaaaaccactggattgtacatttgaagagggtgaattgtatgatatgtgaattatatctcaaagctgttgaaatcataaagtaaaataagctccctagcacacaggaagcctgatgacagccaatctctttaattttcacctcccactatttcttgggtcgtgggaggccaaaacaacaactactgatggcatcaaatattgaaaacttactatgtagggggccctatgtattaagcactttattccattcaaacctcacagcaaccccacatgggtgaattactatcctcactttatagttgagaagaaaaggaggcagggcataagtaatctgctcaaggtcacaggggaactgtgaagccaggacttgagcccaaggtggccaactccagagcctgtgctctgtgcaccaggctatgctgcgttccgtaaacccaggcaggagaggcggaggaaagcacagaggtgacactcgtgtcatgtgactacaagagtgaaagtgtgtctgataagcatctcagtccagctaagtgcaagctatggaatggtgcagattagaaagggggtaagaactggtggccagccacgctgtgagcctatataattcagttaacaggaaagctggtgcactgcaggccttctttgtcatactatgtataagtctagcataaagcaagtctcgtgccacatacagaaatggtatcacccatataaggcagttcagcttgttcatgtctttggtggtgtcattatttgagattaaagggttttggtatcttctttctgagctacttgatagcaggggctgtcatttgagtccttcttcccctaccacctcagcacctaacacctagcaggtgttcaagtattttaaagtaaatgagcctgggataacttatgtatttcaagagagaaggcaggaactaaataatatctaaccttttagaaatgtacagatgtggggccaggcatggtggcacacacctgtaatcccagcactttgggaggttgaggcaggagaatggctggagcccaggagttcgagacaagcctgggtaacatagtgagactctgtccctacaaataattaaaaaaaaaaaaaaaatagccgggcatgatggcctgcacctgtggtcccagctactcggcaggttgaggcaggaggatctcttgagcctgggaggttgaggctgtagagagcagtgatcatgggccactgcactccagcctgggtgacacagcaacacccccacctcaaaaaaaaaaaaaaaagaattaacagacagtatagatgtaacaaaactacctctgaggaacacaacaaacagctggcacaagattcaggagagaggctgggctgggttgggaggcgggaccacgtaggctgaggtgcatgcagtgaccttcaagtttctgagttgggggtgggctcacaagggttggatgttatatagaaatgaaatcaataggccaggggcagtggctcaagtctgtaatctcagcactttgggaggccgaggtgggcggatcacctgggtaaaaccccatgtctactaaaaatacaaaaattagccaggcatggtggtgtgcacctgtagtcccagctactctggaggctgaggcaggagaattgcttgaacctgggaggtggaggttgcagtgagccaagattgcaccactgcactccatccagcctaggtgacagagcgagactccgtctccaaagaaaaaaaaagaaagaaatgaaatcaatagaagagcatcctgcaaggacaggtgttaagtgtgaaccaaggaccatgactaatctagtgccgtgttatctgaggtccgagtgtaaataatatataaaaccacaagacacacagaacaggagtaaggccctctttgtgggaccaataatagaaaccacatgtagtaagctaaattgccaaatctaaaaacaatgtgggtagtttatataaggggtcctgaacctggagtccacttactttgaatagacaagatgtgctaatccctgaaactggacacaaaattgtatgagtgtattttttctgggaggaaagtttgctgcttccagattctcaaaaggattatctaaaaagagttaaaattagggttggagagtgaaagaatctgaagcagcagcattgcagcagacactgtgtgccatgggccatagaataaagtctcaggatgctctggtagaatggtgaatggggtgaaggcagttggattgcatcaccacgtgaatgagatcattattccccaatgactgccagcttgctgaagtaaatgaggccaaggagagagaacaatgcaacagaccaccaaggctaataccatcctctcctctccatgcctgactttcacaggaatgagtgacaccactccaaacatcctgaactttctgaagacaaccctgaaacccaagggggatatttttctggcttcttcccggtgaaggctattgattttgaaagataaaagtggccaagcaacacatatgggtatctgaaacagaatttttatttttaggaaccgtgtgtgagacactagaatgatggctcctagctggggagaaagggcatttcatgagcacaggtggaaagagttttgccatggatgaagtgacaaggtaagttttaatgtggaatttggaaagtggaggaagacacgtaaaatttatatcctagctacagtggaagacagtaaatatgacaggttaccacagaaggaagggatttcaaacctaataggaaaaaataaaagggagctggaatctcattataaatgcatggtctgtgagtagtaaacatcatgaatttgaaattataaaggaaaagtgatctcatgcaaatatagcaacaggcaggtacagtttgttcaatgaaagccattcagatggagggctcaggacagcagctctgtgggtcaagatgacttgacagtgaaccacgagttgctgtgaggatacatcactgcctgcctgctgatccccttcctgttagaaagcacaagactatacaagaaacagtggtggtaggggttccttctaacaccaagactatctggttcaacttaaaaaaacattctcccatattgaacttccctgttccacttagttaggctagacctcaggtctgcacagcagactgagctgacacaggaagccccttctccactgagaaacatatggaaatgtcggatacaacttaagttaaaaagcaaacaaagaaaagcctagccaaccttataagcaaaaggatctatccccagaaataaagagaaatttcaaagagcaaatagggggatttgaaaccagatggtgcccaggtggctacctaggtgaggccagcagtgaggcctgaagacacctcatcttgcaggaaactggtgctgtgccagaagcaaggaagggatttcgttaggcaaaaaatctttcaatgcatttggcttttcttgaacactaacttgaccatgtagtagataaagggttaacattctgccataggtgatctgcaggttatttggagtatgatggatggagaccaaacagttaaattcttatatggaaccccttacacagggggaaaaagcctcggatgtatccatctatatgcttggaactggaaataagaaactactggcctggctgggcacaggggctcaggcctgcaatcccagcactttgggaggccgagatgggaggatcacctgaggtcgggaatttgggaccagtctgaccaacacggagaaaccccatctctactaaaaatacaaaattagctaggtgtggtggcacgtgcctgtaaatcccagctactcgggaggctgaagcaggagaattgcttgaacccaggaggcagaggttgcagtgagctgagattacgccattgcactccagcctgggcgacaagagcaaaacgccatctccaaaaaaaaaaaaaaaaaacaaagaagaaactactggcccacagcagtgtggtatcccaccctccataaatctagggccccaagtcagatgaagtcctaatccatggctccttcttggtgactttaaaaacccaagaaccaactagcttttgcttttctccccagctataggttttgcttaacatatttcttgcatttcagagtcaatgcttttgacatcctcattttccaaacttttatgaaaacttgaaagaaatattaaaaatatgctctagattttatgtcaagccttgatttttaggtgctcctataacttcaaagtaatttaattatgcaggaaggttggtttagtaaaggttcattaatgcccaagacaacatgcctttctccttaaaggggaaaagtcttattctgctagagggctagattaaaatcaagcaagtttttacacttaagctaattgagaccaggggagccaggaatgaagtggtttcctgtcccgccatccaagtaacacgctgtcaggcaggctacactcactccagccaataaaggggcaacggcagcaaggaacgaccccacaaccccattttcatcgctcctctttccctcccagtttttactggctgccagcacaacccagtcaacagcaagctttcctttaccacacaggctttcctccttccctgaacctgctcaaccccagcctccattacaaatttccccattaaccgaagccaccaaaatctgctgtctgccttccttgccttagacacttctgaatgaattgtgattaactgattcaatgttcagttttgcaaaagggggaaaaaaaaaaaggaaggatggggaagaagctcaaaacaaataaagcaatcccggggttgtgctggagtgcacacggagcttctataggaaatgactttttactagtcccttaaaaaacttgcttaggccaagcagccactctttatctagatttgccaaaatctgttctccaggactgataacctacactggggtagctccgacactgggtttactttgaaagattttctccagttaccgccagctgcctatctgtttcgacaatacgtacatagttagcctacaggatcatcactgtcattcttttggacatgttcatttattagcagtcattcagatacgccgacagtgtatttgcaggggacacaaaaacacacacgcttatacacacatggtatgttagatgtttaagactgggaaaaaacttaagtcaaacaacacataattagcctctgcttgcagagatgagacagtttatcagactttatgacttctgttcccattccccagctcccccatataccttctactttcccctcagccccaatgcagatgaaagtttgccctttatttaaaaaaaaaaaaaaaaactttttctaggggtatagaagcttcagacttttgaactttatggcgtccgtgttagaagagtgacttgacatattctcaaccctgtttttcatcaacaatgcctgctcactgccaagtttagatgtgactttaaattgcacccaatccggcaaaataatatttcactgctggctaccagtaaagcgcatacaattttccctttcagaacttctgagccaccaagccaggaaatcttttggtgaccactccccttcccatttgtagagagaagccaatactcaggaccaggggctggacttggggaatacaagggttcctgcatttcagccagggctccctcttgccccaccgggaaactacccaggggcctgaacctgcaagaggtagacaggcactgtgagctgggccagttgccccgcttgtgctcctaccttgacatgtgctctggtcctccttgcccaagaggtgtggggatgggtgtggtggaggcacagtccggggttggtctcgcctgccgcacgcctgttcagtagccttttaatgaactcagtgactcagcgctgtccctcccccaccggcctcggatctcattcctctcaatcgcactgatgcccatgtgacagcacgttgtctccaccgagactaatcccttatcaataagagctttcagcacggcccagaccagattactctgtctcacaaccactttgctgacctgcccggggggccaccgaatactccccgagcgcatactatttacagaagagtcaagataagccggatcacttggcgtgattatttcgcttccaaagtttgtggctttaacaaagcaaacccacattcaaccactcaaccaggcgccgtgcaagccaccagaatgaaaaaaaacaacgctggatcttacacacatgcagtaatcaaaatattacaaataaaggctacatgtgaaatgataggttaagatgcgctctagacaccagatgtatggagtttgctattagatttctttgccatagatccagcgcaaggcaacatggcatttcattgtcagattaatgtggacataataatttataagaaggctttaaaaaaagtcaccaagattggtccttaactttgcccattcagattcttaagagcaaaccaaatttgaggagagatgccggacgccaaactgagtacaggctcaatatcccctattttccgtccttccttttccggcaatttttatcccactcatctctatccacagcctttctgggcagctgagatgaataagaggaatgagtataaagcctacaaacacggtcaaggagatgactgggagtaactacatctgtgcctagagaatggtcttgacggtttgcaagaaccgtttcatcagcattatgggcaagaacaagaaggccaaggcatacttaaaatcatcacaaagcctctttctagcactaaatgtgaagtaatgaagccatcacacagcagatgaaggcctttgcacacaaagctctcttcctcagaaaagctctattgattgatcttgaaatacagatttttagttctaaaactgtgtggatagctagttaaaattcactctctttccctccgaaatgcattaaaattctaaaacatgcaccaaattctaaaaattaagaattctaaaattctaaaatatacaccaaataaaatttatttttagtattaaaatacctgatgctcatttcatcaagtctctgttctctcgtctctgttcaacgcagttaggcagatctgagggtgctgcggagagtatctgaggagaaatgccaggcagagagcgagcaggccctgagctgcagagacaatgctccaggcagaaaaccatggctggcaggaaaccaggagaaattgtgcaagcgaagagccattccaaagctgttctctgtcccacggttatgatcacaggggagggtaattgcatctacttctgatcatattaccttttgccatttgtcagatagcagacctcaaattcaaggtggattagtctggaaaactaaacaatcagttttgaagtcttacttttatatccatccactgatcaatgcaaatatgaatagtacagaaaacagtcaaacacctaatgaaaagtggaaccctgcagtaactcccccgtattcaacagatgacagggctaatgcagggagtttggggctatggactggttttatagccaaagccacagataattccatcaccaaagactgcttcctacttttggtgaaggaagcaggtaatttacatgccagtctcagttttttcctcctttctctctccctcaccccctgccttactggtatttttctctatgagttcccttgatgtattttgtgttggaggacccagcctgcagctttcacaggaagggctgatgcagtgagaagagcaggatctaagaatcagaggaggtgggtttgagatctagaataaacagttaaaggcctagaggcaaggagcttcacttttgagccttaatttcctcagctttaatgagaacactacctgccctgcttgcttactaaacaggactgacctggtggtcaggtatggaatgtgggcttgtatcatagagaaggtggacaaaacaggatggagaaaacaaagtctgagcccctgctctgccatgtcccttgtggggcttcccttcctcttctaggctgcatttgtaaaatctgctctgtgtatctaccagggtcaacaggaaacttaagcaatgcatttgaagataaatattacaaaactgacgatgctatcagagggcatgttcttaccagtctgtccaaagactatgttttaaaagcatgaatagctctaaagttgaaagaaagtcttaaagagtatttttatattacactatagaaaaatatcttatttgctttaaataacgggaatctaagtttcaagtcagcagattagaggtgagcgggtagcgaaaccatgaggggtggcatgggtagatagagcattctcccaagtaagatgactgaagccagagctgatggggctaacaatgacgttcagtcaacgcagtgcatagaccagctttggaggccagggcatttctatagaaggctcctgaagccatgccacagagatgggtcctttcctgttgcttcactgcctagcccctttgtgagcatggtgagaagcctgaaggtggcagcaagcactgtgtgctggcatctgcagtgagcagtgacagctacaccactggacaactcaatcctgcaggactgctccaagactgaagttcagaatgacaggtcactacggcttgcagtcattgactcccaacacctcattttacatacaggaaaactgaggcctggcagcaaggtggaggcactttcccaagaaaggcagcatccaagctttactgagtgccctggtcctcggatgccccacccagtgtatactcactaccttgggatgtttccccctaactggaatcctattgttcacccatttgctcatatgtgtaatatataccatagaaccttaaaaattatctttgacaattttctcctcttggctttataaaaatctgtcctttccttatgcaaattattttccaaatatttaaatttttcgggccgggcccagtagctcacgcctataatcccagcactttgggaggctgaggcaggcctcccacttgaggccagaagttcaagaccagcctgggcaacataacaaaaccctatctctactaaaaaaattagccaggcatggtggttcatgcctgtaatcccagctacttgggatgctgaggcacaagaatcccttgaacctgggaggcagagattgcagtgagctaagattgcaccactgcattccagcctgtgcgacagagcgagactgtctcaaaaaaataaataaaaataaaattttcaggcactttgaggaaccctagtcttgaatcatcttgtacttaaaaagtaagtaaattaggtaatttattttgtgaatccttcgtaatatttgtataaccccttacagttttcgtaagctttccctcatttgatcatgacaatagctctgtgatgtaagcaagacaggggtcattacccttaattttggtggtattacagagcgatgaaatgattcatctagcaccagaactaaagtagaacccagttcttcccaacactatcttggtcctccttactccattaattcaaatgagagcctttgtgtagtgggcactgtagttggaaccaagggggcaaagatacgtaaaacagagttcagttttttccaaagagctggcatctaggagacacacatacacacaaaaaggttacacatgaatttgggggttagagactttggaatcagacagattcgtatttgagaccagacctcactgtttactagttatgcaacggtgggcaaatcattctgcccctttaaaccacagtggtcttacctcacaggattgtcaggagaattgaatgagatggcagaggaaagatgtttagcacagagtctggttcatggtaagcatccagtacgtattagctatttttattagcattaatacaaggcaatgacagagacacatgaaggctattaagagagcaaggtctggggacacctatcctccatcgtggagggtggggggtggggtgggcgggggcagtgtatctggaagaactgaatcttagagaatggctttaatgattgttcttacaaaacaatacttatctttgttcttttgttcttttcatctgtccatccacgtagttatccaacgcctacagtgagcccagcactttacaaaatgattctcagcagggctcccttgaataaagggttttcctagggcacttaaaatatgagcacatttacaaaaattatactcacacaccttttcagagttatacctactgagtgaaatgaggtatatcaatggtctattctgatcctagctagaggtaacagcttaagagaaacaaacctataaacagaaccttaacaagatgtcctttggtaacaaagtgaaaagtccttcccctggaggccacgttaaagtggtctgctgaatgagaaccctactctcatcagcagaggtggggcctgagctactggggacttcaatcgtgtctgccttcaccattcacttaaaagagggaaattatccagctaaatgcttactcatatgcaatatctgcttgtcaaaggtagcacagataataatcccatactttccactttgtatgatgattacaacttcctctccattcattctctcaactgacctggtagccaaatgagccaatctggataaagcagagatatagccaaggtgggctggcctgtgaactttcttttgaaaatgggttctgctactgaagatatgtatcttcaatacctaacatagtgacatatcacagtcaccagatatgatactttgtaagctggataattagttcaaatcaatcccttacatggcacactttgtgagaaggaagttggaacctatctgttcccctgatggacaagactgattcctttctacagagtgccttgaactactgcagaagaaaaccaccacccttcaagagcacccagaagctgtgtgcagctggactcctggaaggctctccctgccttgggatgctgccccgtataaaaaaatgtaggaccaggtcctctgggtaatggtatttgtgactttctttctcaaagaactaggttcttcgagatgggattagacttccattactatctgaaatgtgaggtgaagaaactgaaaaaaaagcaagcctttcaatcatgagaaaatgcagttgctatgatgccaaaatagaacactgtgtttttaaggtttctagaaactgaggcaaagaggagtcacagaaaattcagctagcaagagtatcatgaaaaaaacaaacatctttgtttcttaaatgctttagagagacactcttacctgaggaattacagttcctcactgtattactcaaaagcaatatgtccccaacatcatggccacaaaaacatagatgtagatttcttatgctctcaatatattacaattcgctagaaaattcagaggcctaacaccaaggtcagatcctgaagccattctctgaggggctaagggtcgtggtatatattgctatcatatagtagtctaatatcatccaaggattgatcctaaaacacttcaaaaaggaaattgatacaggctatctcttaaattaccttctatgtacatcatctctcacaaccagagtcttaacagaagctgtatgtccaacagagtgagattatattctgtttatcaaaggtctgggttctcccgagaggctcttacattccaagattgatgctctaagcaattcattaattcaagcataaaaaactcatctgattttagggaacagttgacatgtttacctaaagttgtaaaaaccagacttattaaaatgcctcagaagaaggcttcaaaaattatttccattctcaaaatgttattgctcccaattgtcatatatcaatggctccccagtcagtcatgctctgcctaagcaacattacaaaacatcagacggtgccgatggcaattccactgggttcctccaaacccagcccataaagcctacagaggaaatagaaagatgacagaatgcatacactttatttttgacctatcctgatttccggcaggctttggatatgggacgacttttatggctgcaataattttattgtaaagacccagtataggaatttcttctgggaaaatattttatatcaagttgtcaagcaaaaagcaaggtatgtttgttctcactccaagacaccactgaactcagagcaggaacacagctgttttcaaacattagactgcagctcctagtgtcagtgggtcaggagccttccatggccattcctacagggaatcgtgtacttcctgggatgtcatgtttatggtcgggctcccattgcattcatcttatttactctttaaaaagaaaaacaccaagtctgaccagaacaaacaaacaaacaaaagcaaaacaaaaaggggggaaagaaattacttaaatttataaatgatgtgtctagagtgctatttcatttttgcttataaaaatggcattcatgcttaaaaccgtctatcggagtgataagattggtatgatatggtctccacctgacttaaaggacctatgtttgagcgttgttgttctcttctcaccgcagccataatgtgatataccctatgacattcattaggctcttgtagcacacatttgacattagcacagggataaagtagggcagggagtgtggtgacagagctgtgggtgggaagagtgaagctttaaaccctcaacagtacaacttttcccctcccagagaagtgactctaaccaggaattacagggcctctaaatataccttcccataatttgtccatattctctcttccttcccaattctctcttaaatatttattctgtgttaatacaagtgtggtgttctgctgaactgggtggtggtttagaaaatgcatatgaagcccatatcttaaaccttctgttttagtctggaatataagcttaacaacatcttcccccaacacatacataaaaccataatcaatatgggacagctagtgtattagataaatgtgtatccccagactcagtgcaattgggattgagaaagggactgagaatggtcaagtacaggtgtgatgagaaatctaggtcgcatttgcagaggtggaaggaaagaggatgtttgggggaaacatgaacccaggtactcaggcaaacatgacacgaatgaatataggaagaaggagaatccaaggttcatgataccagggaagctccctaaagttagaaagttaatatctagtaaagatagaattacatgaacaataatttactttgaaagagtgttgcataggcaacagtatatggctgtcagttttaacctattttccaggagctaagatcgaccctaaccctaccttaccctacttacgtactccaaagatgttctgctgtcacttgaaagatgcttatcagaaggcatcatcattctagaaacagccacttcaagctcttgaccttccctcaactctaaaggctttgtaaattagctcaatggaggttagaaaagacttctcactggtgtaattagtggtgttagagatatgtggattgcctattaacatgatgctatcaattgactgagtctcttccaaattcatgttaaaatcctcatccccaatgtgatggtttcaaaaggtgggccttaggaaggtgcttaggtcatgatggtagaaccctcacgaatgggattagtgcccttacaaaagagaccccagagagctcgcttgtcccttctactatgtgaggacacagtgagaaggtggctgtctataaaccaggaagcagggccctaccagatgctgaatttgctctcgccttgatcttggacttcccagacttcagaactgtgagaaatgtctattgtttataagccacccagcttatggcatgttgttatagtagaccaaacagactaagacatgtagcattggacacttcatctgttgatgacagagatatgaaagaacctgaaagacccagccttactctgtgtaatggtgcccacagcttgattctaaaacaatcttctacatagccactggcttggggggttcttgttgcctaatgctgacaaaggaatcctgctccatgttaacttttcatgtaaggtactgtcagcatatctaaagatcagaaaacaggctcagtgactgctttttatgtagctgatgtttatataaatagcagaatttggtaaatgtgtacttttgtatgtgggaacacaattgaaggagacctttaactcattatctcaactactggaggttatcctaaaactccccttaattaaaaataaacaaattggcttagaggttagtttttagcacacttgaatgaagacatttattagaaacaaacatgaaaactctaacatttttagaagcatgaaaaattggagtagttatgtgtgacacatgcctaatagcaaacttttaaaacaatgcatttttattaaatcagaacctaaatacacacacagtaaagtacctctaattttcaaacacatggaatacatggcttccctgagagaatatctctaagatgcagtaagatcccagacaattatagaaagattatgtatttgcagcttagtcaagggcattttactaaggtctggcatttaaaaactaatggctgtttgataactaacattccactagttctctcaataataacaaattagtaaataaaattatgttggtacatacatatataaccaatctttatcaattcatatatagacaatacacacctatctaatactcaaaggcaagaaaaagccattcccctttctctacaccaagcagtatgatacacatttcttgctcactaatcttgaatccctagatatttgaacatgggcatttgttgctgacagccaccgccagacaaagctccatgacctggctccactccaggagaggccacagagagggcttcataccattcttggaaagcattcaactaccacatgcagcctcatctcacaccgaaaaaaaaagatctcacgttgcagacagcttcactataatgttaacattcttggttgttacacacacatttgacaaaaaatgcaagcctctagatatagccacgtttattgtacaatgccaatattgtgttcaaacacaaaattctctatcattttaggcaacaccacctgcagttttattctctcacttcccaacctcttaagccaaagaaatgagaaggtgctcttccttctattcactccccaacacctaaatacaacactgggtaagactcagttcctgcccacagggagctcagagggaggcattcctgtactttctaaattgcacaagatgtcactccccctctaactatggctaaaaggacgaaaaacagacaaaaacaaaatccaccttgctccagctctttaagctgccctcctgcctactaatacctttcattctcatccagttctgatgtttctttacctgtcatttactttaattacttcaaacacatgttctttctggttccagcgttccttctttcccaagtgtacttgttttttttgtgtgcgttttaaaattctattctgcaaagcttgctttcccatgaaacccagactgttttctacaggattttgataagccaaagtgttgctgtcacacgcaatgccattgctgctcctatttgcctctttcctagggtctctgcaactttctgcgaaccctctacacacctctctaactttccgctgaaaaagtatgctcatagaactaggaataaacattaaagcaatcagaggcctcgaggaactaagtttagcaggctaataagaaataccacaaggggttaaaatattaagcagaatgtgaacactgccctaagagttacaagtgccatgcaggcttggaagggggagataaagaaatctgttttttagatgccatgtgaaatgcaaggcatggtggtctcacagtgttcatggctttcagtaaaggctcataaccaccatgacccttcaggcagttcacagcaagcagtgtcctaataaaaatatttagtcataaaagagaacaacgacataacctgaagactgcttggacccttaatgatgaaaggctgactggctacactgacaagcggctttgacaacctcacgtcaaagcacgcgggtaagagagaaaaggcaagctcagggctcttttcagtactgagagtggtgggcacagtagctctacttccctgtttctgaagctgcctgcctaaaaagtaaggttggtttctaattcctgacacgtgttctctttcatacccactcacagtgaatgacaacttccctttgttgcctctgtcactcagaattctgtaattcacttacccaaagctactttgtccgaaagaggacagacaaatcagctaatccttaagtccttttcagcactaaagaatttccctgcagggtgcatcatttattttttttctccacttcctaagtcctcctcattcctaatgcaaagaacacaacatgagggacccaatcagccaagtccagaatttgtaggactgatgttttttgcaatagtattattgtctctctcatttccctcctcccacccctgtccccatattccggacttaaaatacaaggtcacgcacaatggtgtgaattaacaaaaatccaaggccacacactgagcagctccaacttcagccatgaaaagcatcctgggctacggccaatgccctcctctcattcccctggtgctgctttcaaagccacaaagaacgacggagctgagaaacagccccactcaaccaccaggccacatcccagtggggagacactaccacatgctcagtcctctgcccagagatcctttctccaccacattcacaaactctgtttaatcaaactccatgaactgagttgccttgcgtgttcattcgctgcgctcctatactgggtgccatggaacaatggtagatccttgagtagcttataggcaaacttgagaatctaagagataaatacttaaaatgtaaagtgatgtgtactagatcataggagggcatgagatcctatagcaggctaggtttgtttcttgactccttctgcttcttcatccaagccccagccttatcagtatcagtgcctaaaggcttctgcagctctacaccactccaactttactcactcagttcaagtcatcagcatcctcctcccagatcacttggatctgctaattgttcttaccacttctaatctcaacaccctccaagccattttccacactgtagccaagcgcaccttctaaagctcaagtttcatgtggtggcctgcccattctccatgtaaaaaatatcagacaatggctcctcattgccatcaggataaagcccacattgcaatgccatttgtaaccccttctaccttccccatgctctactggcacctggttcagccttactggaaaacctgcagtgaggctgaacctccaaatccccatgctcaaccctgcccttggggctttgcacacaaaccatttcccttacttggaacacaatccccatttcccttacctggaacacaatcctcatctctcccaccaccccctttaccctttacttggctggctactgccagccctttaagtttgggctcagctatcacttcctccagaagcctttgctgacaaccctaggcagaggtgaatgcatcctctttaggtctctgctgtcagacttccatgttcaactacactgtattttagttgcttggtataatagcttgtctatttcctctactagacttcagacaacttggtggggggaggaaagggagattagaatggaaccttaagagatgtttcttaatatctgttgaaaaaaggatctcaagtatgacttgtttacctgtgtatctttgtccttagcatagtgctggctatggtttgaatactgcacccttcaaaattgaggtattgaaactcagtggccaatgtgatagtggttaagggtgggggttggtctttgggaagtgattaggttatgagggcttttgccctcatgaatgggattaaggctcttataaaagacggttcatgggctggcgggggagggcggttcggctgacttgcccttctgcctgccatcaagtgaggacacagtgttcttcccctccaatggatgcagcatccaagccctcttagaagcagagatcagaacctcagcagacaataagcctgccggcgcaatgatcttggacgttcccagcttccagaaataataaataactttctgttctttattagttgactagtttctggtatcccattacctctcccttcactacgagagagcctcagttactatctccaggccaagttgaagccattagttagtcattctacaaatatttagtaaatgcctacactcagtaggggctggaatgaccacactctgatctctcaaagaaaccaccaatcgctttgttgttcaatcaaaactgttgtttctcagttatatcttgtttgatggcaagcccttctcctttccctgttccagaggtcaggaaactatggcccatgagcaaaatctgaccttctacctgtttttgtgaataaagttttattggaacataggtatgccccctttatttacatagtgcctatggttgcttttgctgcaaaaatggcagaattaagaaattgcaccagagaccatataccctgcaaaaactgtaatattttctgcctggtccattacagaaaatgtctgccaacccttgccctacctattataacttatgggtttccttcctacctttgtgactgtgactggacaggctcttgttattctgctgcccaatgaaggtataagaagtcctaggaacactagctccccaggattctgtcagtctgctttttaacctgacacgttctttgtctttctaagatggttcccatggcccctgaacatccctccatcagtgacctatagtataaataatctgtaagcatttttgtcttccccaacagacgtggctccttgaggacaaggcccatgtcttacagacataattcagcacagtgacaggcacacagtagccatcaaaaaatgttaactaggtagatgagtgtttacaaggtatttttaaaataactatatttaaaggctcctgacaaaatgactatatttaaaggctcagccatagtcccttggtgagaacacagtcattcaactgatgaaatttctattcttttgtatcagttttgacttgcctatagatgggtgacaaagtagaaaccccgaataggggatttcccactaggataagggttgaaagtctgactcccgttcactagctgtaggatcttagttaaggtgctcactctcagttgcctcctctgcaaaacgaagacaatgaaataattcctctatctcacagggtggctatgaaaccaataatatgtgtaaaatgcccactacctttgtcaagcaattttggtgctcaataagtagaaacaattattactatggacaaagtcttctgccttaaggctccaagtacactgacaatgaacatggctagggtcgtctcagctatgttatagcatcacacttgatcttttcatagcaggagccctgattcaggtggtagtttcatattttaaattatgaaaacaagcagctaggtcttatattaatactaatccttcaagataaaagaccaaactccaaaggaggagcttctctctctctctcccataaagattcattggttaaaaagcactagtggtgatactaaattgaagcatcaacaaactgttctgtaaattgtcttttcctgatagaatttaccataatttgttttttcagctatagcacatagcttggaatgtaatgcacacattttgaagagtagacattttgataatcaaaaggacaatattaagttgattttttatagccttattactgcaaagatattattttctaagctaatgtacatacaaaacttcatctttctttaaaggtaagtacatgggggctagaacagagatacttgagttttgtatgcatcaaaacaaaaacagggagtaataccaacacatttagcaaaaagtaaaaaacagatcccactcgtgtatgaaaatttttggaggagctgggaatcaaggaggaaagtggggctccaagctaatcagggcaaactctgccttccacctgtgcccctaatctgatgctccggttgcatgacatgactatgacggatggccagggtgctgtcgtttatcttttggagtgaaaccggagaactcaggcagagcccagtgagcacttctcatgaaaatgctgtcctatctaatcccaggagacaagagaaacactgagaggtcagaaaggacatgagcacatgagtgtgcacaccacgcctgtatgttcctttcctcttccaacacattttcggggactgaggaagtgtgccgcacatatcccaaacagaatttctcagtattttctgcagtttgatctgtcccatgctgaccagacactgtaaatagtttagtttagaaagaagccagaaatcctaagtgagcatctggctcttaagaagccagaaggatggttgcacgggggtgggggtgaggtgggaaactggggggagtatggagagtgggggggtgggggagccctttacccagcttctcttactcacgagcactggcgacaagcgacattggcttatcgcctcagctaggataaataactctaaatgtgtgctgggtaggagctttcatgccctggccttcaatagttttattctttcacgtctctaacgtctgcagcttcctgagattggctggtatttttgtcactgggctttcgggctgggggctgggcagagctgaatgtcaggcaagggtaaagggcacctgtgatctgctgagtgcctccgctttctcctccttgttcctgacattaccgcccgctcaaccaggagggcagaaggtgggtcagaataatcagttaagtgtattagggttttctcctccttcactacaaatcccacaagtgcaactaatgagacaatgcccagaggtagaaatgaacttcataacaccaaagtacgggtgtatttcaatttatgcgagttaaaaaatgttaaacaagaaaagcaaataagtctcagagctgttttttcacattacaaatggaactcaatacagattttagaatataaatatcctctcaggcatttaaaataatgtgttcacaaggctttgatttgcacatgatgttggcaatatcttttgtgcaagatagacttggggaaaaaaatcctcagttttaaatttttagttactttcaaaataaaagatgtaaattaataactattcttccgaatagaaggggacgcattataagaatagcttttgaaataatgtagaagaatatccacagaaattctcaacatcgtatggataatatgaaatccgtgttttgttttggttttgaatgggagtaaaggtgaagagtctaaaaaaagaaattttttaaattcctgatataacagagaaatgcagtaaaacagcaggtttcaaactgtcctctggctctcgagagtgtttccaggtttctacaaacaataaaatattggctgttaaacccagaataaaacacccgagaagataataacaagttcgctgcttttccttttgggttgttttaaatgttggggtgctgaagatttcatttgaacaaagagttctgttaccaaataagtttggaagctattgtttgggaggtgccgtgcagtctctgtacacaggaaggttaaaggaaacggcccttggcaatgaattctggaggcccttcctggggggccctgaactcctgtgaggacttccaataaaaagtcagtagcattaagaatcagcaattaaaattcaatgatcagctgctatgtttaaccacaaatgtatctaaaaagctggtgttaacatgtttttattttcctaatagcttatttgaaaaaaggtgatgttaaaacaggatctcaaaaatagatgattttgtattacgttagtaatagtatattattgatagtctataatcattgctttaaaatttcaataataggtcccagttggaggaccgtataatgaattcccttataccgattttctctacttttgtatatggctgaaactttccataataaagtgaggtttgttttcttaaagtcccagcaggccagaaactatgttaaaggctaaatttcatgtccctcaaccacagtggacaaggtttagaggagtgctataaagagaatattgattcctcttcatccagtccaacctggccttcagaatgactcccactaatgtttttcctatgccattttctactgtataccacacacccaaccaacttggtacaaataaatgtgactcacaacatcctcccggtcagtgccaaccccttattgaaattagatagtatacatcctccgggttcattctttttctaagttaatttggctaataaaagtcctttacatttccatgttaactttggaatctgcatgtcaatttctttttcttttttttttttgagacggagtcttgctctgtcaccccggctggagtgcagtggcgcaatctcggctcactgcaagctccacctcccgggttcacgccattttcctgccgcagcctcctcagtagctgggattacaggcgcccgccaccacgcccagctaatttttttgtattttttagtagagacagggtttcaccgtgttagccaggatggtctcgatctcctgacctcatgatccacccacctcggcctcctaaagtgctgggatttcaggcgtgagccactgcgcccggccagcatgtcaatttctactgaaatgtctgctgagattttaattgagatctatagatcaattgagagaatttatatcatagcaacattgagttttctgatctatgaatacagcagcttgctccatttatttagatcatttcttttattaatgtttgtattttttagtgcacgatcttgcacatctgttgtcaaatttatctctaagtatttcatatttttgacagattatgatactgttttagaatttcaatttctgattgttcattactagaatacagaaatataatggatttttctgtatttccttggtatcttgtaaccatgtaaaattcacttattagtcctaacaaaacagttttctttgtagataccgtaggattttctacacagacagttatgttatctttgaataaagaaatttttacatttccctcttaagatctggaagccttttattgtttttccttgccttactgcactggctagaacatctagtgcaatgttgaacagacgtggtgaacacttttagttggcacctaatactaaaagaaaagaagcagtgaggccgggcatggtggctcatgcctataatcccagcacttttggagagcaaggcgtgtggattgcttgagcccaggagttcaagaccagcctgggcagcatggcaaaaccatgtctctaccaaaaatacaaaaagttagccaggtatggtggtacatgcctgtggtcccagctactcaggagactgaggtgggagaatcacctgagctggggaagtcaaggctgcagtgagccgtgatcgtgccactgcactccagtctgggtgacacagtgagacgctgtcataaaagaaaataagagaaaagaagtggtgaacacagatgtgcttgcatttatcccagtctgggtgaaaccacgtttgcaaaaattgtaactgagacagtgaaggagacctgaactaaccaactccatctgcttctaaccttcaagctgtctttgtccattcctgggcacaggacaaactaactttgggaggaacttagtttatggtttagctttgaaacgaagatgataacagccctttcccaaaacaattccccttcctgcctggggactggactgcctttgcaggactaacaaattagtcataagattagaaattatggtttaggaggcatgcaactggaggctatgagattttaaacctctccaaattgcttctggcaataatattactattgtaaaacctaagatcagtggttgagatattttgcagaccctgcactccatggatcagctggcaccacccaggtggatacactggctcatctggtcttgtggacctgactgaggaactgactcagtgcaagaggtcagcttcaactccctatgatttcatctctggcttgaacaatcagaactcccgattcactgccccccgcccccaccactaaattatcctttaaaactgtgatcctcgaacatttgggaagactgatttgagtaataatacaactccagtctcccacacagctgactctgcatgaattactctttctctattgcaattcccctgtcttgataaattgtctaggcagcaggcaaagtaagcccgttgggtggttacattaggaagggggagatacttttggtctttgttatgtatattaagatgctggctgtaggttttttcatagctttctggtgtcaggttgagaaagttccctctattcttaaattcctgagagttttgagggttttaattttaaatcatgaatgcatgttacattttgtcaattctttttctatatttattaagattcttgtatcactcttctttagtctgttaatatggtgatttacactgatttttgaatactgaactagctttgcgttgccaggattaacctcactttgtcatgatgtattatcatttttaatatattattgggtttgatttgctaaaattgtctttttttacatccatgttcacaaagatattgtattgctctgtacttttctttcattgtaatacattttctgattttggcattaaggtaatcttggcctcataaagttcctaagtattccctctacttcaatttttttggaaagaatttatgtagagttggtattatttctttcttaaatgaattcaccagtgaatctaggtcctatctttagtaatatccaaagtcacaaagccaactacaactcatttgtcagatattaaatgtattaacaggataaaaatacatttgtaatggaatgtataagaagaagagattaattctcactgggggagaaacgaagagaatattcaaatcacattttgaaatggcacatatttctgttgtttgacttatggggcaatgatacagtgtcaaacactctgctaggagctgggaatgcaaaagtgaccaagatacaacccctatcctcaaggggaccactgcacccagtgcactgtcaggggaaggagatatggtaaaaagaacacacaaccctggggtaggatgtaggagtcttcaaggaaggctctcctgtgggtatgatacctgagccaatcagagattacaaaggcgaagaaggcaaggactattccacccatcattgcaactcagcacctagggctcagatatttttctgcaggtgagctttgccagactactgtgaggaagtcaaaatgtgtatcccaggcagccaggacttcattgacagggacggtgacacacgtataaaaatgggacgcaaacgaagctgtcagggcggcttccagtgtgatacagggagtgcaagaagatgaggctgagaggcaggcaggagatttatcatgcaacgtctcatgtgcctagggcagggcaatgagagcagaagttgctgatggcccataagcatgttctgtttgtgaaatacttgaattaattaccaaagtttaaaactctgggacttcacaaacaaagttgggtttttgccttctcttaagaacatctagccatacaaaatccatgatccctagagttgaaaagtacctgttccccttggagctcttctagttctccaaggtctcaacatattctggccctggggatgcgtttgaatttctgaaactgctattagataacatcactctggtgatactgccaagcctgtaacaggaagactggtggcaaagacagggcaggagatccaacaagtctatattaaggcagtggaagtagggactggaaaggaagagaggctacttgagaattttttttaaagcagggattaaatggtaattcgataaagggaaagggagagggagaagtcaaagttcctagcctagaccacagaatgaccgatctacaaagaagggcagaaactggtaaactggtcagggcaagaggagcacaagggcagagaaaatgatgcctcatttgttcataggtttgtttctgttacctggctagagatttgacatttaaccaacaaataagtacttcattttcagtacatctagcccaaaactggcactccccacaaaccttctgttccacgtactggcattttctccctgcttgcaggccaaggactcctagaccttccccatgtgaatcacaaactccttgctctgctgctacaccaaccagcaacacttcctgggactcaccatttcagatcttttacaaacaataactcaaggaatgctcataccaattcttggaggagtaggtattgttatatagtttttgttttgttttgtttgagacagagtctcactcactcactctgtcacccaggctggagtgcagtggtgtgatttcggctcactgcaacctccgcctcccaggttcaagtgattctcctgcctcagccttccgagtagttgggatcaggcacgcgcgaccacatccggctaatttttgtgtttttagtagagatggggtttcaccatgttggccagactggtctggaactcctggcctcaagtgatcagcccgtctcggcctcccaaagtgctaggattacaggcgtgagccactgcctctggccaagtattgttatatagtttttatagtgaatgcatgccaactatttttctttattcaaagtctgaattggaggggcctgaaacaaaaacgcctgttttcctcacaggaactgccctcgtccttaagcattttctaatggtggcataaccactgaatcttttaacagcactgtgggaagatcagaagactttaaaggctcccagacttggtcaactgtatgttttcctctgtgtaaattccaaaagtatcaccactaatccaaacaacagctcttcaagcaggagttaatagaggaaaaacctcaactgaaaggtcaggaaaaggactttcctgaagtacaaataatggccatgtgtggttgctactaagttcaaatcttttacagatgcaacaagataagtctaagttcacactcctgttcgcaaaaacaatccaaccagggaatacgaaaatgactccttaggaaaagatttgccacatcatcaattacatagggcagacaggctgaaaattgaacagaaggtggtatgtggaccatgatctgagaggtacccagacaggatataagaaatgtaggagtggtgaccctgttcctagttgatcttatactcggttaaaaataaaaagaagctgaagaatgaggccacatccagaagagccaagcgactgacatgtctgtgtaatactttatttatcatccaaagccttatatacattgctttacttggtgacaacctctgagctgagcacttccagattcttacatagagtcaaagatgtcaacatcataacactagttccgatctgacttcacgtatgacacttatgtgttttcctgtatattctgttgaactaattttattgacgaattttcttctaaaattaccctcaacgtattctgacagccaccaacctaaagatctcagttccaatccacccaggcagtcatcacttgaattctgccaccatttagaattgctctacctctaagagctcagtgtcaagattctcttcttcaacaaaaacttctcaaccacccttccactttccccacctcactcttactaaactttctctgggcctcccgagttaccttctggaatttactgaaagctggtgacactgatgacattctcctagtcattccctctgaatactcacaccctcatacagcctgaacttaaagagtacttcatgaatatatgctccatggagtccttcacctccttgatcttctaacacaattacagtaagaggataagaatcactacccaggaaacctataccaggcacctcctctgttcctggttcactgacatgtgctgtatagtcacaaacacaggctcacaggcatcccaggaagcagtgagaacaatggaatgtcagaaccagaaaggatattaggtgattacatctgatgtcttgactttagcgatgaaaaaaccaaggttaaagtgagagagctggcaggtggtagaggtaacacaagaaacgtcttgggccaggcgtggtggctcatgactataatcccagcactttggaaggccaaggcaggcggatcacttgaggccaggggttccagaccagactggccagcatggcaaaaccctgtctctattaaaaatacaaaacaaattagccaggtgcggtggcaggtgcctgtaattccagctacacagggggctgaggctggagaattgcttgaacccgcaaggcgaaggttgcagtgagccacaattgtgccaccatactccagcctgggctctgtctctaaacaaacaaacaaacaaacattttcttcccccaaccccagaaagctaacacaagaaacctttctggagaggaaaaaaagttttattgggataaatttattctattccatggaatggaactgaggggccaggatgggaccaaaaacaatgactcacaagggatgaatgtaactggaaaggcaggagccatgatggagaaaaatgagatgtgctcagattttagtttgcagtcaacaggaaatcaatgaacatatctgcacaggagtgcaacaaggtgaaaagattcctggagaagtgttgtggcacccacgcaaagaacaaaatcaggctttcaaatgacagcttttattttcaaattaaattatgtgtgtgtttaaatgccacaacatctggaagtaactaacaatttagtttgaggggctagggtcattaactaccattttagaagaaaacatgttacaatttaaatgatttccatatgcttttcaggagcttaaattaagctaattgaacactttcataaaccaataaggaacaacatcccttaaaaatgttgaaagtatttatctctaggatacaaaattatgggtaattttagtgtttaaaattctaactttacaatgttttatctgtggtattatttatcactgggtgaagaggccttataagatagtcttgactcaggcctgagttcaaactctgtttctgctattaaccagttgaatgatttcaacttggttattttaattaccttaacagttttgacatctgaaaatagggataactatacctgacttgtatattactgtgaacaattaagaatgtatattttgttatttgctaaggataaggcaatgcagttatgacagggatatttaacagtagcagagacacccaggctcagtttttcttttactttttcgatgtgatatgacaacttatttctaaaagggactaattaagtgactttgtttagcattagagcattacaaagccttaaatggttaacaaaaattgcccataatatttctctagacacatttgagactcttgaagttatctctacctattatcctgtttctagagcaacttctatcaatggtatcccaacaccatcttcaaagaatacgtttcacagtatcttcattgcaccagaaaatataagtctgttcaagtctgccaaataatctggtgttaggcactataagaagtatatagccataccttagataactcaaacacccattttccacatatttcattcctgaagtagaccataatttatagtaactcgaattatttacatggtgccttccagctagagaacatggttctcaaatttgaattcagctcctatcctatagctgtggtgcttattcattcatgtaactaatatttgtactttaatgatttatagaataatatcccttccattttaaaaaatctttaaagaaaatcatatgtttctatagacagtagaacataagcatgtctagaacaaacaatatggggatggcttataaatttttcataagcaagatccaaatcttaaaactactgtataactataatactataaagtaggagatggacgccaaacacattccattcctataataaaagtaaaaagtagtctcttttcccctacaagatctatcattttccattattccgcattttttagacctgccatggaaatcctacagtaaagacaatctgtaaaggaagactgctcatcagctgtcagtctgatctttcattcttggaccaatgcatccttctagttaacggctggtctaatttagtcaaacccaggtattacatagcaacagatgatgctactgtcaacgaaatcacaaggtatatgctttagccccaatgagcctgggctcaattaaacttaatagatcagagaatttgcctacttaagtaggtgttgaatgaacaaatttgcttctaagaccacaggagaaaacccttaaacattctgaataggtacagggcctgctatggcttgaaaatggtttgttcccaccaaaattcgtgttgaggcatggtttctaatgtaatggtgttgagtggtggtgggaactttaagaggtgtttgggtcctgagggacccatgctgtctcgtgagaatgagttcttacacacacacacctaccatacacacacacacaccaccccccgaatggtgctggaggattcaggcagtggagggagtggtaagaagggtattgccagacttacagaaagctccaaacggcctcaatgttaaggtgacatttgagtagacctataggaagtgagcaacaagcctggggaaagtgtggctctgagaagttgttgttgaaatgctagaggaacagcaaggtgaccaatgtatctggggcagcaaaaacaagaaggaaggtggaggtggtggtaggggtagggtatagatcatacagggcccactttcaggacttaagaggcttttatactgagtgcaagagaaaaggggttttgagcagaggaataacatgaattgacttatattttaaaagaatcactcagctgctgtggtgagaacagactgtagagggtaaggatggatgcagagaccagttacaaaaacaagaaacacggagcaaataagccatcaaaaacaggtgacacacacgctcatagcttagctgtgggtttggtgacagattactgtggggtatgaagaagaagaatcaagaaacacgtcaatgtttttggccggaaaaatggaaggattgggttgccatttacatatatgggaaagaatgtggagtccagagtttgattttatcatgtttagttttaaatacctattaaacactgaagaaaagatgaagaggcagctgaatatgagtctggaattatggcctgggctggcagtatggacttagaggtcagtgtttggatggttttttacagccctggcactgggtgagaagaggtggaaggacagggctttaggacatcccaacatggcggatggggaggggctgaagaatcggcagagacgaagaagggatagccagtgatgtgagaaaacagccaagagacagctgtgttctggccacactgttacacctgaactaaatgcctatttaaaatgttcagaatctgaaaaaatactgctgtttctttaaagaagtataaggttaaatatcctgtaagtaaatacttaatgataactaatagcaaccagaaactgcaatcagatgtttttccaaacacctagtactgtgaaatatcagtgatttcaattaacacgcaaatggaggaggttagcttaaaaagaaaagatgaaaagttttcaggtcagcaaaagtgatcctcctgaggattactggcccaaacttttctaatgccctctgcatgggtttaggatacaatcactccggcaagtgtttttagtgatctagagaactattttgcaattacagtcatgtgctgcataacaacattttagtcaaagacaggccacatatacaacggtggtcctgtaagattgtaataccacatttttactataccttttctatgtttagatatgcttagatacgcaaatacttaccactgtgctactattggctacagtactcagtactcagtacagtaacatgctgtacaggtctgtagcataggagcaacaggctacaccatatggcctagatgtgtagtaagtagactgtgccgtctaaatttgtgtaaggacactatgaagtttgaacaactgatcccctaacaacacatttctcaaaatgtatcccagttgttaagggaagcatcactaccatatatgccgcatttctgctccactacaatcttctctctagctaatgtgtagtcaaaggatggaagcaaattgaaatcttcatatgattctcagtccccagtcaagaagatgttaaatagtggattctaaaaatggccattgtagagttaaattgcctaatcctttttcctacaaaattagggcagcagtaagttttgtttttttgttttggttttttacttttactgttactggatgttaacagttgctttcatcatttaaaaatatcttcattaagaattcaatttgaagactctcttaagacagctaacacatcaatgtccttgaaatatgacttttaggtcatacaattttagataacagagggagagggagaacttatatctcatacataaacaacacagaacatcaatgtgttttcagaaactaatcaatgtgatatcacaaatgttaataagagggccctaatcaaattcttatatgcaacattgcccatcttatcattccttctagcataatgagctgaaagctataataccttgacatttcttcctttaacagagagaatttttcacactgacttttcaattcagcaaagctatactgatccaacaagaattaaggatctagtccatctaaagcagtaaaaatatattaacatagtctaatttggaaaaaggtttactcttcctatatttggaggatacaagttaatgtactattttgcagatataaatatgtggtgcaatgaggaaagaatcccagtgtccattttcacctcagttatgtgaacctagctacatgactaccttcacatattgtgatttctctaaaatgaaaactaccattccattgactttctcttcaatcagttgagctgtattactacagaggattgcaaaacagaccattatctcaattcttattatcatgctcctacgtgctccccataccttaaaggaattttctgattctaaagagatgagcccgacaaacactcccccagctacaggaatttcttggattgtagaactgatatactgcagtcaaaaattttaaagacttcattctgaaaagcaaatcctcttctccaaaactctaattccagaaacgtttcctaagggggaaaaaaaatctcaagagcttgaccttaaatcactggtgagaaatgcagagtaagccttttttgttttgttttttactgaggattgaggtactaaaacatttccctatttcagtgcttctcactccctgcgagtctctcccttttaccataagaagagagtttcccagttttagaaatttcttaatgtcacacttccaactctttaatttaggagttcagtttgtattacattctcacacatcaccagtaaatatgcttccatctaaaatctgtcttaggacacaaatccttacaaagtggtgtccttttgtttcagttttgtaaattagatattcttaccaagttacaatgaaagagacctgctatttagccagatcacaactcagaatattcatatgaccacaggacatgggtgatgtttcacccattagtcatggctgtctcccatgttcactttgttcctacaggcaaatatgttaatgagctttctcattaatcctctttcccccatatcatctctaaaatggaatttcctcctaggaagaaaatgtcaacaaattttcttgacagctatgaaagttacaagtcatgtctctaagatagtcgtgattaccaatttgccaatgtgtctgaaagaaatagcaaaaatatgtattgaactttgagacaaatatcatggttttgctgatatccagtgggtttttgcaagctgtcatatttattataaggctatttcacatagtcagtgttgccaatgaacatccaaatcattgtctaccttagtagacttcaactctattaatccccagtaatctctagtttttactatatatctgacaacttactgacactaagttgtacaggacctatataattttgaatctaaacaacctcctggttttataatgtagactcaaactatgaaatacaattgcctaaatagtttatcaccacctcaagcacaaagatactatgttatttgttaactagctttcaccttaaagcaaactctaaaataaaagcaaaaataaaatgtatcacttttaacattgaattttctaaactccaggggaaaaaagaacaagcatgaaagtcacatccatccacagtgaagtaggaaaacaacatatccagaatccttttcagatttgcatttctgcttaatccatttaatgtagtatggttgtattctatcttccaatgctgggatactgggtctcagtggatttcagtgggtgaatgaggagtccagttacataattttggaatcaatcttccagaattggatgcctgaacactagcacataatagcaacaggccatgtgagtcaacatgtccacacccttgcccaagtctatcagctttcaggcatctccaaacactccctttgccttcctattctgaattcgcacgcccaaaaaagctgagatcagagactctgtcagtttacttggtagttttttcacattaactttcagattcagattaatgcataattatacacacatcaatgtaccaacacttcaaaaaacctttaatggaaagtactttgaaaatttattaaagcaagaaaggacccatttgaacacaagaatacagaattgcaaattaagtataattaatataatatttatatgaggcagaactttcatacggatctttagaaaaacccagactcttcaccatgtgcagagtgctttaaggaggcttggagccagatggtctgggcttaaagccaggctctaccagttactatgtgacctggggcaggttccttaaattctgtcttctcaactataaaatggagatgatttaaagtatctacccaggagcagaaccaggattggagaagtctgaagcgtatggagcaggcagttattttcaaagacttataatcttttataagtcttgttacagggctaaatgaaatacctgtaaagcacttagcaaagcagccagcaggcaggcagtgctctataaacctgactatcactaatattagtgaagagaggaaatgagtgttataggcccatccactttatctgaggctatcagaggagaggaaacaagcttctttgaaacaaactgttttggaaccaaatggaatatttatttacatggcaagttatatcggcaaatgtatgtaacacctaccatgaactgcaaaagctgaaaatacccatattaagggcggaaagttgccaaaaggtttgatgttttcctataattatcttagataactaaatgtgcatctcaaatgtctaccccaaatgcctctcaatgtctcagactagaatgcatgaatttaagaaaaggtgaccaaggtattcatactacctgctccaaacacaaatatgaatgcaatgaagtttccttaaaacttgacagattctctgaaaccctgggtatcttaagccctcattccaaggaacaatctaatgattgagaaaaggaataaaatggctatttctttgtgatttatagttttggggtgatactaactggcacatatgtgacttctctctcctctctctcactgtccctttgtctccctccaccccaactccagccagatggcaacagcatgtcagaaacatttagtattaaatcaacatttccttgagaattagattcaaatccatcctgagtcacctaagatatatttggctgccccaaatccctagattacaaataacatttaatcctaacaactatgaaattttgtcagtctaacagatggtctaggatgactctgtcagaagcaactctgttcatctgatcattctctgctcttaaatggaaaagaactcataggatggggagacaatggaggaaaaagaacagggagatacagtgtatatgcaaaagagtaagtcctaccactctctaccgcaaacagtggaagggaatgttctgagccacttgtcattaacacagagtttaaacttaaagctctattctgactagcaaataaaagaatcacaggtgctcaatatttgttgactaactaaatttggtggtgcttattttcatgaactgatagtttgtgaaaatgaaatggcctaatcattactttgatgataaaagacattaaaatatatcaagaaacctatttattatataatacaccatcatgatactgaaaattacctttaaatgctccatggtcactttcaatatttagcatatatgagatggattcttcacattactataagtcttaaatcttatataaaaatatataaattttaataaaatcaagggtcatgatcctagcaagccaaggaaagctctgagagcaacacttcaataagaaaatgcaatcagccttaccacattcttcctttgtggagtgtgactagaagtggcaactctgcatcagatcacagtagaggagcacactgcagcatcttcctatgcttcagcatgccagggaagcccccctagacgggctttttactaaacccaaatccctcaaaagaggtctctatctctacccatagtttccaatttccctttaaaaatacagaaaaacagagaatatctgttgagtgcagatattatatatagaaaacaactagagttaaaacaggactcttcttcctgcccatttcctcaaggaaactcagtgctccacccagccttgtgcataatactatacttcttcacaggccccagatatgcagatgacaaatagaacacaagctactaaaagcagtggcaggttccttgttaaattatgaactcttgggttctagcaattcagtccaaaggtagatgaaagagacaaaaatatcttatgaaaggagataaaaccaaggcttgatccaattaggattcttgagttcgctgccagaaattcaggtggtaacctcagtcttctggcaaacttccaagagcatgcgattaccagtgatgctcctaaaatgttccttgtaagttctgcttttcctaggctgtgcccagcagattttctggaattgtttgagtgagctgattctgttcctaaagctgcccgaggtgaaaggtgccatataaaactttaaactgctccacaataaaaatgggctttttaaaaaatcaattgagagaacaccacaaaactctcctcatcctttttcacttcatattctgggttcttcaaaagtctgacttcaatgcacttgagaaatgaatcaaagaggaatttttctctaaataaaaacactagcctctttgttaacttagattccaattatcaaacacacatacattccatattacttccccaaaggaatctccaaataatttttatatctgattagactatgttagtgcattagtttcttcattccactaaacaagagagaggtaaataatcctcagaggaaaacatcaatttaagtggaatttagcacttgggaatgaaaaagatccaactctatcatgcatacaggaactgagtggggaaacacaaataaaatggtgaatgtggatttaacaatcctgccatttgagggcacagtgcttcgcaactctctcctggcccatgtccctttatgataaaactacacaaggagattcagtacttggaaagtattccttcacttaaggtgtaaagaagatttctggactgggcaccatttctcctgcagagaaaccatttcggttaagagattttcccactttacattcctccaggaaacaaatcattttgagggggtattctttcatttcaatgttatgcccagttctgcagcttcaactctgcagaacacaaagaactggagtctgaacatatatctattctgcctccttgacctgattttggtagccgttaaaattcggtcagagtctgctaaagttttagagagttcagaagattgaggcagctttggtgatgttcccgctaccatttccttggtcttctaacctaggtaggtcggatttcctcatgttcaggttgggccccttgggtgcctttgaagagtaaattctatgacaggtaaaaatgctggctgcaagatcctcttttaaaggctctctgatctgcagaatgagtcacactcccatgacaatatgagatggcagctgagagaggtgaggtatgcttgagcctaggtttgaaataatattgctgcatttgcagcataaaccaatatgcctgagcctaggtttgaaataatattgctgcatttgctgcataaaccaagaaggacaccaataatctggaatgcaaatttcaataaattctagaaatgctggtggcagaaaagctttccgggaccagagaaaggcagtatcgaggataagagcatgggctcttggaaccacactcccatgactaaatctcagttgtattacttactagctatttgactttggacatgttacttaaattttttctgtgtctccacttcctcatctgaaaaatggggataattatgtctagggttgttgaggtagttgaagattcattagattatgaattataaaatacttacaatgagtccaggcatataattgagtgccattataatgtttatcttcactgttagcgttgccaacgattaatattacaatttccaagtgagtcactctgaggtacaataaatgattaagctgaacacctaggttagggcagagcagataaaaagccagaagaatacacagagaggagaactaaggcccctccctccctcctcaaactgatcggatgtttgttcagggggacgggggacaggcggggtggctacacttggtgggtggcttcgctgggaggctggaccaggagagcattcccactcttttcttcctcgactgaatttatcatgaagtcttaaaaacataaagctgcaatgaatatactgaaagaaattagactctgaatgtcagttgttttcactctgtcaagttgaaaaaattgagaaggaaagtggcaacggggctcctgatccactggaagtccttggggaattcattaaatacttgctaattgactgaacttgcctgttcaaaggaaacttggaaatgtatacgccttcagggaataaatcatggcgtatacaatccactaagtatcttgcttctcaggagtaaccacagaatatggtttatatgtaagttaaatatttaattggtataaatatactactgagatcactgaggcaaaaatgtgaacattttacttctactttttaatgactacattttgggccattatgcttaaagctaataccacaaaaatttctgaattttgtagcacaaaaatattttaatatgacttggttattttcattgatatgcggaaataaatgtgttccatgaaaagcaaataccaactgcttccactacccatttaatgttcaaaaatatttttatggaaaaacctaaaaacaaaatggcaagccaggagaattggtgcctctgggattagaaggtcagaaaattacctaatcttatttctgccaagaagggttacttgcattaaaatgacagcagtcaccaaggcactgggaggaaacacgggccaggggaaaacgggccggctgtattttagagaaatcacaagcacacacatgggctacaagagaaattatatttgaaaaataaaatggaacttcctcattgattagtctcagctccgcgataatttctgactgattcagaaacttgcaaggctctcatagaacccagacaagagctttgatgttggctggatgcgacacactgccggtgatttaattttgtctaaggcaagaacactgaaaaacaatcagagtcatctcatgcctgaagtatcagagttgtattattttccagtgacagcagaaaaataatttccatgaatgagtatggtttggggagctggggagggaaaaaactgaagtagggaaacagaggtggaggaagcatgctttgtggattttctctcctttaccaaagagagctcaaaaatttctggctgcaagactgatatcagacagacatcaagaatgcagctatatctggcttccctcatggcataagtagcactcacagcaaaatgcatgcaaccagtcacttaaactcagatgcaaaaattaccaggctttgggggtagaggcaccactgttgaaatagacattaaatcaaactgatgagcttctggcacttttcagaaaggcagtaatatttggaaacattttttcctgttttttttaatcaaagcaattatttcactaaaaactgagaaatgaagggaaaatgccacctaaaaaaatcactatccacaactaatggtagaattttgtatatttcattccagtcttttctcctatttcctatttggcaattatacatgacagatgacccataagaaagcaagtcctgcatttcactctctctcctaaaaagactcttcaataaagcttttaaaacaaactaacaaaaaaatcctggtgctttacgacagacccaattttgcttacagattttccccaaatttaagattttgttattggttgtatacaattcaaaaatgaaggctgttaatgctgagttcatagtataaacaaagagaccagagattagaaaaaaatgtcagcacatttgattagtttcatcctcccacatgccaatgggtatgggatgtggaaagactgcaattccattcttaccatggtttgcctcgactatcaaggtgatccaatatggcaagagaaaaagactaatggtctcaaatttttaacaaaatggcatttccaatttttgtaaaatggttgtttagaacttaaaacatattttccaaagaagcagttacaagaagaggtacatatttccaacttactctgcaacatctatttaattcctgggtttaaacagaggtaacaaaggttttaaaagatgaggtaactatgacaattcatcgaaatgtgaagagaatattcatgcatatgttttttttcaatcttatcctttaacgtctagtttatttctgctttttaggatatataacattaatacagtactaaaggtatttaatttgtaaatatacataaattggacatacaagctgttaaagctctaactttatttaaacagagaagtttggacaccattagttgaaacaataacatcagcattactttcatttgctgccatactgatgacaagatctctttagaaaaacatgttccatgtttcagtggggacggccccaggaataaatctgccatggaaacatccagtatactgtgggtctctttcggagataaattgggtaataggagtttggaatcccaaaagggcagctctgagaggaagcagggtactccctttctccagggggtcctcgcatgcagcagagttctcaaacacctttagtttaggcccctcttaacctggtaagtggagcagaccttgtcctcatacatttttaaagggtttcagtcacacacttgctgaaatccatttgtggatttctgggaccatgatgccagagaagaggatgtgggctcagccataactaagaaggaactccgtagtaatgtccagatggggaagaggactcgagttctgagacttcaaagtgctgcccatttgtggcaaacacttcattgagaaatggcttctgtggatgcagtctaagcctggggtgcttattttaggcaactatggtatatacactcacttttatatacacatttctcatttgtcagatttcccacggtgaactggcaactcctctctgggtgaaatccaaacgtggtggaagacagattcctggttctgggccaggtcctgtcagtttctgatcattacctggttttctatttccaactccatttaggtgactgagtctccacacagagctcaggttgagctttagacacaaatctcatctggtcattcattatatgatttgtatcctccagtggcttctgcctttttgaaaagtccaaattacctactcttttctggtctcctattctgcaaattaaatcttcataagtgattatactttccacatatggaatggagggtggtagaaagctgtcatgtcggtctctcccattccgccactcctctgccttctgtgtgactgcatagggaaggacagtcaggatacccttctccccagcagagtagttggcccggtgttgaaaacttgacccaattaaaagctagtgagagagcaaggcctaaatatacccaggcctcaggatctagccatgggtaagtcactcctggacttatatgagctaatattattattatttaaactaatttgaagtccgtttctaaactttccactgaaataaacctagaactcagaccatattgaactaacctgcttatgataggtgtggaatctgtttataaggctttgaaaataactatgtttacatctttcaactgaacaggacataagtcgatggcatgattcatgatatccactctagcatatgtagcttgactccactgaatccactccccttcctctgatacgtcttctttaatacatcagtggcactatttacagcaaggatggtttcaatggaggttgctttaatattacatttcccttccttcaagagtctaatgccaactgtaacaggatttctcatcttttttcctatactcagagagcaaactgggccatttaaatcacccagttaatgtaccagttgctgttgaggagcagatggaggtctgcattagactccaccagaatctgtgctccagaaggcacagcctcaggaccagaggagctgagaacaccttgaggaccagacccttattcacaaaataaggagctgggtactaggcgaggaagttatttgactcagagcatcacggagtcaggtgaagaagacacctttgccccattccacaacactgctcctccaggacatcatgcagctcccacacaaggaacaacagccagatcctctggatgtcctataaattagttgaatcagaaactgagtaatatcagtgtgtcattataggtcatttagaaatagctttagtttcatagtaataataagctctgagctatatgacatattgctctaaactgtacagaaactcaactaacttgcagtcttttcttaggagtataacgtaggcttctggttaaatgtagcagattgactacacacttctcacctttcctttccaacaatgactaaaatgatagcaaataaaataaaaattaaagaaatagctaagggcaagagactaggagggaagatagcagaggagtgatttcaacaaattttggaaagacagaatagacagaatgatgcccaatttaacttcctcaactctgcgatagcctaaagaacctacggaggagataccaagaaaaataatttactctcatagaaacccagagaggctcaggtttggagagactgtataccacaaaaaacaggagtgagacatgaggctggaaactttagaaactagttgtaagtttatttagagagagattggacctccaggtctctgccttaacccttcacacatacaggactactgtctctcaccttgaccaccttccctaaagaacagagaactctgtgatatgaagaccacagacctcagttactacaggctttgactgaaatcaaaaaaggtattacatgaaagcatgtaatctgagccaggggtctccactgttcctttccttctccaaagtttcattctgccaaatgttggaagccaggccaacatctccaaagtagactagacaagtcttctctggaaaaactgcaaagacattcagattgacaaacacttggctccaaagcccacctgttggctaatccagctattcccatagagcttcaaatcagattttttacattcttttaggaaaaaaacaggtggccatatattcaaggaactaatccagcagaatagagaacgaccaaatcaaacaacagtataaaatgaacaccctccttctcataaaccacactgtttttcattgcttctaactccttactggtgctaacctaatcccacatcataggccatctttggcagtagaccaatactgcaaggtatacccagattcattagaaatattctggacttaagcaagatattaaattctttcagaataccatttgagttcatgtgtgtcaggagagtaatagctaggctgaaagactaaacttggagaaaaagccttcagtgatatgttacaaggcattcattctagtatattcacatcattggtaagtatgtcaatggtataattctcaaacttctggatgacaccactttaggaggaggaacagccaatatagaagctgagagaaccagaaccccatccaaagagaatctgaagagattcagataataaaggacaaaattaactggaaaaaaaattaagtcttacattcacatttaaaaacaactacgcaaaacagagatatgaattagtaagagttaattattagttttttttttaatccctcaagaatctgggtttcctatacattcagtgactcatcaatgaagcagctgcccaaaaaactaatgccttcttagacaacagcaggagaggcagagtgcccagggcattgcacttcaagagggttatgaacaaggaacatgaccacacgggggtaaccagatggacacagttcaagaccatgcaccacagagaaatgtgcttcccatctcgggtacttcagagagccattcccttccatctcaccaaaaggaacaaaaaactgtgtactgtggaaatcgagaaagcaaagccgtgactttaccaaaagtaacaggagtcagtcaggcaagacccggacaagctgggtgataggagccagtggtggtgagagtttcctctcctcagtgagagcgagatcatcaggcaaatgcaattcacaatgagatatcatggagggaaagtctgtttctcttgaactacttactttaaaaagtttaaaccaaaatatccaatgtagtggtctaatgaattctgaaatgaacaactatgctttctgcctattatcttacaatcaacatttttagctttttagcccaggtctaaaaatggctgttaccaagcatgtgtttttgttttttttgttttgttttggtttttaatggaatggtatcatgtactggcatgatctagaagtagctacatcagccctcttctggtaatgaatcatcagcacatataaatggaaggtaaagacaagattattttattaaaagaaacaattactaactcacagggcaacaaagcttcggcagctataggatactacttgtgagtatcctatactcctatactccaggtctctgccttaacccttcacacgtacaggactactgtctctcaccttgaccacattccctaaaagaacagagaactctgtagtatgaataccacagacctcagttactacaggctttgactgaaagaataaaaggtattaaatgaaagcacataatctgagccatgggcctccactgttcctttccttctccaaagtttcattctgccaaatgttggaagccaggccaaaccttggtttctggaaaacaattcaaaggcgctggccatgcctagtgtgtttatccttctttctgtttaaaaccggtcactggctcaattgcctcctgaacgaagttagcaactcccagccaggagctcaggccttgaggacgggctcatggctctgggacacacctctcaggactgccctccgtttgcccaatgctctagccaagcaacaacatggcagttcttagcacacctagcatttccttctctctttccttgcttcagctctgctaacacccttcctctgcttctgccacccatccaacacccggcttgagccagattcaaattttgttcatggagccatgcaatggattggaacatcaatatagttcaatacccaccaacagtaaacagatgacaggatccattctacactgcaggcaaagtcaacacacacaaatctggttaagatgtgtctttggatagcatacatggaaatatcaaaattatctaaatctacataattgattctaatagatctggcttctctaataaatttgtaaatgggaacatgcctctctcacccccaaatagcatatgtaatgtggatgtaattgttggcctcagctaatgatatatttttaacaacacaaggaatgatcatccatatttttatgaaatgtagatctgtaaaataaatacagttaaataatctacaagtaggtttacaacttaaagcctacagggacaaatatattttgatcttccaatagctaacactttgagcaaatggaggaaatactccaaattatgtaatactctatataatctctagagttagaatgagaatgtgtttaacatgtgctctgaagttaagcctatacattatgaaactttagacgttccagctttaaaaataaaaaataacagctttaaataacatttctaaatacaacatttggttactaggagtctctcatgattgaaatttacttagcctgaaagatgaaatgtcaaactccaaatggaaggaaacaaaattagtgcaagtctgtatctactcttccactagaaaaatggtttcactaagtgagtttactgatttccactcttggaggctagaagtaaagatagctaaacaataggaagaggtgcttccctaaagtaattaagaaaacaatgtttcactttactactatcctccaagcaccagatctatatatttgtataagcacagcactacccaaatatatataaaatgaaaatccactataacaaatttgtcaaataaaatctgagcttctccactgttgttcaggcagcaatactgcccacaagtatgagaaacttaatattgattagccattgtgggttaaaaattccacagaagtgccatattaaatcattcgggtagcttttgcttctggaaagcacattccagcactttgggaggctgaggcaggcagatcacctgaggtcaggagtttgagaccagcccgaccaatatgatgaaaccccgtctctgctaaaaataaaattagccgggcgtggtggcatgtgcctgtaatcccagctattcaccaggaggccgaggcaggagaacggcttgaaccagggaggcagaagttgcagtaagccaagatcgcaccactgcattccagcctaggcaacgagagaaactccatctcaaaaaaaaaaaaaaaaaagtaatacttttttcccactaaggttcaacccaaccttgagggacaaaccaaagaaatatcttatgtcctctctcttgtgttctccaagtcatctgtttttttttaacccaatgaaatattttaaatatctccacaagccataaacaacctaactggtcagggaaaaaggtaagcaaagtagaatttagtccttgccacaaccaagccttatgtccttgaagcaaccaaggacataaggccaagaagaggtatgccaccaggataatagcaggtttggaatccactgtgagaaacaaaactcctggtgattaattttgaaactgtgctaccaccctgtaaccttcctagagaatataaggcttctcagtttcagcttctcagtttcagtaataaatgtctgacaaagcctcatacttttattttctccgtttttcatcccttccccacaaatgatggaaaatccaaaggaatcctagccataaagaactcatactgtgacaatttaaaacccattcaatcacagcaactgccactttgaaaggaaaaaagtcaccaggagtaggggccaacaatgtaatcaacatctaatgggatcagaaagtgtatggaagtctgggcttctcatgacactgaggccaaggagaacagtattacttcagaggtttcagaaaaagatcttgttataaaggcttttgagataaggtccctgccaaaaatatttcccgaggggaagatggggaacaaaaaagaataaactcttggtagaaaagagagacatttagatttagttataaaagatggcttactagcagagaatttgataaaccatggaaggacaagagcctgtagccagaatttcaggactccaaaacaagtcacattctagacattttagggttctggaggcagttaaaacatgtttccacttgcttgtggaataatctctaatcagaggttcaatacaatgagatccctacccactgaaatatttactttttaaattgataagctgaaaagttcatcttttttaaagcaatttctcgtgaagtctcatcttgatttagaggaagagggaagtaaaggggaaaagcctaccccacagaaagaggggaagtgacgttacattgtgaaacttaagggaggaatttcagccacggctctagggcgaggggttgtgtaggagagaaggaatggcttaatttttaggaaaacaggaaagccaagtgactactttggtgaatgctggaggaatggaaagcagcagcgaatcctattttggatacagaggctgagagccaagtaaatgaatcccaggcggagatactgtcttttgtctccagctgtcagcttttttcttgaaaactgtctcatcactttctgtgattgtggttaggaaaaaatcctactttatcttgtgaactttttattgtcttcctgaagttatgtgttacttctgtaaagcactctactctccttgtttaatcatcacaacagggaaggggagaggcttgcaatgcagtgtttccaaatccaatcactggagtcattcacataacattaggtttaggacctgagaaatagattctgaggtcacagaccagccccctttatatttaagcaggaggcaaaaactgaagctaggagagatccggagtcttggcaaggctctctgcgacttccagaggctttcttcactcagtccactgttcggtccatttcagagtctgctctttcacctttgtcctcaaatggtttatgacaaaggaaggtgctggacactggaaaggtaacgtcttaagacatgacccctgccctggagtagtttacacatatggaggaaggtagggcgtatacttgaaaacataagtgataatatgattagcaaaaaatcctacaggaatccagaagtgggggtttcatcaaggggcaactgacaaaagctttgtgaaggcaggtgcattcagtggaaagagtagacaactaaggtaaagaccatgttaagaaagggagggagatgggagaactatagcacccccagcacacaaaggtagaccttggaatgatggctcatgatacatttaagtcaacagaaaactaagtgaagagtaaagagaacaaagcaggaaaactacagaatgctttcaatggcaagctaaggaattgagactattttctagatagttactaaagatttctactggtagaaatttcttcacatggaagttttagtagaaataaaagtggtatatacaaggcagcgtcttaaggatcactctggaaatacagtacaaggtggactgaagaagggctggaggcagggaaactgagaggagactcagcagtttaggaatgaggtgatggggaccggtccacagagggacagatggatgtaacaaaggacgtcctaaaggaaaagtaaatgggatttggccatctactggatgtggagcaatcaaggctctcaatcttcaagtagagatgtatgggagaatggtgtcaccataaccagagggagggatgatagacggcagcaggggagtgtatggtcacctatgaagatatatccaacagccatttacaagtcagatgctgaactaaagccctggaaagccatcaggaagcacagtgttgagagtcgcccaaaaccaagagcctaaccttgagggtgaatgagatatccaaggagtcccagatctcagcctggggcacacttcatagttagggggctggaagaagcagaagtcagggaagggggcagagaaggaaaagcctcaaaaggaagctaagaataaagaaagcatatatcctggttactccaggctgacgtgggaggattacttgagcccaagagttccaggttacagtgagctataattgtgccactgcactccagcctgggtgtcaagagtgagaccttgtatctatttaaaaaaaaaaaaaaaaaaaagatcacacataaaagaaaggcaggagggagctttacaactcagtagtacagtattaaatgcccaaggaatcaaagtaacagaacacagaaaaacacactggatggggttattagatcatgggcatcaaagcaggtactatgctcagttttatgttactgtcacttcattgcctcagtaaatataaaaataaattttatatctgagtaaagtcgatacaggatgagcatcccaactttgaaaatccaaatccaaaatccaaaacacctctggccccaggcattttagataaggaattctcaacctgtatatgaagagtatatgaaattggctgcttcccaaatttccctagtgttgaaaccccggttgaccctctaaatgccaagagacatagttcaagtctggttcgtccaacatattcaccaagaagggtcttgaatagcaaagctatttccaccttcctatcccatgttaacggtagggttttgatataagattcccctcagcagaaacaggacagaacaatgttccctggttctcagtgcacatgctgcatgtgctctcattctctctctcttctttttttttttttgagatggagtctcactgtgtcacccaggctagagtgcagcggcatgatctcagctcactgcagcctctgctcattgctgcctccgcctcctgggttcaagtgattttcctgcctcagcctcccgagtagctgggattacaggtgtgcatcaccatgcctggctaatttttgtatttttagtagagatggggtttcaccatgttggtcaggctggtctcgaactcctgacctcgtgatctgcctgcctcggcctcccaaagtgctgggattacaggcgtgagccaccgcacccagctctctctctctctctctctctaaacaattgattggacaccacactgtctgtggatccagaaacagaagggtgagctgatatggaagaaaacagagtccctgttgtttactctataaaaaccattctccttgaaagatgccaatcacaacagtatcaagatctgctcagaaccaaataaaacacagaaagctcagggggtcagcagagggatgaggacagtgagacttaccaactttactgagatgaagtcagaagaaaaacaattccttatatctctgcattgtgcaagctacatgctactcactgttttccttcacagctttctgtggagacaagatttccttttacgtctgccaaacatatgccctgtacctatgttgtgatcccattcattccagcctctgctcagctgctgttccattagttaatattttctcttctgtgcctcttctctcctttcctcttggctcaccccccaaaaataagcaggtaaatctggctgtctctgtatatctgtgtgtttggggtgtataaaactccacctgccactgttgggtttcagggcagagagcagagctagtcagagcagcatgcttcatctccctttcaaacctgctcacccaggaccagggcaggacaaatgtatcagacagacgaagttggccttcaggcccccttatccactgctccttactctggtatcaccctctacccccacgcctttggttttaccatctacttaactaattctctgtgactctaagatttgccatgttaatagcctcttcagactccaatgcacagtttccaagaagccaaaaaagtggcggagggaaataagaaatataatgcagtatttcaggaaccaccaccaaataagaagaaacatctgaaaggaaaaaaaacttccttggcatgctgaaacccaaatggaaaagactgtctccccataaggccagctttgcttcccatagtgtctgaggtgtactgcaaacagcaggagttgaagatggtcagtgaagacccaccaatgacataagtcacacagggcactctgtcattatctcagggaaggggaggccaaccattatgtctgaggacagagtcaccaaggagcatcttccttaggattctcactctgtaaagcaaagataatgagaacaagtgactgctcaaacgtccaacgtgggaaaactggaagattgtttagtccaacctcctcagtttacacaagaagaaaaggagatgtaggaaaaacttgctcaaaggtcacgtaacatgacgcaggcagagctggggttagaacctctgtttcttgagtcatcatcccagtgcagcctgctcccacagcacgctgcctcccaacatctgttccttcacagagacatgtgcctttataaataattgtttttaaaaagttactcaggttaccagaccttttctgtgatcctgtgttcttgttattggaatcctaacatcaatcacaaaattatgtcacacgcttcctgaggagtgcatggaactgtttgtgtaagtggtgtggggaattcagatcaaatattcagggactcaaaactgaagacaaagacggccaatgctggaaaacgcatgtggctttttctaaggggctgagttccaagcatgtgtaattccactccctctacttcctacattctgatgactggaaatcttggggtcagtccaaggtcgacctacacaaagggaactccctaggatagccttagaaaaacacagcccctgcaacaggtaaatttagggtacatcattccaataaactgtcttgcctgacaaggttctctgtaacaggtcacacaaaggatttataccttttccttactgacttaagaggtagagaatttatccagaggggtttcttaaggtcctattttaacaatacaatcaaaagtgttctatttggcctcacttttccacacatcgtaactgttcacaggaaaataaagtcacccagtcttctggcttacaaacctcaggcaaattctacttctcacaccaccacctttgcaaatgccatatgtactaactgtattgtaagaaatatttacatcaatctggccaagccaaaaggtattttcttccataactttaattagcactgtctgcgtttttttaagttggtattgcctacatttgatttcaactgttagaattcatgtttccatttctcccattcatttgtgcttggaaaaggaataccaccataatgtgtactatgataaactttaagatacagacagcttttctgatagttggaaatctcttgcagtgtgatctctatagccagggtgacaaacacgggactaaggggcctggcaggtaactaaatgattcaggagggcagcagtaagttcacatatagatctggactgagggataggggctgtggcctcgtggagaaggtacaacccttcaaagcttctcatacttaccccattaccacagtgaggaagactgttctagttttgccagatcttctgacttctcaaaaaaggcgataaattcagagtttggggaagtctcagtttttaaaaatgttaactcaagttcaaaacaaaacaaaatactgagcccaaacatgcctatgggctgctgtacttggctgctgagtttccagtttgctatctctcctctataggaagtgggaatgatgcatattcaacgacgcctacaaaaattacttcagattgttagtctcagaaacccactggtggcctgaggggacatgcaaaaagaagaggaacaggagcagagatggcaaattattaaggtttcaagaccttaaaagagacaatcaaagtattcagattctcagtaaaattaccagattaaatcaaataaaaccccaccctttttccacaaaaatcaacagagagtcctgctttcttttcaccacaaccctattcctccatttatccctgacgtcctgccaacacctaaccagtggctagatcctgtttacttcttagtggaattatcttgatcaagcatgtcggcccttcattcccatcccattatcttagtgtagagcctccccattgcctagaccacaagggtccccagcccccgggcccacagatctggtacgaggccgcaaagcaggaggtgagtggtgggtgggcgagtgagagaagcttcatctgtatttacagctgctccccatcactcactaactgagctctgccttccatcagatcagtggtggcattgcattagatcttcattagagcatgaactctattgtaaactgagcacgtgagggatctaggttgcaagctccctgtgagaatctaatgccttatgatctgtcgctgtctgccatcacccccagatgggacagtctagttgcaggaaaacaagctcaggattcccattgattctgtattacagtgagttgtgtaattatttcattatatattacaatgtaataataatagaaataaagggcacaataaatgtaatgcacttgaatcatcctgaaacaatcccctacccactccaccacccaggtccatggaaaaattgtcttccaggaaactggtccctggtgccaaaagattagggactgctggtctagaccactgtagttgctatggcacccccagactccagtttctatctcctcccacctcactccaaacctagtccatactataacacaacaaccaaaatgatttttcttaaatgtatatgtcataacctctctgcaaatatgcaggaaactgctaagagcatttgcttcttgcaagggaactggcgaacatggagagtgggttcaagaaagccttattttcccctgcatgcccttctgtacttcttgaatttttattatgtgagaattaatttctcaaaaatgtaattttaaaatatgtaataccccagggcttctagattaagaagcaagacatctccctaccccaacccactggggcacataaatggactaaagattcgtataggtcagatgagagcatactgagaagtaaaccacagcagagcttgggacacatgcaggtggaaggcaagaatggaggtggaagttggcagcatctgagattagacgtacagaaactgaaaggagggtacatctgcaaaactgcctgcaggatggtagcttagcatggcctccttttcaccagcctatcagggtggtggcacggttggcccctagtctgaagtcaaacatctacctactctccaaagggagcaagtgatctgccaggagggacttgcagaccctggtggggatctctcctctggcattgtgggaacctctccccatcctgcttgcttcaccttgacacaccctaaagtgaaacctgctctttgacatactatgccctcaatttcagagctcacaacccatactcctagtgaaagaaaaggccaacaggggcagcagatgagcacaaggaggagggaagctaagtcagctgctacacatccttcaggcatccatatggataggtaagcaaggatgactacatatgaagaaagctggggaaaaaagataaatacggaaaaaatgaaaccgatcccagagaagacagagatcataactcatggagctaaagcagaagagaattttagggggaaaaacatctgagtgtggtcaaagatattagaaaacacaaaatacatatataaaacaaaaacatccatatagaaaagattgcatattgaagttaaaaattcattagaaaggatgaaatgataaaagaatgatgaaatccccagaaaactgggtgagtggaaggaggaaaacaaaaaagtttggtaggacaatttaagagtaaatccaggaagcctaacatcaatctactgaacccaagtcttcagattggaagagcccacaggtgctgagcagaataaaggaaaaaagattctcataaaatgtcacaatatcttgataatgagaaaacagagtctccaaagaaaggtccatcaaaggtacgagggtcagtagcattgattggtagagagaaattctttcaaatgctaagggaagattattttaaactcagaatttcatatccagccaaattaccaattaagcatgaggacggataagcagaggctcaaagtatacttgccatgtactgtttctgaaaacttactttataatatactccaggaaaattaaaaatatgtctaagaaaaaggaaaatagagtccaagaaaagtagaattaagccaagaataaaaggaaaataaatgtcagctgttcagcaagtcctgaaagcagttagttcataacgcattcaaaaagtttgtataatcaagaaaataaattatagttttgagagaatgaagacaaatattacttctgtaaatgagaaaacaggcaattacaaagtccagtaagaacaaggctatataagaacatcacagcccatacgtaaagcaaacaaaagtatgccatgatcctaagccactaaccaaatgtaaagagaatttgacctagatgcccagaacacctctgttcaagtggcctatgcttggttaataacctaggattccatctttatggtgcatttatatttttgataccactttgagggagtggtattggagcctctggatccaaccaacaaaagcaaaccatctccttggattttcccaatctaagagtgtgaaagacactgttagttccctgagtaaacctccatttccaacccttctcccttgcctgcctctaagatgtaccttaaaaacataagagtgggctgggcaatcccagcactttgggaggccgaggtgggtggatcacctgaggtcaggagtttgagaccagcctgaccaacatggtgaaaccccgtctctactaaaaatacaaaaattagctgggcgtggtggcagatgcctgtaatcccagctactcaggaggctgaggcagaaaaatcgattaaacccaggaggtggaggttgcagtgagccgagattgcaccactgcactccaccctaggtgacaagagcaaaactccatctcaaaacaaacaaacaaacaaaaataagagctattattcccccaccccttttgcaatctgatcacagtgagagccgacatgtgagccaaagtcctcgaggaggtttcctttataaataaaaaggccaagtcttgctaagaagaaagttttgcaatttttccttccctgtttttcctatgaaagccacatattaagaatgattggacagaagggtaaaaggtccaaaatgaattccatgagtgcctgtagcagcctttgggatcagaaaactaacccccatatctacttaagacttcggttgcatatttttttgttgttgatggggaacacattccttaactgaaacaaggaattggtttcctattctgaatgaagcccagtttgatttgggtttctgtcatctgcaagtgagaaagatctaactaatatatatctccttctttacactctgctccagaggagaaatattaatagcctgtcaaagaccaaatcttttaccttcagccttaggaggaatatgctgggtaggtttcccacagagctttcacttaaatatttacgtggccccaaccacaggctaatccctgtggttacgtgggacactaggctaaacaagccaccacatttgccctcctggaccccagtaaaacaagggcagagagtttacaaatgcataaaatgctgcttggagtgtaggactacgttatgcaagcacagcaaagggagtaatttagatccatctggtagtatttccaaacctagcaaatcctaaaatccaaaagcgcttatttgatctgattcagccacatcaacatttttatccaccaacaaactcttattcactgaacaatggcacagatgagccaaaataatatttgctttgaatgcatttatattttaaattgggtgtgtcccttgttccgagaattcaccacaccccaaacaaattgaatccaaatggaaggttctaattcagaagaaaccagcacatagtttagctgcaccaaccctatctctttagtagagtgattcctggttctgtttctatccaagaggagaggtaggtaacaccactactctaactgaattgaagcctatcctcatcccagcactgcttatttcattcattgaacaatattaaatgagtatctactatatcagatactctgccaggtgttgtggatatgccagaaaaaagaaaatacctgccctcaaagggcttatgtctactggggccagcaggcataagtagagggttcagacaggaaagagtcaccaagctattacaacatattatactgagttttagaaaaaataaaacatagctggagtggattctctaaacagagggaacagtgtatgcaaaggtctagaagcaagataaaacatggcatattcaagaaacgtcaagttcaataaacttgcctacctatatattaggtagacagctgtagcatttacttgaaatgtgtatgtttgatgaggaatataatgagtccacttctggacatgttgaccttgggaagcctgagagacatccaaacttaagagctatctggccgctgcagacactgctacctacctgccaacctgatacagatacttggcatagcctcaaatctgagaagagtcactgtggccttcaaacctgggttaatgccaatttttgctttatttccacaccatatcagatttttgcttactctgcagaaagtgctagtaaagcaaaacccataaaccattctgagggccagattaaaactctccttgagttctccaaggtgactaatttcaattcttatctttataggaaaagaatctggcaggaggtctggatggttactaatcagttatcacccttccattacatctcgttgcaccaagtggttgtcacaaatttgtctccttttgtgttttcccctctaacttatcagtgaagattagcagaagtttgtggtattgaaatttgtaggcaactgaggatttctggggctaagcgtgttcatttttaaggtccatgggcttttggcatatactccaggtaccacttctggtcatcctggcccagtctggtgtgtgggtccagagttcaggctggtgacagatttgggcatcattactaaggttgtcatgaggctgtgcaaacctctagagagtacaaggaaatcaggagagagaggtcaaagggagaactccaaggaacccaggaataatggggcagacggagcaacaggagacaggaaggaaaaactaagaggacagaaggactccaggcaatgaaagccaaggtgaagaagagggagcaatcattcaacagaatctgatcaggaacagagagtttaagtgagaaagagactgagaagcctattaaataaggggtctttgttgaccttggagagagaagtgggttgagaagggaaagaaaactgaggactcagacaagaggtacagaaaacccttcagaaaggctggcaataaataagctacggataagaggaagaaagcagtagctagggccgcgagtgcacaaatggatatgcatgggggtgtgggtgctgggatgtgggtgtgtgaaagaagagttttaaatacatttaaaggctgttgggaaaacgtcattaaagagggaaagcctggagactatggaggagaagtgataatcaataccacatgttcccgagggaggggaaagcgttctatctagagcacaggtatagaaaccaaacctcttccattacgggagggaggacagatggatagatggtagcagtgcagaaacttgcaggtctggtgacaagctgaggaagccacaactcaatggctctccataaagcaggaggccagagcatctgctaaaattgagagaagtgagcagaattgagagaagttgaatgagggtagagaagataccaaataaacattgtgaatgagagagagcttcccaaggcagtttttcagtgagcacattgcaaggggtcctgaaatcaatactttttaaagaaaggaattaaaaaaccaaagtacaatgcttataggaaagacaaacattgtatataataacattaatataacatgtgcttatgtgtatactgaattgtgatgtaaaaatgttctttctgtgggtggcactcaacatatttgaatgccaacagactagaacaaataaatcacttataacagggggtccccaacccctggtctatggaccagactggtactggtctatggcctgttaggaaccagagcacacagcaggaggtgagctgcagtcagccagcattaacgcctgggctccgcctcctgtcagattaaccacagtattagattctcataggagggggaaccctattgtaaactgcactgcaaggaatctaggttgcatgctccttatgagaatctaatgccagatgatctgaggtagaacagtttcatcccaataccatccgccacccctgccactgtctgtggaaaaattgtcttctgcgaaagcagtccctgccaaaaaggttgggggtcactcacttaggagaactgaggtgagggtggaaatgattttagtttgtggtggcagtaaccatcattatggcttatgctttacacctaccctaagttagaagaggtaattaagtttaaatgctcctgttaaatgctgtgactcaagaagaacacataaaatatataaagtaatatatcttatcacttactttacttaattatgctaattaaatcttttaaagtaattttacagtaaattaacaggctatacaagaacaaggtctgtactactccgaccacataattatgctttttgctatccattaaaattcttacatcaaaagctctttaagtgatctatttaacttgtagatgtgtgtaaaaatgttaaaaggtgttttattttaaacccacccatatttttataatttacaacagcaaaatgcaagacaaaaaacacataaccctattattgttaaatactctctcataactgaaggcaaatcccttctcttagaaaggtacttctccaacttctacaggaaccaaagtgactccattagagaggaatgcatttatttgccattctcagtcatttgtgagatgccccattgttacagatgaatcccaattcaaacagtcaaaaaatgaacattgccatattcctcattttgccaaataccaattattattcagagaccaagataatccctcaaagtcattcagccctaaattctaatcccataaatctgctttatgggttagaagaaagcctttgaaaatacagtaagtcaggtaatagagtctaccacacccctaagtcatttaacagacccattatcatttactaaagaaaaaaaaattaattggaaagtattttgctcttaatgtgcttcagaaattatttgcaaatatagctgtgaagtctactttgtttatttccagtaattaaatttggttgcagcagagtgcggccaggagaagcacgtggccattatttttccctttagggtgattcgaactcctagaacatgttaacccatttatgcctagtgttccattattggaacactaagcttgtgggagttatttatatactactgctcaaggtcatcgccaagatctgatttatcacacacacaaaaaatttgcaacctccagcataaatgggttaattttcatcataacaaaaatgaagctattttatatgtgtcacactgtactaggtaccacagaatgcaatatttttctcaggtaagtgtttatttcttaaaaaaagtcaagtcaaccaaaatgtacaaataagctcaaactacaaaatgactctagaaaagatgaacaaatttgttgattaacaaatattacctttccatgtggcctgcattcattataaattcaagagaatcaatgacattcaactctggaaaaaaaaaactccttaaacgcagaagttcatctaactcagcagtattcaactttttgttttcaggatccgtttacacccttaaattaccaaggaccctaaagagttcttgttatgtgggttatatccactgttatttatcatattcaaaattaacaaatttttaaaatacttttaaaaataatctttaaaaccacatattaacctagatactttttatgtatttttccaaaagaaaatttactaagaatggtattgatttgcgcttttgcaaatctcttcaatgtcctgcttaatggaaaatagtagagcttcatgcctgcttctgcatgcaatttgttgcaatacggtgtttaggttgaagtacataaagaaaaatctggcctcatacagataaacagttggaaaatgaagggtgtcttgcaatcatcttttgagatagctgtgggtattctttcgtactttccccaaattgaacaaatggtgctttttagtagttaattacaatatggaatatgaaatctgacaaactttctgtgctctgttccattaaaatccagtggtctatttgcgacttgaaagggtcttttacccatgtatgattttggaaaatactggttaactgagttatgtagcttttttttttgaaatgcctacacatttttttttagaaaatatcccccgaaaagtacattattaatattactatcaatcttaccatacacatcttcagtactgggaagctgtcaagcacagggttgcaaatatgagttttccaaaatttcagttttcactttcacctgacagctctaattttatcattggcagataccatcaggtgtttttcttgaagtaatagcctcatttctgggaaaatatcaaatggtttaagtgttcaaaaaaggattgttaggatatacctttgtgatgaattatgtggccaatataccgtttacaaataatatacagaaagttgtcgacttacgatggggtcacatcctgaacaacccatcctaagttcaaaatactgtaaatcaaatatgcatttaatacacctaacttgctaaacgtaatagcttggcctagcctactttaaacgtgctcaaaacacttgcactagcctacagttgggcaacatcatctaacacaaagcttattttatgcttaagtattgaatatctcatgttatttactgaatactgtattagaagtgaaaaacagaatagctaaatgggtactcaaaatacgatttctactgtatttgctttagcactatcccatcataaatctgtaaaatgctcataatataatgttaactggaaaatacaaacaaaacatgtttatattactatggtatcagctgtgcttcaagaagtttgcccaccttttcctgaacttcttctgtattagacaaaatagccataaaaccaaacccaaaactcgtacccagagggcaggtatttatgcctttaggagaagaatttacaaatacagtcataaataccaaatattaacagttatgggaaaaactgacaaatattatcatatttaagttagatttacaattttttaagcattcagtttaactgacacaaacaaaaataaattaaatacacatcctatttgactacaatcaacatggaagaaatgaaacccagtcttttggcagacagggtataaagaagcatgaatttacaggttcttcctaaaagcactctccgtttgagatgctgacagaatgggctttgtccaaaattcaagacatttttgctaatcactttcttatattactaagtgtccacatgatgcagtattaactcctaaaagctattttcattaacatgactgcagtacacaaaaaactacattattaataaaaaaaattccaatagtctatgtgtctatctacccctctgataattaaaaattggagagaatgattaaccactcaccaattcaaaaaaagatattaactttttcatgaacgtcctaagagcttttttttaatttttatttttttttaagtacgaggtccatgcaaaacaaagggcctattctcccaaggttccccgaaacaaatgcatcctctaggatgtcctgcactttcaggctcctctctttagcacatgcctaagcatacaagctccacagattgctagcaaaagtaatgtcaatcccatgattctaggcatatcagtgtctgctttcaactatcacatttgctatcaggttgaaagaaaaaaaaacaagcgaaaccatccttggcttgggttttatgagaaacgttaccatttttctggtctaataattatttatatgtaagccacctctacttgactgcaaacctgttagggctgggcccaccttttatgcctttgtcttctcactgtctaccaccatggcttttaaaagatggtaccaaataccagcagttattgttcaccaagcacttatgtgcaaaacgtttatacatgtcaccttaattccccatcatgaccttaataggtagagagggttgtcctctttctatagaaataaagaggccaaagataaagtaactagtccccagttagcttctaagtaatgcaaatggcatccaaacacaggtttgggactaaacaagtgattctcaaactttgttgagcatcagagtcatctggagggcctattaaaggaaattcctgggccctgcaccctgattttctgattaaggagatctagaaatgggcttgataatttgcatttctaacaaggtctcaggtgatgctgatactgctggttcacggaccactgagaacaggtgctctaaccacattagcctcagcaatgtggaggtttcaacgtgttgaaaagacaatgatggctaacgaggccatcaaattcatacagagtaaaaaggatggaatcctgacacatttttcaaaattaaatttgagaaatgttttttcctacttgtatatttttctaccctaccatcctggcagagaaaggctgataagaaaccaaaagtcctcagtcctctaccttatagagagggaacgttcaagactggccctaataagcaggagagtgctgttgtctcttctaagacaatcaacagctcagtggcatctgctggagttagagaaggtagacagctttcaaacttgactagctatttggagaagattgcagctaaatctatgcgactgtgatggagaggacccttaatgggaatggaagccgaaggaagaaggaggaaatggaatctacaagaggagacatctactcagaacattaattctggatcagatattggctaccatgccaaaggatcatagctatgttactactgatttatcaatagtggccctgattcacttggacagctgaagagttcaatgtaacaaacttctgcctaggaagctgcaaaattggtaccattaaaacatggctctttcaaattgcttaaaactctcctactgaaatgtacacattttcagcaacatttcatttctcagagtaacatgactttcaaggacaaggcaaaaagactgcaataattttactgcaggaatctactctgaaaagtaaaagctataacacaagattgcagtaattttattgcagggaatccactcggaaaagtaaaagctgtaatatagctattacctacgggggttatctccaggagcatcttaattttcctgaaacgtttatggtgtggcagaaagcagctggactcttgcattccacacagatcaagacacaagcctcacacttcatcatggcaatagcaaaataactgaagggaataaaaaaggaaagaaggaaataaaaccagtggccttatatctaaagagaagaagaaaaaaagaaaaaaaaaaacacgtggtcagattggaaaccaaaccacctgattttgcctaagtcacgcatctcatctggttctttaattcctcattttacaacaatgttctgggaatgaaaagaggcactttgctctttagaaacaaaaattaagtgattccgaaagatatgatttttcagttgtaagactttgtgaggtaaatatccactaaaaactgcttcctaaagccagcacacttcgctgctgcaatgcttttttaatgcagtttgtccctgccaaaacttgcattgacgtttacatacaaagcattacacaatcttccaggagacttggtttctctatataaatacgaaaacggcatctgcctccctccccagtgatacaatgagcagagggccttagtcacgggtcaaacacctaaagtctggcctggtaattattagctcccagcttgaaaactagctcactgaacttaaaatcttttcttcctctcaaaggttagttaggatgctggccaactatcttccagaggtcttgtgggattaatgaaaaggttaaaatattaaggacttacactcaatgagagctattctcatccatctcagctattataaaagtaaacactcccccttacttccctgtgatactctagggggctgcaaaccacagcccatgggccaaattcacctgccatatgtttttgtagagcctacaaggtaaaaagaattttcccacttttaaatggttaaaaaaatcaaaagaagaatatcttatgatgtaaaaattatatgaaattcacatttcagtgtctgtaaataaagttgcactgggccaggcatggtggctcaggcctgtaatcccagcactttgggaagtcgaagtgggcagatcacctgaggttaggagtttgagaccagcctggccacatggtgaaaccccatctctactaaaaatacaaaaattagccaggtgtggtggcacatgcctgtagtcccagctacttgggaggctgcggcaggagaatcgcttaacttgggaggcggaagttgcagtgagccaagatcacgccactgctctctagcctggaggcagagcaagactgtctcaaaaaaaaaagttgcactggaacacagctatgtccattttgtttacatattgtctgtgacttttatcttaccatgggacagttgagtagtaatgtcagagaccataggacctgcaaagcttaaaatatttactaagtagcccttaacagaaaagttttgcctatccctgtgctctgggcccaagtctgctatgcctctgagtatcctgagacccttagagaattagccctgcaaacaggcagctgtactgagaagcaacattctgtttgttttatcccaacccaacctggtatctaacaaatgcttctccttctagttcaaagcaaggctatgacgtcacagaatgaaccccaacctcaatgtctgcactaagggaagggtagagcagctttctctatggggccacattttcagtaacttagtcccgtacttagaatcttatactccgccttctaataggtcttcacagcagctctagaaatctcaggcttcttttttaccactatattagggtacctttggttgaacgttcccaaaaccccttgagaaaatttaaggaaaatatgaacacacccccttttcatttgttgtaagtacaccggggtctctgggaactggagggctacacagaggaacttgagcatatctcttgatttttttcccttctccacgcacccaactccatcatgcttccctcactgcaggccaacccctctagttcatacgtcaccaggatttacacctcccctgcttcagagacagactaggagtagaatcataccccgtttccaaatgcccgggagacaggtcaaattcacacgtctaagtgtaacagtgtaaatggaatgcagggcaatccctagaaaatgagaagggagagatctgaatagacaataccttaaatatccactctgcctgccataatataggtagggaaaacaagccatttaaatttaggaagagagacagtaagtctccttccaaagacaaggctaataagaccctcacagtatggggcagtctcaggcatttgaatttcaactttcattaaaatcctaggtcttatgccaaatgctaggaaaaactgttgttctttttatagttcccctaaaaaataactatattattttggtcctggctggagtcaacctctaccttcaatctacatttcttttgtgcttgcttccccttcaccccttctacacacacacacacacacacacacaaaaccattatcaccagcaattctgaaaaaacctatacaggaaaaaattcagactagatattcactcccccaaagtgggactcttgtttacccagcaacgatcaatgatgccacttacaaacacattacacaaccccacagggcttcttacacatacagccagagtcagtccttgggagttggcagttcttgggaaattcccaatatctcacatagggctttatttgtatttatctgggagagggatgggcagaagatgggatagcactactcccttactttttttcttttgagatgaggtgtcgctctgtcacccagtctagaatgcagtgatggggagaactcctacgctcaactaatcctccagcctcagcctcagagtaactgggattataggcgtgagccaccacatcccagccacttccttacatttaaaggcacctcagcacttacaaagcttttttgcacaccttgttgtatacaaagtgatcttcaacatcccagcaagggaactacctccctccatatggacaaaaaaacaaaacaaaacaaaaaaaaaacctaacaaaaaaacctataaaagattaggtatcaggctcaagggaacacaatgggtcataaaatcagggatccaggtcacatttcaagcctagggtatttatggttttgtttcattttcttgttaaaataagagcctaagttactgaccagttagcatgtggcctcgggcaaataataaattgggtcagagaatcatgcacagacatgacttggccaacagttggctaattatgacaatttagcaatgattgcattattaaactatttcagcagaacaggtttcacactcccctgtatcccagggcacgttctctgcagctctttccttcctatcgtccctgtagcaggccctcagtgctcaaccctctgctccctttctttaaaggctgccctggaaatcctcatcagctctcatagaggcaaccactggcacaccaaaagtgacttcccaagagactcttgggtctggcaattcactcctctgctactattaacccaaatgtaattatgtttaaattttatcccctcacccctagaactcatcttctcttcagtgaggtatgttgtaaaaccttcacgtttatataaaatccacccatcagtgttcatatacattatctcatcttcacggtaactctgggaagtaaagagggcagcactatcattcccatttaataggtgaagcatgccactcaacctctgagcttattctgtcaggggcaacattcctcagccacctgatggccaaaccaaaatccagcaacatactgagatatgctacagcatgatgagccatgaaaacatgccaagtgaaagaagccattcacaaaaccatatcctgtacaatttccagaacaggcacatctacagtgacgaagcagataagggaggcaacgggaggcaggggtgactgctaatagcctttcttttgggagtaatgaaaatgttttaaacgtagtaatggttgcacagtcctgggaatatactaaaaaccacggaattgtataccttaaatggataagttgtatggtatatgaattacatttcaaagctattaaacctaacttctgtatttatatgtcttataaaaaaggtatgtctgctaaaacatgatcttaaattagaatgaaataaagtggaatggaagatggataaaaacccaaaccagctatatcttcaactcctttctgttcccttccttcaaaatgtctctctcacttagcaaattctgtcactattgtagccaacgaatcttctatcttaatccaggcctcaactctacaaacctgggttactgaaacaactcctccctgattaccacatctctagtctcttccctatcccaacaatcctaaagacgtccgaaactcttcttccacaaagcaccatcttcctataccacttccctgctaaaacattagtacctaactcagcatggaactgaggtccctcaagggtccaaatgaactctaccttttcccagttcattctagcggtctcacctagtcctctgtgactaacacacgtgcacagcaccaccactcctagaaatcctttcttctgcttacagaaaggcccttaggatgtaccactgtcatcaatttcccttgaacattccagaccataatgtttgtctacctaccattagtagtctgactcacttgatacttagacaacaagaaaaattttgtatcctgtctcccagtaagggtcaaaaggtagctaaggtagctagatgatacgacatcttctgtgccctgcccctccatccactaggcctaggatactgctatatacaaagcgtctctcaatttagtgaccattaaagaacatgagctcccagaaatttactatctaatttaacaccgcagaagctgctggcaaaacaaaaatttttttagtttgggaggtggatttctttaaaatcatcccttagtaaatctttggttacctgggaactagttttaacaagcatctagaatgtccaagcactgagtttaaggggaaaaacacattagctaaaacacaccaccttggaggagccaacagttttactcaatggtatcctgactggttagtgcaggacacacgacaggaatattaacggtgactgatgttatctataaaagctaggcttttttttcttaaaggtgagaatgcagtagagaagcaaaaggtatcaaaggaacaaaagaagaatggcagcaaaagttagaaactaagaaggcagcagcacaaacagatgggtgggtgaatatttgatggagaagacagggatgaaggaaataaaagtcagaccagccttgcaacctggagggagacaaggcagaataattctctgcttaccaaacccatggaacaccagcaggcaagttccctccctggcgtcagggccccgcaatctctctccaggtggggactgggccttttgacttcaacagactctactgcagggaaccagaggccaatgaactctttttcaatgatacctttttcaatgataccttaactgataaagaatgcttatgtggctaaattcctgtctcttgaattaagctactgcaatgaggacacatcaaaaaaacacttccttcatatctctagaataatgtgggttttatctcccccaaggtgacaccaaaacaaatgattaaattgtggtagccttctaaatctgattaatgttattcagactctcccacaaactgtttgccattattacacttgctaattaggagctgtaaggtctttatcttccccaacctacagtcacatgctcaggatggagctttgctaaaagcaggactcctggttaatactgttaatgagtttagcactgccaaaatgtcaatagttttttatttggtcagaaagggcctaatttacctagttcagctgcccttggtaatgttcatggaaatgtcagagcagcaatcaggggaaacaaatggcaataaagatgattactagaagggtgacagcgaaaaccccactgacagactgcttttatttttctctcaccactgcaagatttcattcagagataaggcaacagagtacactgagttcagcacccaacataactgcatattttttctaaagtataattacatttctgcaattttgaaacggacataatacaagaagcttaactgtaaactttcccaaagaaggaagagagaataagaaaatgtttcagggaaagaggtgggaagagctgaactgtttaacattactttctttcatttacaacagggtgtaggatgctaaagaaaagggtacctacaggaggtagatctagatctaactcttttaccacttttggactaggaaaaatgtttatgacttattcgagacaaagattccttctttagcattttcaacttaacctttcttaggtggttaggaatgtaatagttctaagtcagtaatgaataatacggctgttcatctttaggtcatccacgccagggtgtccaaacatgggctatattcactaaagcgtgcaacagaatgtgggggaatgcccatgtacctgtgctgacttcggtggctggactaagcctttcactgatagaattccaaagtttactggggcacacatcaaattcattcaagtttttaggaaaaaagagaaccatacaaaataaagaaaaataaagcactcagcctagtccccaagggctaacgtcctttagaataaaaaacctaggtacccaagataacaatgtgtcgtcccctttgcacccactgcattccctacctaactccctgtatcccacacaatgggacacagaaatgcttcatgttttctgatgtgaggcccatttaacttttttagcatactagatgaagcaaagaataagataacttttccacttagaaagttgagaaacaaaaattccaatgccaaattccatgtgacctgagctatatccctaacttccatgcatgttaccttccaggtaattcatagatccgtgctttttaaatcaaagggcccacacactaccaacactggtgctaagaaaagcctttgacagaaagataactgcttcactttacctcttaaattgccctgcaaaaaatatatatatatacaaacaaaaagctgacataattcaatctctccttggggaaatttaacattttgctaagacaaggataaaaatatttgcttcatttttctatcaatttacctagattaagcatttaaccacgccattgattacagctgtatcactcaaaatgggacccttagtgagcaagtatgttcatgttaagacaatagcaggaaatatacttatctaagaggcctttgtttacatttctaagcacagaattgcaaggatataatgcagctgactcagctgcctgtggattcctatgcgcttaagaaatgtcttgcttttccttgactcagtttcccatcattaacaatggcacagtcatctcttctaccacctacctagaacactagattcacaaatggttgggtaaggattaagcattgtgtacacagtgaggatcccttggctcaagtctggaaccagaaaacagatgaaacccatagacaagaggcctacttataatgaagaaaaagaagaaggttccttatgatcagtcatccttactttagtaaagaatttcctagtgtgaaatttcaaagaaaacctgatatcaagatctgaaataaagggagtaaccatccaggattgccaggactagcatagtttttgcactgaaattcctgggcaaacagaaatagttggtgctatggtttgaatgtgttccccacattgggaatgtgtcctggggaaaacttaatccccagcacaatagtgttaagaggtggaaagttttaagaggtaattaggccataagggctctgcccttacaaatggattaatgacatttatcaggggagtaggttcctcagaaaaggatgagtctgtcccccattcccctcttgccatgtgatgctgtccatgatgttatgaagcagcaagaaggcccctgacagatgacagtccctcaatcttgaacatctcaacttctacaacaatgagccaaataaattcctattaataaattactcagtctgtggcattctgctctaggagcacaaaatgaactgagacagttgaccatccttaacagagactcaaacaagtaagaatatttgcataatcaaagataactgattaacttaaatatagttactttaaactcaattctctgcattaaaaattggagattgtttagctttagcttgtttatatattatctttttctggattttgcttgcaccaaaagggaaatgggtaaggtttaattatctgaggttttgccacttactgtgggagtccaggcaagttatttaacttctctgtctcaagttcctcatcatgtcaggcacacaggaagcactcaactatgagccacaattattatctctaatattgtaagtctagtggaatggccgtatttgttctgctggtgattttcaaataccactcatctgaataaatactatgaattttttcttttaatctcagaggagcctgcaagtataatcaggttgataggctctcctttaattcttctctctttccctgacagatctaaataaaaaaataagcaatttaatttccttcttcaatttaaaattgggctctactgtgctcattttagcataaccaagtgatagaaaattcttttaatgataaaatatcattatttctttctcagtaatttctaattatcaggatacacttgtccatgttaggatatgtttccgcttccaacagctaacctagaaacaggaataagctcatcagaattctagcaacaccagtaacaaaacataattaggttcttggaatttatgagcccattctttcaacaaaatacagtaattattcttttaaaaatgaatatgataatgcttggattgcaaggaaacgaattatgggacattactctgctatcgtatctggcaaggttccctttactttgctgtccttcagtcatttaaattttcaatggcaagcaaatataaccactgattatcacgtgggtaggcagcacagaatcacaaaaacgtaataatgttgactaaatagctgctgtttcttggggctgccagcaaccagagattgtagaaatgggacaagaaagagtttaaagaagttactgttacttattactatttcactattgtgaaaacattaatgaactaaggagagagaactattagttcaataatactagaaagaaaaataaaagaatatcttaatctgtatttatcagaacagtactgaggggctgaaggtgacaatgaacaaacttttggaatagaaagacaaaagcaaagtttcctccaaagcagaaaattcattcattaccagttacagaaggaatgccatgagtatgtgtcctttcccttttctaacaaaatattctaaagggggtcagaggtttcccacttgctcagggttttctaagaactgcccccagggaatgtactgtggatcagcaatgagatcttaggaaagttgatataaagctggaaatcagggattgtatacttcattctgagttatgcctacaacattgcagggtctttctcacttgggtctttgacttttttggtattgggttaagtatgacacagaaatctaataggacataaagtagcagacactcccagccactgaacatacatacaaacttgtaggggaagcaaaacatgagaaacaggatcaggccacattttaaagaatttagatgtgtgtgtgtagagactaaatgcaatacaactgttaggaaagaggggttaaagtaggtatggggtggtgccaaggagaatcagctgtactaaataagggtattttcctgattaattgtattaagcaaatgaatgcaattaacactaggcaaatggtcacaataataaagatcaggaatcttctcatccatattagacgggatgagaaaaaaaaaacagtgagcaatatcaagcctggataggttaaaaagcattatgctctgttcctgtctccttccttcatctcccaagtctgcccactatgttacacccctaattgcactcctaattatgggctcctctcaggatattatgtgtatgactgacattcagggaaagagagggcttcgcctctgcacagaaaaacgctggcttctccagcacatacaaacaggtaaacattgtatacccaacatgtgtatgaagcaggataggggacctccagaagctcatcaagagtgccacacaggggatttacttcagtcacgccatcagacagtaccacttcctgtgatagcttcaatgcttgtaacaatgtgtggtagcaattacagtggagcataaatcagatctgggtgttagaaacttcttggtcccttcttctaaatgatgtgttttagcaaaccaacttccccctaggaaagggggaaaccaatagggaagcatttgtactaaggtgagatcatttaattttgactaaagatacttttgttttgttttgtttgagatggagttttgttcttgttgcccaggctggagtgcagaggcacaatcttggctcactgcaaccactgcctcccgggttcaaatgattctcctgccacagcctcccgagtagctgggattacaggcgcatgccaccacacccggctaatttttgtattttttagtggagatggggtttcaccatgttggccaggctggtcttgaactcctgacctttagtggtccgaccgccttagtctcccaaagtgccaggattacaggtgtgagccaccacccccatcctaaagatattttgaaggttaacagaattgaggccagactagcattttggaagctatttcccatcattcaaagggacaagtttctattacaatcctttggtgggtctaatactgggtgggctatggaatcactaagtataaatgttttcatcatccaagttcccacaatcaactctttctattttcataaatactcatttctgaatgaatgttataccttatgcttgagaaaatgtttgcactgaatgacatttctggctaggaagccaggctctgacacctcctgcaccatgcctagattcccagcttggctttcagcatgccagtgaagtgggggcagagaaaaacaaggccagcttgcaaatgcttcactcacacagcttgtggccttccctttacttcctgaaagccacaaaaacctaagaccatcctagcaaccaaagcctccagccagtccatcgcgcgggtgggccactggattaatgagctccttaaaggaaaaaacaaaaacaccctgaagctacaagcagcccctcctccattgtgctacaaaaatagtaactctgactctaagagctaaattgattatatgacacagtttgccaaaccagtaggtaaaatgttgctctagattagcattttggtcagatacagtttaaacaaaaattaaacttttaacagtacacttgtagttagcaacacagttcaatttaggaacttctcagtaataattttgtcattatttataggaagtcaccattaaaatacagaaacactagcaatgcgtaattgtagcaattttgggccagaaaataaaattcagctacctctgtgattaaaaaggactccactaggccccagggattaagcttcctacattagattggttcacagactttgcaaaacagattaatactaggctcatgcagagacaggtatagcccgccctccatttccatggattctaccaaccatagatcaaaaatttcaggaaaaataagaatacaaataaagaaacaagacagtataacaactatttacatagcattcacactgtattagctattataagtaactagagatgatttaaagtatacaggaggatgcgcatagcttatatgcaaatactacacccttttatatatataaaggactttaacatctacagattttggtgtagcgggaggtcctggaaccaattccccttgaacaccaagggaggctgtatatgtaaaagagtcataggttattaaatgttcaagtgaaattccctttttacaaaacattctaaaattgatttcacttgttttgtttttttttttttttttttaagcaggccaaccccaactcccatcccatacccatggatgggctgtcaaaggccacaggtggcaagaatctcaaggccacagtggccacattgattctggccccaaagggtaaccagtgtgggaacagcacagcagcccatgctggctccccaagctgctgccttcctccttgccccacacgcctcccctgactccctccagacaccctggcagcactccttcaccattgtaaaggcattcttaaataagcaacaggctggagactgagtacgcaggcctgggtagaacaacagatggtcctaatttattatagctatgtgtttggtttttttaaactgaactttatagtctttggattattttacaaagaccaccctggggcatcaaggtacccttgttttttcttctttaacgtcagacaccaattctgcacaatacactgctcagtttcttcatttacactattttccctctctcctcccccactttccttcctttgatctgccctaaagatattagaaaacacaaagttatgtaggtgtgcttataacgaacacagattgaaaacctacatacttactcagtcgttaactgtatattatgatatataagatggactatcagagttattaaaaatcaagttgtttgttttttgagacagggtctggctctgttgcccaggctggagtacagtggtacaatctcggctcactggggcctcgactttccaggctcaagtgatcctcccacttcagcttcccgagtggctgggcctatgtgtactcgtcaccacacccaactaatttttcttcttattttttttttttttttgtagagatggtctcacggtgttaccgaggctggtctacactcctaggctcaagtgattccccccacctcaggcttccaaattgctggaattacaggtgtgagccattgcacctggccaaaaggaatcaagtttttaaaaagaagctatatcaaggaaaacttgaaaaaaatgcagaatatgattctttaaaactcaagtatgatccctttaaagaaatctttataactaaagacataccggccaggcatggtggctcacacctgtaatcccagcactttgggaggcctaggcaggcagatcacctgaggtcaggagttcaagaccagcctggccaacatggtgaaaccccatctctactaaaaaaaaacaaaaaacaaaaacacaaacaaaaaaaaaacagccagacatcatggcgggcacctgtaatcccagctactcgggaggctgaggcagcagaatcgcttgaacccaggaggcagaggttgcagtgagccgagattgtgccactgcactccagcctgggtgacagagtgagactccatctcaaaaaaaaaaaaaaattaccaaaatgttacctgatagtaaaatacaaaattttttgtttactcatttatttcccaagttttgtatgaatatgcactatttttatgatcatgcctgcatactccttactctttatcctgccctttctgtaaggagtccaaggtggaaatgctcatgtgatgtgaactaattaaatttttcttaaaaacaattttaaaaaccatgacttaaaaagcacggtctgctttagttataatggcagattctgaactatacacacatgtattatatatacataaaatgctagaagacagactatggtcctttcatctgcatttgagtacaaacagtaccaaatggttacttcataccactctttatttatgtggtatatgcgatattggcatctactgtggagagactggaataaactatatgtctacatcacccatcagccatctgcattgtgagtgaacagccatgaagaccaaagatgcccaaatcctgacctgtctctgagccttattatccaacagtctactgcacatttccacttagatgaccagcaggcatctcaaactcagaatgcccaaatctagactcatcattcctcacgaactggattttactaggagatctccagtctcacctatcagcagaatcccctcagaaacctgggtattattcccaatgcctgtccttccctgcaacctaccaagccatcttccagctccaacagccatgacaacatggtctgagaaaggagtagcattatgcaaacagcagggacttcaggaatcaaaccctaattgaaacctggccctgccatctaccagacctgtgaccttggacaagatccttaacctgtctgagcttctattctctcacatcaaatgcccctaaagacaggatctgtctcatgggaccatggcatactttaaatgaaggccattcactagaaagtgaatgctgagggtcaggcactattaggcactatgcaggtactagggtcaatggtgaataacagccattgtggtacgaaataccaagtcctcaggcctttacagtgtattaactgctacaatgcgaactacccaatgcaacggggaacacaggagaggagatggaacctagaccgggggtggcaacatcagaaacagttttccaaggtaactaacatttaaactaagtcctatatgatgagcaggaggtagacaagcaaagtttaaggatgtggatagtataccagtggaggaatagcaaatgtgaagttgtgaagtccagagacaaccaggcaccttgaaggtgctgaaatcagcggtgttggctggaggatagaatgtgagcgacgtggctggagatataggtggagtgatcaacagggtatatggggctgggtacctcgaaatgaagggtttctaggcagggaaatgaccaaacaaatgctttcaaagtgcttagcacagctgaatgctcttcttgaaacctttaataactgccttcattctcaccaccatatagtctggtttatgctgtccagaaatttacaaatcaagtgtctctttttgcaagctggccttttccaaatattaacatgttagagtatttttaaaaagcaattttaaaatttttctatgtcgttggtatattaaaggcaagaatataaagggaaaagcccatgagtctttagctggggtttttgatagtcagatgtgcaatgaaaaggttaacttcttttctgagtcataaacctcagaactctccacacaactgatctcagtaacttcccaattccaattgctgtgttaagtagcacttataagacactacatcagcctcatcatttcacgacatggtgtgctccagtttcccacccaacccacataagcaccaatgttcaatgctcagagtcacccgaagcattgcaggctgattgctttgatgaaaacttaattctaccactgaggaatattacagtgtcgtattgtgaatgaaattcacccagtaacccagacctcattggaataccttattaactctatatagtaatctatgaacactgacattaaaaaaaaattagtaaaatgaatttaaaactctttcatttctactggattaagaatcattcaccccagaaaagcaattaacatatttgtctcttgcaaatgaatatcggagcttaactgcatggacttcgtatctttgtaagaaaggatgtctttttgcatgtagaacacaattatagataaaattatcccccaagccccatcttctaatactattcatttttaatttggaaagaaaccttgataagtccagatgcattacgttaccattctcacaagctcttacgaatttttagaataatcagagtatcaatggacaatatacatttaacaatactaatttgtaacaggatgctttgaatatcagaattattactgtgcatcactaaacagttttgttgtattaaaggcaatatgttttaaaaagtatagatgtagcttttgaaatgcataaagggaatacttgcaaaatgaaattgaagtaattctgtaccatactgcttcactagaagtatttcaacaaaataatatggtattgccattcttcacatttatcatttcttaacacaatctgcaacaattccagctcctggagctactcccatcatcccaggactacaacttgcttccattcggcctccacactgatctcttctcttcctgagagaggacacccagagccaagttcagatactctcatgtaatctggctggaaacaaagctctccaaccccagttgtactgggtgggcccctggggctcagtgtttgccttcagaagtagatagaggcgagctgtagcccagatcctttttcatggaaagggaacctgggggtggtgggttccaggggctcacaccgctggttgatataaaagtagttgccctatgtgtaacttttctatctatctcctagtattattttacttattttcattattctttattatcatgtattctgtcaagcacactgcaacaatgtagggtatgttctgatacgaaagcatttctccagccaccagccactctcaccagcaaaggtgctgagacagagacataggtgaacacactgtattatagaattctaagtcgtaagtcagaggggtgaggagtgttgccagacttcatggggtacttggcactcaccaggagttgagaaaggccttccagagaaggtgacatgttgagtctagaagatgagttggtgtcaccagatggagaaacgtcatcacaggaagaaggggcagtatgagctttgttttgagagggcaggagggaggaggaggaagaatactgactacaagaagattttgtattgcacaagacctgtgattctccttttacctgttggatattcagaccaacctaggttggaggcaacagcttagaggtggcagtcaaagccatgggaatggaaaccaccaccataagagagtccatggagatgacccagccatggaagtccaaggggtccaaagctccacaaccaagtgggaggtggaagagcctagggcttaggtttagggcttcttcagttcccttcccattgccctcatggtatatgctggtcagcaaatgaccaaactgcttaacaacttcaaaacactggcaggaatattctaccacttcctccttttgaccattagccaaaacctcaataaagtatcagaggctttaaaaaacttcttgcaaataaaaaaggtagctataaatgaaacacgtggccttcgttgctatgggggatattccaaatcctctcaaacctccagccatcattgctgcttcaaagcaatgctctcaccagtgcttctgtaaccttcttccagttaaccaattgcaactcgtacagtaattcacaaagtgtgcatcactgataaaacttctacagtaattcacaaagtgtgcatcactgataaaatctttacagtaattcacaaagtgtgcatcactgataaaaccttatctccaggaaagaatggtcatgcaccacatgaacacggtctgtttctctgcagtgcatccttattctggacacaggcagtgaccacaatgccacctctctcccatgacctcaatcatgatggtcatccaaaggttactgggcacaagagggattgaaaacaataaacctgggacaaaattagggcaaaagtcataaaaatttaaaaggaattagtattgccacttgttagcttattaacattctggctctgtgaatccagaaaagaaaatacccagtattctgacttgacactatttggataaacattttcccaggcaatgagcttttggcattaaggtagagaaagaaaaaaacaacagcaggcagtgagactctcagcattcctgcatattgttttcatgacatattggtctacacttaagaacttctcttaaattatttgagtgctcacaaatatagctactaatgcttctaaggcacttctactctacttggcatcttcagcaagtaggccctatagtagcaaaatataataataatatagcagcaagaactggcaattactatgtatttactaggcactgtgataatcactatatgggttatgtcactggccttcacaacatttatctagggaaaatacttttattatcactactttataacagggaatgtgcagcccagaaaagcaaccttccccgcatcacctagctaggaagtggcagggctatgatttcagagtctataactttagaaaaaaaatagttttacagacaaagaaactgaagtgacttgacccagtgaagttagcagagaaggtgccaaaaaacagaggcctttcctagtcattcaacttagtatcctgaccccaatatgtcatcactgctagctggggatgttttaatgccaaataaagaagacgctccatctttgacactcagggaattaaagggtttgaaggcagctttatcagcatcagacactttcttcagcagtaattacatgtgtgtccagacagcattttcataagcagttcagatgcccaaaatgagaaacagttttggaagtcgctctgtcaatcctaccaaaaggcatactgacttctgctccctgcttccatcagattatgccaaaagagagacagagacagagagaggataccaaatttgattttaaatctacctattctaagctggaaataaaaactcttcctgtcctggagtccaatgcactcatttttccctctcctcaatcttaacaccctgttaataatcagcccaggcccaacagcctctgaaccactacatttcctacagtagtcccatatggcgcttactcttattcaaatacttcatcaaaagtgctcccaatcaagcatgaaaataaattagattttggtttaatcacgattagagtcacatcaccaagaaataaagtaacagagttacctaatctaacagaccagcctgtgacttcctggctgctttccacaagcccctcttgctaaagccctctcctaaaactcctctttgaagactgtgaaatcacatgttggtggaaaactgttactcttcaaatgtcacagacataattcttaactctgtgcctgcctgacattgctagtcaggccacaagtagagttgctgggtgtcggcctgtgaaaagtagcccggcccgacaaagcatcagaatgcttcttattcttgggcactctggaggagccttcctgggcttgggcagagcccatttattttctgtggagaggctattcactcttgggctgtattttatactcactttcactcctactggaaataccaaggcgtgagtactgtgcaaagccccaatatggagaaaataaaaaatggacaaaggagaagaggactaagggattgataatccagaatatgcaaagaaactctgtaactcaacatcaacaaaagccaaaccagatttaaaaataggttaaggacttgaacagatatttttccaaagaaaatgtataaatggccaataaacacgtgaagagatgctcaacatcactaaccattagggaaatgcaaatcaaacccacaatgagataccacttcacagccattaggatagctacaatcaaaaatataaaaatttttaaaaagaaacggaaaagaacaagtgttatcaaggatgctgagaaattttaaagaaaggagaggcttgaccaatcactccctgtcaacatacagcagctagcaaaccagccaaagagtaagctcatctcattattccccccgcaaaaagaaaggcgtattgtccctgctaggctccaacaatctttgtcaataaaagcctgttgagagcaattacaacacaccctaaaaccacagttaaagctaaaaataaattcttattactaattacagttgatcattgaacaacactggtttgaactgctaatgtttgatccacttacatgtgtaaacttagcttctgccacctgggacagcaaaaccaaacctccctcttcctcctcctcagcctactctacatgaagacgatgaagatgaagacctttatgatgatccactgcatgaataatcaatatattttctcttccttatgattttcttaataacattttctttcctccagcttactttcggactatggtatataatacatgtatcatataaaatgtgttaattgacttatgttatcagtaagtcttctggtcaacagtaggctatcagcaattatgtttttgaggagtctaaagttatgcacagcctgggtgactggcaaaatcccatctctacagaaaatacaaaaagtagccggatgtcttggcatgtgcctctagtcccagctacttgggaggctgaggtgggacgatcacttgagcccagtgggtagaggctgcagactgcattactgtactccagcctgcaaaatggaattctactgcaggggtggcaggttggtgtttctatgccagcatggtttaagggtcaactgtattttgatagtgtgatctgtaataatgttgtatctagatatgatttactgaagaattaaactttctccttttaaaataattacagaatattccaaaacacataccttaatgtaaatatcctgtaatatagaaatagaggaagttgaggcagaagagaaaaaaatatccctgggaattagaaaaataaaatctcagtactacatttccccttttgccactagcaagccttcttcaggcctcagtttctttatcagtcatgcaaatggttaggacaagatatcgcttaagtcaaatatatgcttaatagcaccacccaatagaagcacttcctttgtctgattccatgtttgccaggcaattttctggtcataatctgactgccaagtagtttttcaataggaaataagtgtcagcattccagtctccttgcagttatatttgttataaatcaataaattgatattaaagttcataaaaataaagtctgattctaaatagttgaaggaaatgggtccatgtgacagtggaaggcagttttcaatttttctaattcaaaacccacctatattatacaacatcagcatccatcaatactgaaccatcaatcaagggaaagcaattttcaaatcattcttggccagtgtccatgccactcatttttttaaaccattcctttttaggggaaaatgaattcacatacactgaagatgtcaaaaaaataattacagtgtatttttatggtacataataattacttttgactacagaaaatgatacagtttgaaagtttgggaatatacacaggcttcaaaggcgggaagccaaaggagaggcatctgacgatggatcactctgccctcttctgaaaataccttctttaactggctttcagaacacaactttccaggccttttctttgctaattcctcctcttccctacatctccccctgcctaccccgccccccacccccacaaaatatgaaaagaataagaaagtaaaacaaattcaggcctgcgttggaaactctccagggagatccagatactcttccagggcttatgaagccctaggtgatctggccagaactgttttcttggacctcatctccttccactctccccctgctcactctgctcccagtcattgctgccttgccactcctgaagcatagcaagagtgccctgggctctgcaccttggccctcactcttcctttctgcctgaaatgattgtcccccatcttcacatgactgtgtccctcatttcacagactcccacagtgaagtcttccctgatcactcaaacagcatccctccccatttcattccctgagagtttttcctttacagcacatatcaccactgaacatttgtgtactgtctatgtatctgtgtaggatgcatagaacagggactacatcagttttgtttgttgctgtatccccagtcttacaatagcatctgacatgtagaaggcacacaatatttgttgactgaatatgtgaacggttacaagataataaattacagtcaaaatgaccaaactaaattccatcgaatgggtactttcaccaaaatagaaaaggagttaatccaacacatctgtcacagtaaaatggcaactgggatttggtccaaacaacaacttcaaagactgttgatatcctatctaccacatattgactaggtgctggcaatatagtgatcaactttactctgtctctgccttcaaagacctcatggtctccccaaggaggccaacttgtaagtattctgaacacagataagggaaggaacaactaacctggagacaccgggggccgctgggagaagagcaagaagactctaagagtgctgtgtgttctatggacaagttcacacaacccacaggaaaacaggaacaaggaattactcccactctcaccacataaccagtcagaggcctccattccttttctaactgcaaggccatcttttccctagttggcattcttcctttgacaactgcttcagtatttctcacaaccccagctgaagttaactgacatgcgcacacacattgaggtttcatgaaactttctgttctcaaataatcacacaccatagattttggtttaagatgcatttccacctctggccccataagtcctatgcgcgttccaggcactgatcaaatctcatgacaagggatctgctcaaaatattccaccaaccaaaacatcaggcagccttcaccacacaaatttcccagttcaatgggcttttttattgcttatttacaaagttaacaaactcaacatatggtttttggtatggcaattggaattaatagctgctaactacagaatttttttccctaaaagactttctcaaggtttaaggtctttgctgaatttaagaaatatcttgaaagattcatacatgcaaagtgctttacaaccttattcactcctgtggcaatgaaaacccttgaaaaggtttcctctttcctctctgtaccaattttggctgtttctagtcaacaagagaaaaaggacattggctagaaagacagggtatctctgtagttccagtaaatatttactctataaattgaacttctgtttatctgtgtaatccacattacttgcttttttctttttttcacccccaagagtgaaagatatcactgttgggaatccgggcagatatatgggggaggaaagagggttcaaaaaaataattacatacaatttatctctgctatgacatcctctcaccaatgtaaataatccaagtcctaactaatatctatcaattcttgttgtcttctttggcttgtctgattttataaccttgccaacacaaacccctcctctcagaatctagagatggcttaaaatataattttcattttctgtaatttgattccctggatcaaaaactaactttgaaatcttcatcaacaacttcttttttttgagacagagtctcgctctgtcgcccaggctggagtgctgtggtgcgatcttggctcactgcaacctccacctcctgggttcaagcgattctctgctcagcctcccgagtagctgggattacaagtgcccgccaccatgcccggctaacttttgtatttttagtagagacagagtttcaccatcttggccaggctggtcttgaactctcgacctcatgatccacctgtctcagcctcccaaagtgctgggattacaggcatgagccaccacgcccagcccatcaacagcttcttaattttgctataaatgcaggtttgatcttccaattgcagccccacctgggagaaagccttcctcatgacttgcattgggtaaatcagctaggcagctattacaactgcacacttgactttatttcctgagtatcaccatgacattccctactctagataagtgtgcccactcacactcagggttctggcatctccaattggtagcaactacctctaaggtgcttccttaagataagaagtcttgggacttaaaagcttcccaattggtcaaagcacttcctcagaatcaagcttctctccctgcttccaggtctgtggccatcccagttctgatcacctacctggtctttgagtaacttctctgttcatatcacatgttctcctttttcttgtcttccacctggttccagccaaacgaaccatctctgtggcttgatctactgcacctgatccactgcatttgactcaggacctcaatgtcatgttcagcatgtgcttctgcaagacctggctgtcagccgctgccttgccatgcagccgtggccactaacttcactgggcccctttggctttctccccaagcctcggcactctgcagccccacagtgatttggccaactgtagaaggaacttaaagccctgcctgcagggctgggaaagccctaattcttaagatatttaaagctttattcttctctttctggcacctcaagtattgtaacatcaatctctgagatgtctctgaatacacaggtagtgggtcacaggttgtaatattccaccttccttgcagtgaaaaaaaatagaagtctctctcccaacccccactgaatgaggatcacaactattccttatcgacgaatctgcttttagggctctggaaagtcaatgctttgaattcctccaccacttggaggctatggcagtgactatatccctttactctaatcatatcatttcatttttatcaaaatatctgggtattgcatagggattacaatacaaatcaagttaaacaggcttattaaaatagaatactccctccttggaacatgtgatcaaaagctgagggcagtaacagaagctaatgaaaggaattaatgtacacatggattcctctgagtgtgctctggagaaaggctacctgggcacaaatcttgactccaccttttacagtctgtgtagtttcgatatgcttttcccccttcttatgccataatttctaaacctgtaacatgggaataacagaaggcacctcagagttttagacaagcatgtcaatatctgggaagtgcttagaaaatgtgattcagagttattacaaaccacaaaatgaacagctataaagcaaaacaaaacaaaaaactaaaaaccattgccaggcattgggaattaagaagtcagggttttaaggtaggtgcggtggttcacgcctacaatcccaacactttgggaggctgaggtagatggatcacaaggtcaggagctcaagaccagcctgaccaacacggtgaaactctgtctctactaaaaatacaaaaattagccgggagtggtggcacgtgcctgtaatcccagctactcaggaggctgaggcaggagaattgcttgatcccgggaggcaggttgcagtgagccgagattgcgccactgcactctagcctgggtaacacagagaggctccatctcaaaaaaaaaaaaaaaaatgaaaagaaaaaagaaagaagtcagagttttggacaaggctctgtcattttgtggcttctggagtgggtttaaattggttgcaaattctttgtgacacccctcttggagaggtgttttctacttacttctttaaccttaatctaggctgggaaaacagctgttttgaccaacagaacacacagaaatgatcctgtgcccgtttcacttccatattttaagagaacaggcacctttacctcctctttctcggaacccagctgccatgctgagaggaagcccaagccacatagggatgcccatgttgaagagaattgagctgatctcccaattcacaggcaacattagtttgccattcatatgattaagccatcttggaagtagatcctcttgctctagtcactgacacaagtcttccccctgaactctgcccaaactgcaaatccatgagtaaataagatggttattttcaacctctaaattttggagcagtttgttggattctgcaccaggtcttgaccctgctcttcttacgcttatgctaatgctatggctaagacagacattcaacagctcattacaatgaagtgtgattttctaaaggcagaggactataaagaggcaaaaaagggtgtgtgaatactaggtgatctttcaggccccttccaatgctgatattttataattaatttgatgatgaacagcacagctgcgagctggccacttggagatagtcacacaagataatctaggtagagaacaactttcttctatacaattctccttcttaattagagcatcaacgaagaggtggcatttcaggagttactcaacacgcaaatggtgaaagcatggagagttgcctctatggcctaattcagaagtggaatgatctgatacaaaatgatttgaatgaagatctaagaagaaagtaagggaaatatgatttccaggggcatccaatgtttccaagtaaatagtgatgcagaattttgtctgtccattgtttaaataatgtttaaaaggcaaagagtttaagttgattgctttgtacaaattctttgagtaagaatattttttcatctccagaggttatgattgccatgggagaaattttttaaaaataaatttttatttttgtacataaataggcaactgtctaccagacaaccagatcaagcagacaactactctgcaagaataagtaaagtcaagttttaccctaatattgttaaaccttaagatatcttccttccagatacctgggattatttaacaagattaaactacatactggccccacaaatttaaccaagaccaatagagctaactgctgatctaaaagtcacgaccacgaagaatatgccagagctgtcccttggaagatttcgggagaatttaatgctgcttaaagtgtggccattcggcttcttgatcatgggggagagaggttgaattcaaacatttagtttttgcaatgcttttgatttgcctgatgttgaagtccttccttaatctcaattttaaaaaaaaatcccttcaaatctttatgacaggaacagctatagccaagaaaaaagaacaaatcactagtttatccgtctacattttccttttgtatttctgttgttactgctatgaattcctttgctttcaaaaaagcgttcagacttgacataagccatttatggtcaataaatacataaaaatatgtttgaatgttcatagaggcaattttactatctgctgtaatcaactcaggatcttaaatggctattgttcaaactaaagatacaaaaggaacacactcatgaatttcctgttttccattttgaagtacacatgcaaaacacctcatgcccaacacccatccctaggtctcctaattgtgtatccctcgcacacaaatccctcctatctccctagtatccaagcattcctggagtactaggtgcagaggccaacacctcagtggttgaccaaagcttgctgctgtcactaacaggatcagcagatgacaaccagaaattgattaaactcactctctagttcaggatgttacagagtcagtgtcaacattactgtcaaagagtcaatgacttctgtggctaggggacccttacagaaggagtaagcccgcaagtcaacaccaatgagagccattttgtttatgatacccaggataatggcaggtattttcagagttcttcctacccctgaaatgcctactaaacatcaggctgaaactgaccccacagtgacctctagacagcattgaggctcctgggcaatcagagagatggcactaaaggggccctgaggggttttattagctctgcttccaggtgaggaggaggactcaaccatcaaaagtgaatggcaactttgccctacaagatattaagcgaaaactagtgtttaagagaaaaatgacagggaatagaaacaccaaagatctaatgtgaggaatacaaacgaattgtatttgaatctatggatactgctctgtggatattagaaaaatggtaaatactaaagttattgcccatgttaaattgaactgagatttagggtccacaaggtatgaaccacacactctcttgccttacaaattatctttacacatattctaatttaaaatatgtacaagccgaggcaggcggatctctttaggccaggagtttgagaccagcctggccaacatagcgaaacctcttctctactaaaaatataaaaaaattagctgggcgtagtggcacatgcctgtaattccagctactcgggagactgaggtaagagaatcgcttgaacccgggaggcagaggttgcagtgagccgagattgcaccactgcactccagcatgggtgacagagtgagactctgtctccaaaaaataaataaataaaaatttaaaaaattagtgcagaaagtaaaaataactaccattcaacctgcaggataactaacattgattggaaagaggtacaactaaatcatggtacctaaaactggctcgaaagcaagcaaaaaatgaatgagcagacaccgatgagaagaaaagaacatctggtaaaggatatagctgaggaaggaacttatttccttaggaacaatattatgtcatatactgctcaaatagttttccagccaatgcagggactacaaagcactctcaactctttcatttgcctacaagctttatagggattacttagggagtggatacaactaggcaaaaaaaatgggtaattttatgtggcacctgagtgtcacattctctgctcacccaatgtgctcaaggacgtgccaataggactaaagtcaattcacatctcttccttcactcagggttctagcccccccttctcctaagtctgcgattcatttaaacaaaggttactggacagcactctgctgcatagaaacatcgtgaagggcctggcaaagagtctctgcaaaagaaatgccttcagttttggggttttcaatgaccttagaagatcaccaaaggcttctcctgaaacagggttagtgatggagcagggccctgggttctagttcagatttgagaccgttaattataaaattggcaaaagtcacttaaatcctcatgcctcctccctcacctcccatttttaagttctcactctcagcatttcttgagtcttctacatcacaggggcaacagccgttaaggattagcaaatgctctacttcattcagccagcacctcaaaatgctatttcaaaccggagcaggaacagcacagcagcagcatgacacttaagagcaccaggcagggcccaatagcattcaccagcccgacggcagacctcctaggtttcccccaaccccatttaatcccccctctttcccatcaccaggtgttccctcacacacacacacccccgcaggggctccatccctgcatttttcccttcaccattggtagtctgacatcaccattatctgccttccggctgcttttacactgttttccttttcttcctctttcctctcttcagccatactcaagaaacacggactacttatgctacttttgcccccataaatggctcagtgatggaaccaagagggaaacccacagacaccaagcctctagctgtagacactaagcacacagacttcctcttcttttcagcacccagttctacgggcttctcatcacttttcaggtattcaaagctttgagggatgtgcccgaagcatccctaaaatcatgaaaaaagatggctttgggcatcttaccgctcacacatttgcatagtgtttgatgtagctttaatttcaaagctggtctcaaacactcaagtggataggttacagtgggagcccaggaattgcaaatgcgcttgcctcaaagactcaggagtccagatccgggcaggaaataaagttctaaagcggctttgaagtgctttctccccagacccctccccagcgcgggtcattcatctcagcctagggaagagaccaccttgcctgaacgtagccaaacgcatcgcacgtgggagccaagtgggagatgaaataatccaatgcgtccccctcaccaccaccacccccaccaaattagttaccgtcggcttaaactcatcgggaatgtccgtgtattttaccgatcagggaaataaaagggtgtatataaattagtggaagcgggtgggaaggaacaagggatgcagactgtcgtgagtaaaacgcctcgcggcttggtgagaggttgtttcttttttaagccactcatttcagactgaaatatcaagccagttcaggtcatttcctgagtagcactacaagttaaaacaagatccagaaaatctactaatcttcaattgcgctgcctccagactgggagcacagggggatagggtgtagggctgtggggaggtcgaggggagggggatttgtggaaaagcaaacgcccgagaaaccctagctcccgacctcagctgtttcttacctcactcagctcggccgaggagtcgtttccatatttcatggcaactccggaattcatgatgcacttttcagagctgggctctcagtcccccaggtctcggagcttaagagttggacttcacaggctcaatatccactgcttggtcccttctgccacattttagtctagacagccattttcacccaggacagttgcgaagcgcaaacggaggatgcaggcactcttaaaaagagcagccgtggctcgcgtttcacggacgagccattgctgcaggaggctcggtggcgcggcgcgctcgcagctgcggcagcggcggagcccgcgcggggaccctcccgcgcgcacccagcgccccgttccggggcagtgccaccctgggcgccgcctcgccactcctacggtgcctcgccgccccccattaccaggatggagggcacttcccagcacgagccgacaccctagagggcaccggcgagctcccgaaaaaactagggcggtggggcgaggaagatccgcgcctcggattccagagaaggaaagaaagctagagggagccggagcggagctgcacttcacgccgaagtttc

SEQ ID NO: 2599 - DNA, 466733 bp, Homo sapiens
gtacactgtggaattagaaatatttattcagaatataagaatgtttgtaaaatattataaatgtctctgtataaataaatggagtttttaaaaaacaattctatatcaaataacgcaaagtagctattttacagcagctaaaactaaaggcatctggaaacatttaaagaatacaagtggagaatctaaaaaattacaaggtatagtacagtgttaagtagcaattttaaaatgagactttcagtacaaacagtagaacaatactgacaaatgcaaacttagtcacatgtgctttaataactgacaatacattcaagcaggtttttctaattcaagtgtatagcacatattcaaataataggaaacaaatctcatgcaaagtaaataaatcttgatgtctaaaaactgattagaactagaaaagaagtggacatgttttattatctttgcattacgttctaacaaaagcagattatcaggggctcttactcacttgccattcctgacatgagcactataagtgaatactatgagttctacaaacagaacatttttccacatgaatttgacttgcaaaaagtgcaaaagggaatggtagaaccagaattactaagtacggcatcagtgtgaatgtgggggaaatttgtgtataacttgctttgttctgctgagctgatatttcacctgattagcagatggatgactgtggaaagatgaagtactagtcaaggatgtggttttacatagcagttgctatttccgggactgaatgatttcttcctcttggtcacatgcaaaatctcacccagatgtaatgtgataaacaaacagtttacccagtgtaacctttaagcaaaaatgtatggtgatctgcatgtgaaactgtctttctctacacaggtattagcaaaacaagaatacatgaacagctgctatcaacttgtatactttttttccacttgtttatattttaacagccactgagagatcagtgatgctgtggtgacagcagtcagcattatttcttagagaatacaaatgtattaagttagagtaatttcaggtgtgttaaacaggagatgcttctgaaggccacaagtttggagcttactttaacctgacctacatgaacataagatttgtaggatgtggataaactttaagaactggatagtgaaggcgtaacttttgttttgtaaccagttacgcctcttctgtaaactctataagagtgctcaaaggtgaatcaaacttgtatatcattccttgtcaaataggctgttcccactggataagaaaatttgctgtatgttttcctgaaaaattttatagtgttctacaaagccatcaccttctgcagaaaaaaaatgttacttatgctccacctccccagccctcactaaaaactttggtagccctatggcggtaccctaattaaggtcagtgcagaaatctcaaccattacagaagtctcttactattttggctctcaaaatactctaactagtagctctgtttgctgaatctagaagtaggtagagctgtaaatagtttaatagaatgattgggacatactcccaattaagaatttgcaaattgtttaaagccttatggaggaaaggacactttcagagatgtttattttttaatagtcatcttgatatgttatcactttaaagcttgataatcgaaactcttgagagctattaaggttgactgatagacttaaaaagtgattgctttataattctcgtgggccataggaaacaccttcagaagggaacaagcaactatggaggttctttaattcatgccagggacacaggcagtccaatcttgatcgggtaactacggtgcacttttttctcatttaaaataatctaatctgtatccagttaggaaccagaagactttcagatagtttcatgttttccttagagtggtaactttctttactactccttaacagcttttaagaaaaagcctatgggctctaatttggacttccttttggagtagaatgtcaaggctctgacttagaagaggtccctctaaaatattgctgcaggctcagagaagacttagtgcatgcatctgaaaggagaattaagcaattttaaaagttaagtgctagttaaacataacatttgtttcaggcagcatggatattaacttcagaacgctgacaagccagccgatgaggatgaaagtttcaataaggaatcatactgttccccagtccatgacagatttttgtagctggtaagctcacactgatggcactcgcaactacggacagaagtctcttttgcttgtgatttgcacagttggttttgtttgcctcagtccaacaatgggaaatatattccaagggaactgtgaaatgggtcctttggctctgtgcccatttcttcaaaagccaaagactgaattctgaacagagatggttactgactaaaagggggtaaccactgaggaaactagggagaacaattcaaaatacgaaatctgaaggtttttaacctcatataaattagaatcaagatcattgtttaccctcattggagatgtttgttagagaaaaattcaggtagcgccaggttattcacaaaggaaaattacccaggaacctgcaagcatttaatttaatcagtatagtttagttcagtagctcccacaattagcataatcaagtgccacctagttcaccttcaaggattgtgtcttggggagtatttgaaaaatacaagaaaaggaaaaacttttatagcttttttattatacatatttataaaaaattaacacttttgcctgcaaaatagtttttacccaaatcacatttgaaagtactaaaactaaggtcaggtagcatgagtaaaactggggcccttaacaggagctggagccgcctctgcctgggggaattctcagagaaggggaggttctctgattttacctggagcaagaatggagacagaagtcagtaggcaggattttattcctgcttcagccacatgtttctgtgtcagtgaaaatgaaaactgcccatttgatgcctgcttaatcacaaaaaagagccatgcacatcccactttgctcaggggaggacgtttccctaggcaagctggaaaaatagtgaaaactgatttttttttttttggggcatatgtttttcagccaaaacattttcctcatgataaaatgcaactttatatgaaaagtgaaaaattctaaaaaatcacaggaatggccaggcacattggctcatgcctgtaatcccagcactttgggaggccgaggtgggtggatcagtggtcaggagttcgagaccagcctggccaacatggtgaaaccctgtctctactaaaaatacaaaaaaactagctgggtatggtggcgggcacctgtaattccagctactcaggaggcagaggttgcagtgagccaagatcacgccactgcacttcagcctggtgacgagcaaaactccatctcaaaaaaaaaaaaaaaaaatcacaggaactaactttgaccaaatgattgacagaaaccagtgaacattttcatagtgatcaaagcaccccaaagctggtccttctagactgataccagttgatctgttgtttcgttttggagatgggcagcctcactgctggcctctcagtggttgcttttaggatacagctgtctgccctccgaactggtggctggagtatcctccagcgaacagaaggctgtggaatttgtatcatgctctgaaaatagacctacccgtagcttatggacataaagactctatgcagaaacctcctcaactttaatttgtagtcagctatggcaatggaacacatttttcatagggaactttggatggattctctggtgctacagaaaaaaacagtaaatggtccttcaagtgtatcagtgtagaactgagagagaagaggtaaaactgaaaaagaataatgaatttgttttaagattgaagaccttcctgaaataattcagttactttggtactgcctagccctgtaagcattttgcttgaaatttaaccttttaagcaccatatgctaaccatcaccatgtatctgggggcaaaaaagaagccttaactaccattccctcactctgtccccgtcatgacaacaggagctaagtcttgaactgggggttacacagcactcttaagtaggcgtgataagttttgcaaaatgttcagtatctcctcagtgtcttgtccttaggtagagacaggtccagagctacaaatgcacccatgtggaagagatttgattcagcagaacagcaattatgtagtgccctggggcgggaagtgctaataatgtttctcagctcttgaagaaacccctgacagaattttagttccactacaggtatcaaaaagattcccagctctaagtcttggatattaataaggctccactgagagggagaaatcccagaatcaagagagcgctcccttcccagccctgcctccaaaatgaagattgaaggaagtttttattctctcaatacaaaattgttcaggcacagtcctggtggtggtctgtttgtaactttagtgtatctgggactgtaagtaacacctgtctacgctcttcccatgacctataactcccagagatcacctcttatggccgcctctatcttaaagttgagacccgggacttggaaaccaaagccttgctgtagtaaacaaatcagcagtccttttaaatgctggaggcacacacaggtctgttttcccatgaagcaggaggaaagaggagaaacgagattctagaagatgagcccagcatctaccaaaaagaggatacaatggaaaatcttacagaaacaaatgtctgggatcccactgatgcacagccgccagaccagaagaggagggggagagtgagtgctgaaagcagaaacgaggctctgctgagcaggcacagaacatgtgtttacacgctgttgtgggcccaggagggaagagcgggcacctctggatacagtccacaatgtcaccatggccagtcgccccaagggttgagttggggcactccattgtccaagtgccgacctacctgccagccttccctttcctcctcctcccaacaagtacatgggcccttctgtccccagtggcctgctgcagtttacttcccatgggcagaactccggtgcgtgagtgctgattaaagcgaagtttcattggtgtgtggcctggagttctcctcctctagcagagctattctttgcttgagcatcctcacttgggtctcatgtctctccaccatggccatcatctgcgactctaacttcttcagtttgttttgatgctttttctttgctttctcataggcagccaccaggttgctaggtgggaatgaagggaaattggtattaagattcatcctaagtagcatcgtgacaccatcctgtccactggataaccagatctagtgagcactgctctgaagaaagatcactcatcctcttcggtaagaatctgaaatctagtggtcagaggagggacagcaccaggatgtcaacactcaacggccagtcacctactggcttaaccctgatgaatccagccggattgctagaggctggtcactctcacatattagaaggggttctaagagtcaaaccagcaatccaaattggcccagtccaaaacggataaatacaaatagtgggtctatttgttgctccatggttgcttgcaacatagtcaagtgtatcttacaggagagtactcctaaggcactgcaatcaaagtgaccatacctgggacgagagcagagaggttgttcttgttccaccttccctttatgctttgggctggtgggactcggaatattaaattaggccataagccaatgctgcaaagccaaacatggaatatacaggcctttgaactgttcccaccagagcctggtggtagggtatacagtgagcccaggtaggtccattccatgtacagtcattacccttacagctgcagttctcccagatagtctgaggactcaccccagagatttgtaaaacccattcaggaggtctgtgaggtcttgagcttttatttccaactatagagctggatgatgccaggtgttctcaatatacatccacataatgttgactacagaagcaaatgtgagaacctagctgtcttctattaagccagacattaaagatttgcagaattgtaagaccagtgccacttttctaattatttcttggaaaatagtttttcataaaaatgccatttttttttttgtaaatgaaataataaaaactttaaataatttatcttggttttagttctaacatgagaagtatcaataaatacaacttacaggaacaaaagctctctgaggtcctccgttttttatagagaagagtcctgagcccagtcttagagcagtatttcctgaagtattccagtggatattgtgttgctcaaataaattccatggctaattttgtttggaaaatactggcttaaacagattttttattatatgacttctcagaacatttaagatacataataccaggaggcatataccacagtatgctacatttggccaaaggatgttgttactgagcatttcttagtttccacagaccatcttgggagatgccactctaaggaagaccaggctcttagagagccaggtagggactcacccactttctagagttagttcttaagagttagggaaatgtccatccctggtgctgtgtctacatgcagggtgtcagtccaagtaccacaggtggagggcggtgggggctgggtatagggagatttttacctgttggcccgctttagatcattcacgaactctgcagattgctgatgtcggatttcactgctcttggtgagtctctccaaggcactcaccagctcttgaactctggccttcaacttcttttctctatattaaaggagacaaaatatgccaggagtagtttgagatgatgctggaggtgcccactccctgggaagtggtgacagaaagaggaaggtttagcttgcaaagcctaaaggcaagggagagaaaagatactaaagggcccaacagcgctactgtcacctgaatgaattcattctcaaatgcagatttaaacccatttcttcaatgacaagggctttttaaagatcttatgtgtcaaagaaaacaagacaggaatttctgtttctagtcttctagctaatctagaagttcctttctactattggcataccagatcctcagcaatgagtgcggcctgaccacaaacccccgtctgtctccatccccttctttttcaggtgtcctaagtatctcctgaaccactcaggtttagcaacctaccttgaacaggtccccactcattgagaccaacatgatcccaccttgccaaaaaccaaaaaattggtagagggagtagatatgatactctcttcattgtaagggtccttatttcccatgaaattacatttgcacttttgactacgtgccctccacaggcaaagcagcttcaagttctgtggatcctctactactttggtaacccaagctaattagagtcagttcagggaggtttccagtatccagtcagctcattgccttcctctaattcccacaagacccagcagggaaacactaatcaaagccttctcgactactctgactcccttccaagatccttctatcacatgcacagtgttactccacttagtagcacactcagcactatgtcaccgtattacgtgctggagccatgacgctcccccatggtcatgttgggttctagagtggcaaggactttacttggtttgattccccaatgcacccccagtgctgagcaccgtgcctgggtgacagcttctagtgactgttaaaacagctttagaacaacttactgaaggtaatgtatttgattctttgggcatattaagaaaccaggatttagggaaggaattcgtttaaaaaggactcactgtatgtagaatgtaaatttgcatgattaatttataagacagttgggtaggatctagcaaaataataaatgaacatgccccttgactaagcaacttcacttctaggaattgattttacagagatatcaggagcacaggttcctaaagatacatcacttatatttggattcacttaggcattggttacaataatgcctaataaagggagacaagcagggaactggttaatcacggcctacccatgctaccgaaatgctctgcttgaaaaatatttttaaaatgcagatggagggctgggggcagtgactcatgcctgtaatctcagcactttaggaggccaaggaatgtggattacttgagctcagaaattgaagaccagcctgggcaacatggtgaaaccccatctctacaaaaaaatataaaacttagccagatatggtgggtcatgcctgtagtccatgctactcaggaggctaagttgggaggatcgcttgagtccaggaggtcaagaccagtgagccatgatcctgccactgcactccagcttgggtgacggagtgagaccatctcaaaacaaacaaaaaaatcagatggccatgcactggcatgggaggatatctgatacattaagcaaaaagggtgagttctaaagatgccatttttgtaaaaactgaaaagctgagtgtgaatatctgacactgtaataagactagaaggtgaaacacaaactcaacagtgcttaactcctgaagggggttgatgggaggctttcattttctacttcactcacttttgcattgccagatatttttacaattttgtatattttctgtaaagtgcgagttagagtcatgtaggaacggcatgggaatgtgacgtcggggtagaaggctcctttctgctgcccaaactgttcagaccctggttctcctttcctagcttttcatatatctaatcttttacatttctgcctttagctactatgagggtaagtcaagctctccaaactgatcaatgaagaaaggaattacaacgtaaaatccaggcctgcttttgggagagaggatggaaggggcaggatctttaagggaagtctagcaaccagccctcagcccagaactcatttttcagtaaatcctcctacccgcctctgctaagctggaaggagcgtgtgtttttcctgggccctagcagcctccaggacatctcggatctggctgcatttcctcccggcattggagagtggcagcatttcctaccagcagtgaggatggtgttgcaggaggggggctcctttcctccccacccgccccccaacacctcctcggccttcccagcagtcctcctccagcggagggaagccagggactcctgcttccctccagctaaaaacagcagggaagggttttttgccctacattttattaccatttagagccctttatctttcattctaatgttgattaatagtgtaaaaggaaaaaaaatactgaagagttaaaaatgtaaccacaaactcaataagaaattcacaacaaaaaactctgggatgctacctagagcagtcaaatcccctccctcccccactcctatccacactcagtgaacagggagactggaaatcccagcccttccacaagacaaaacgcttccttccccagcacccaggccctcaggggaccagagggaactttctggatctggcaggctccaaaggaggatagaaccccagaagggcaggagagagtctctcagacccaggccaaccccagcttagggttgtggcgcaggagtggggagtagccattgctgggagcttagaactgcctggccttcagaagggaatgggagtgaaccgctgggagaaaccccaggaaagaactatgatgctcatttatttaaagatgcaaagacgaggccaaactgtaaacttaaacctaaaatttgggttggttgatctgttttcatgacaacacaaaaaaatgtaaaatatctatttagtttaaaaaatactgattacaggggccgggcgctgtggctcacgcctgtaatcccagcactttggtaggccggggctggcggatcacctgatgtcgggagttcaagaccagcctgaccaacatggagaaaccctgtctctactaaatacaaaattagctgggtgtggtggcgcttgcctgtaatctcagctacttgggagcctgaggcaggagaatcgcttgaacctgggaggtggaggttgcagtaagccgagatcgcgccactgcgctccaacctgggaaacaagaatgaaactctgtatcaaaaaaaaaaaaaaaaaaaaaaggatactgattacatgttgagatattttggacatactgggttacattgttattaaaattaatttcatgtgtgtctctacttttttcatgggactactagaaaatttaaaattacatacatgccttgcatttgtggatcatattatatcaccagtggacagtgctgctctagaccaattgtttaatgctgtcagaggcatgtgaaccagagcaactccatcttaaataggagttaggtaaaagtgaggctaagacctactgggctgcattcccagatggttaaggcattctaagtcacaggatgagataggaggtcagcacaaaatacaggtcataaagaccttgctgataaaacattgcagtaaagaagccagccaaaacagcaaacccaagacggccacaagaatgacctctaatcgtcctcactgctacactctcaccagcgccacaacagtttacaaatgccatggcaacatcaggaagttaccctataacgtctaaaaaggggaggtatgaataatccaccctttgtttagcatattatcaagaagtaaccataaaaatgggcaaccagcagcccccaaggctgctctatggagtagccattcttttcctttactttcctaataaacttgctttcattttactctgtgggcttgccctgaattctttcttgcacaagatccaagaaccctctcttggggtctggatcggtaatattttccagtaacagcattaccagatattttccctggcttctgactaagtaggtttcggttgagacccaggaattgcagtttaacaagggccccagctgactcttgtcatcaggcaagcttgagggactggcgtaaggcagaagagttcctcacctggacctgaggatgagcttcagttactcctggaactgactttctgaatttatatgcaaaattgcaagcacggggctcactttatcaagtctacagttttcctcagattttcaaacgatgacatggaaaatgcaaagaaacatagcttactaattcaagtcacattgaaacctcaaccattcttgttcctttctccttctaatttaaatttgcttagcctttcgttaagattttatatggtttgggtacataagttaggccaaaacaagctttcttggcttcacacaaatgagaaagcaaaaattcaacactacacgttccatatgcaccttcaatagtaatgtattcatacagtgtttcctggaatggccagaaatacataatccattccttttttatgcccagtagtattggcactcacaaatataccccatagcatcaagcaaaaacaatgctggattgtaatgactgtgacaactgaagtcccccagtacacacatggatttcagttccacgtcttcccacttcagcttttgggcttcttattcctggtgataaaaggtcgtatgactctaaccgcagagccagggtgggacttttaagagacagggtcttgatctgtcatccaggctggagtacagtggcacaaatcacagctcactgcagcctcgacctcccaggctcaagcaatcccctcacctcagcctcctgagtggctgggactacaggtgtgtgccaccatgctgggctaatttttaaaacttttttttttttttttgtagagatagggtcttaactatgttgcccaggctggttgcaaactactgggctctagtggtcctcccaccttgccctcccaaaatgctgagattacaggcctgagcaactccacctggtggattctttttaattgaaacgtaatgtggtacgtttcaaggcagtggaatatacacagggaattaagaggcagcctcgtggtgtgaatttaaaggtaatatgaaaaccaaggtggcttgccagtacgctgggcagagcgaagcaagcctcggaagtggtgcttgttggtgtacctgggtagcctggcagtgcggcttcgtgagccatcagtaaggaggttatattctccctaaaataaaaaggccagcagcggtactctgtgattagagtccaattgaggagctgcaggagtcatcgggcgagagcccagtctcaatgaggctgtgagtggcttcacagctggccaggaaacctttcagaggagctgtaatcagaccaaaccacagggagtcacagccatgcagccacaaggcctagaatttcttagtaattgctgattatatggaattagtcactaagagaattgtctgcatatgtgatgtctctcatcctcaccttccatttacttttaacccgtcaggctctgtctccactgacgtggatcactgagctcaccagtgagctccaagttgttgcatccagcggtctggtcccttctgtccttttcttacctgcccgcatcacctgcagggctgacagcctctttgctcatggcttgcacaaggcctccagagcctgatttcgttctgcttcattggctgctccctttctatactccatgacaaaatactgggtgttgtttaggacttgggcctggcctgtattttatcttatccttttctctaatggactccctccattcccttttcctaaaaacttccacactcttaatcttctggcctttccttggatctctggacttgtctgtttgcggcctcttaactggcatctgcgatttcacatgtccagaggattacttcccagatgacctccaacagccactctctctcctgtgttggctaatggcaccacctttcagccagtcactcattgggctcagatctctctgccttcttgcaaaggcagtttaagttacttggagtaagccttaactcctcctcccctcatccttgacatctgttcaacagcaaactctatctgccaagtctcatcctgccattgtcaccacacccaggtccaagtggtcatcacttctcacccggacaaccacaacagcctgctaactggtttctctgtctcctcccctgcatccctctgccctggttttcacacagcagcccaggtaacatttcacatgacagatctgatcatgttactgtccttcactgcctttcacctacacgtggaataaaccctgtggtcttgcctggacctctaaggccctgcttgacctgagtgctacttgctgggcctttgggctgctggaatcacccttgccctgatggaatcctgtaggtcctcaacacagccctgcacagccagggcctcttccggatatgattctgcctctctcctcctcatctcagcttcagtgtcacctcccagagaggcctagactgaccacccatctaaactcatgtcccagagctaagacatcaccacgccttaccatttccttcatattattcattgcaaactaaagttactttattggaaaaaaaatctccacagtgactgtatcacatcatcccgtttccttcatggtaatcaccacaatgtttacttattttttagaaaatccaggcagcagataacagctgtctctaagtcctttataaggataacatcatttcattcccacataaccttggaagtcagtactatcatgattctcatttttaaggatgaggaactttttttttttttttttttttttttttttttttttttttttgagatggagtctcactctttcgcccggtctgaagtgcagtggtgcgatcttgggctcaacacaacctccaacccctagggttcaagtgattctcctgcctcagcctcctgagtagctgggattataggcacctgtcaccatgcccagctcatttttgtatttttagtagggacagggtttcaccatgttggccaggccagtcttgaattcctaatttcaggtgatccacctgccttggcctccgaaagtactaggattacaggcgtgagccaccgcgcctggcctatagatgaggaacttaagattagtccctgcagaactgggactcccacctgggattctgtctgcagagcctgtgcccttacgcatctcactgggtagtagcctgtgattcacaaagggaatacagtagagtgcaagataaacaagacctctgcttaacagtgcagccctgcagaactaaggctcaagtgtccccagataatgaggttctgcaggtatgtcggtggctgtgttttgccaggagtagcagcacaaggacaacagcagtctaacttttttttgcccagactttgctatgaacatgtttcttgtccaggaaatccatctggagttttcacaggccttgccagtggctgctgggtgttccagtgccctctaccactctgcctttatgaggtcccaggcaaggccttcttctctttgagctttggggatgctggagggatggcaaaaaagtaaaataaatctcaattactcaagcaacaacccctccatcccttgagtgagcctcagtcttcaccctctgtgcttctaggcacttggctctggggctcagcagtttatttgcgtgctaatgaagccacaggcacactttgtattccattaatgtcctgcagacccatgtgcttttatggaattctaagcacaacttccattgcttgattgcttttatacatcaaccaaatatgaagaatcagcaagtttaaataaaacagcaccttttacaataatggtcctcctcatgaaccagtgaagattctgctgcttatttgttcagtgggggctcccttttaaaaagcaccccacccacttcccttttcattttatcccactctttgtgtggctcaaaaacagtattcatccacagctgctgaaataggggtcaactagggtcatcctttttccattcagggacaaatgttggttcctacaagtctggaagttttctacagttgggtggatggtgtatgaacttggacatggatttgaactctgaggagtctcgctggctttttcgaaggcactggtaacagtcaagggctctgtgggccactgatgggtaaagagtagtcagggccgggcacagtggctcatgcccgtaatcccagcactttgtgaggttgaggcgggcggatcagttgagcctaggaatttgagatcagcctgggcaacatggtgaaatcctgtctctactaaaaatacaaaaattagccaggcgtggtggtgtgcacctgtagtccaagctacttgggaggcttaggtgggaggactgcttgagcctggggaggttgagtctgcacagagctgtgattgtgccactatactccggcctggatgacagagtgagaccctgtctcaaaaaagtaccagagaagactcagagaatagcgggaagatacatgatggaggtgactgaaggaagcttcaagatggtaagcattctgattggaaaggatgagggagaatcagggataaagcaaagggtgtgctcttggaaagatgaattgtccagaggggctggactacagatcaagcatggggaaacatttgaaatatgggctaggaagttaagttagggacctacggacaatcttgagtgccaaggcactgaaggtgcttatgcagagcaccctaatccgaagtgtgttttaaggtattctggcggcagaatcaaactacagaatgacccattaggacactactctctgggttctgagggtcagtgcgatggaaaggaatggaagggattttaaggaattatgacctgctgacgagaggtagggaggggagacttacaagttataatcctggatcattaggagaaggggatttttaacataaataggaattcatcaaagggcaggaagaaacagaattgtattggatgtgctgttttgaggctttagcatatttgggtggagatgtccagtgggcatgaggttgagataatttagggaccatttagaaggaacagctgaagacatgagagttggagtcatgtacttggctgagtaaaccacaatccctggccctaaaaggactctctttctgtgtggggactgagggttaaggaggggagttgggggtagaaccaggcatattaagaaatgagcaatgaaatgttccatgggagaaggaaattcatggcgctaggaaccaaaaaagaagtgggagagggtgtcatttctgctgggaggtggaggatgggaacatccggatccattttacagatagctgtaagtcacctgatgtgaatgtttggggaatggcattgggtggggccaggacaaaagcagatgcaagactgaagccccagaggcgcagaagaggaagagcagtctcacggcaggtgtgatcgatcacactgaccagacaaggccctcctgccactggatatatccttacagggctctggcacacaaccctgtcttccagcagtggcagcttgcctacttcttattcagcagagaggggaaaggaagccctcttctggtggatgagtcaggggcatcctgtccctggacagaacggccactgtgatttgtcgattgccttaacgtggcattttacagaaccatctggcaaacacgcagacacagatggcatattccagttccctggagggctgggcacagcccctggatggtcggtgactaaatgaccgcagcctcctggagggcagggcgctgactcctgcaggtagtatgtgaggctcgccccaccctgctcctgggtagagtgaaaggcgagtgcctgtgaggcagcaccatgctctgctcctcaccatggctcaggtgatgtatcatggtgaggagcagcgcacctacttcctgcctcccagcactgaggaagcacagatccttactttaaaaagatattttttacttatttattttttaaagacgagatctcgctatgttgcccaggctggatttgaactggcctccagggatgctcctgccttggcctccccagtagctggaactccaggtgtatgcaacagcacctggctcactcagatccttacctttttatcagcatgacttaggctgacatatgccattgcttcacagctctgtgtgtttaaggaagtccgcctcccgccatggcacctcatttgcctttcgcactgacagactaagacatggctgtttactggaggcatagaggtttctcactgcccagaccagccacacagcaggtagtcttcagataaacgagtgggctcagctcactcatcggcaagcaagcccaatgctgccagcacatgtggggcacaaggggtccccatagagaatgtagaaacatgcagacttccccactgcctcactgtgtgaccttgagagatcactcagccttgccgtcccactccgcgcccccccccccaacccaccccaggatcacatggagagcagcacctgctcccggctgcctcccaagaatatgacggagatgaactagtctgctcctctcagctgtgcttgggtcccgagggcgggctgcacaaacaccatgtgagtacaaaaaaggagtcatttctgaaaattcccttatttagctgcctttttatagatcacttacttggtggaaagatcagtcaaattttactaggaccaagggtgagagacagatctgagatggagaaggtttttacagcacacaggctggatggacaagagagaaaacaaaataccctgttaagaaaacatctcgtgtgccagactggaaacctggtcatccagatggggttttatggcaataccacagccaacaaactgcaataaatgttcaccgaagtagggggaacgaaatcagaccagatgggagttatacatacagtaaaggcggggtggcatgtagccttggttttgttccaaacagaagaaagttaggagaagatacactgagagagccagggctgagtgacaagggctggccaggtaaggggaggttgggttggggacagtgtcatgacccagaaccagtgactgaaatgtcacagggcaccttccctgggatggctggttctccttaaggacagcccatggcttagcctcttcctcttcccttagcgacacctgatcttttcagtctggatgcctgcgcctacagttttggtgtctggcaccatccttttttcaagggagaaatactgctgaaaatgctggtaagattcccccagctgacctcaaccataagctcggctgtgatttaataccttcaaaaaaggtgttcgtttccatttgattttttaaaataaaaacctcaggaatcatttcatcaaggtatataatacaaacccaaactgcagccctgaggtgtgtatattgtatcccctcatgaagtgatgaccccagtttctaagctatatttacagtatcattatgttattttcctttttcctttacctctgtaagtttgttcttggctccatccacctgggtcttgattagaaatccatgctaaccaacttaaggctggttattggaaatccattgtgactgacagaacaaatgaagtctctttatgtttagtcagcacaatctgcatcttccttgtgccagcaaaggcctctgaggtttggggaatttgaaaaacttaagggcttagcttacagatacaatatccaaatggctcccactggaaatagcgagtgggatttccatcccgtgtttctggcacagttaagtcattaggatttgttgagggcatttttctgcgcagcttttctcttcccgccccaagcagagcaactgccatttaactgcacggccagaggctctggcaaagtacaaacagagctattacaacttggaaggaaagacaaaaagtgacaataaatcaggaaggtagtgaagttccccacaaggcaaccttccatccaccatcagcttggaggccatcctataaacaggcccgctggatcaagtgagctgactgaaaatacactgtacccttcccctccaaccctaaatccccagaaatggcaggaaagacattttttaaaacccctgagcatcttagaaaggagtgctctttgtatatcagaaatcatgctcaatcataaaaaatgaaaggcagatgttttcttcttcctgaagagaaaaccacaatgcaaaatgaatgcagaaaaatattctgcaaaaggaagaaggggattcagaggtgctccaaccagaggtgttggctaccagaacaggaggggaccaaatgcttgggtcagatacgcagactagagggctgttattagccaggagacacagaaagcccaggagacagcttctgatatgacccagctgacagcactttgaaggacctggctacattttctgggtggcagactgtaataagtagaagcaggactctcaaatgggatggccgggtgcagtggctcatgcctgtaatcagagcacactgtgaggccaaggcggttggatcacatgaggtcaggagttcaagaccagcctggccaacatggtgaaatcccatctctactaaaaatacaaaaaattagccaggtgtggtggcgtgtgcctgtagtgccagctaacttgggaggctgaggcaggagaattgtttgaacctgggagaccgagattgcagtgagccgagatcgcaccactgcactccagcctgggcgacagagcgagactctgtctcaaaaaacaaaaacaaaacctctcgaacaggtgacctaggaatttaaaatacaagaatgaacacacaaacaagaaccgctgaatatttaaagaaagcaaacaccaagaaagagtcacaaaactcaactatgaaaagaattacatgtgaagaaacagaattaatacagcagacaaaaaagatgaaggaatttaagggccgggcagggcactgcatgcctgtaatcccaacattttgggaggccaagatgggaagatcacttgagcccaggagtttgagaccagcctgggcaacgtagggagaccctgtctcaaaaaaaaaaaaaaaaaaaattagccaggtgtgggggcatgcacctgtggtcctagctacttgggaggctggggtgggaggatcacttgagcccaggagattgaggctgcagtgagctgtgattgtgtcactgcactccagcctgggcaacagaatgagaccctctctcaaaaaaaaaaaaaaaaaaaaaaaaatttaagcattataaaaatcctcaaagagatgcatatcactaaaaaagagatgacagatttaatcaccaaaataactcaacatataggtcaaacatcacaatgaacctaactaaagaataaattagtgagctggaaaatttagccaaaaaatctgtctctccagaactgcaactatctgatagggcagccacaaccatatgtggctcttgagaacttgaaatgtctgaatttgagatatgctgaggtgtaaaatacataccaggttttgaaaacttggttaaaaaaaaatttcattaatagtttgagaaaatattgactatatgttaaaataatgtagacatattatgttaaataaaatgttattaaagggaatttcagctgtctttgttctttttaatgtggctactagaaaatttacaagtacatatgtggttcacattacatttctgctggacaatgctgctgtagcacccggggaaaaagcagtgatggaaagaaggtatgaaaagtggagatacggaagacagagctagatgaatcagcatctgtttctccttgcaggaggagataaagaactggggggcggtgaggggaaagaaacactgaaataatagaggaaaatttcccagaactaaataaatacacaaagctttttcacactaccaacgctgaaggaaagtattcctgctgaagttggaaacaaggtaagagtgcctgttttcacctcactagttaacactgtcccggaagtttctagccaatgcaacaacataacagaaaaggaaaggaagaggaattttcctattcactgatgaatcaatgactgcctaagtgctgtctcttaagtgctctctcttctcactgttttgaaaggcctggcaccaacaggccttctccatttctggcttccaagacatgggtaaagtggaacacatcagcaccttctccttttgggagcagcaaagagaactcagaacaaagtctccatgcccaggataaacaccagctggggtggggaaagggtgcttaccgacgaatggcgttggtgaactccgcagccagctcattctcgctgcacgttgtcctgagttcggctagggacagagctggggaggcagcatcagcacactcctgacaacagcaaacacattccagttaggcctgaatccaagccggcagcaccctggaagcctgcagcagagcgcggtaggtggctcgtgcagtgatggcagcagtgtgggcaccgggtggcgccctcaggtcatgccaaaggggaaagcctggcagcaagccaaagaggcccctctgctcccagaccgctggctccttttgcagactggccagtgcggtggggatgacacccagtatgctctgagcagccgctgatgccaggcactggtctaagcatgccatatgcattcaatcatttaatctccacaaatactctctgaggcaggaactatcattatctccattttaccaaggagggaatgaaggcacagagaagttatgcggcccagtcaccagctaggaaatgggggaaccaggattcaaacccaagctgtgtggccacagatcaatctcttgaccgctaggtaaagcctcttgtaatcatacaagacaagtgagaaatacctgtgaatatccttggtgccccatcccacgtctccttgggagaaaagcaaactcctttagatttaggagccttgctgggttcagtgtaatcatcaagaaaacccagcagaggaggaggaaaacagaagtgcagcccaccccatggcttagcattagacagggaccttgacatcatctaaagcaaatcatcccaccctgcagatgaggaaacttaagagccagtgctccaaatcctatagttaagactattcaaagcagtgaccatgcctgagtgctctacattccatgcacagagaggacagcagccacactacatagtaccatggctgggggaaggcattcatcggatgatctctcaacggacatgagtgctaccaagctgcagacctgagaataaaaagcttgtgatctgttgcaggagatggaatgtaaacagatatttttttgtttgttttttgagatggagttttgctctcgttgcccaggctggagtgcaatggcgtgatcttggctcactacaacttctgcctcctgggttcaagcgattctcccacctcagcctcccgagtagctgggattacaggcatgtgccaccacgtctggctaattttgtatttttagtagagacggggtttctccatgttggtcaggctggtctcaaactcctgacctcaggtaatccacccaccttggcctcccaaagtgctgggatcacaggcgtgagccaccgcacctggccataaacagaaaattttataagatatgagctacagagaggcacgaattcagtgctgcaagtccaggcatgtggtctcccgaggcagttccttggcagtggcactgccaacacttgagtgctcttccctctgccatgccctccacctgggccgccttccacctcctctccacctacctgcgctcagagatccaagtcccctgtccacccttggaatctgttgagattcccacaataccctcactttttgtatatccattcccatttgatgttaacatttcgtgagactccttaaagacagggactgctctgtctcattcacggtgcctctcactgaatatacttggcagtatctggtgcacacagacgagaatttcaaaacctaacgcaacttggataagatttggaatccagctgtgctagttggagggaagctttttaaagaagcataagcacccacccagtggagcaagaaaaaaggttcaagactcaaatgtggcccgccagctgctttttatgacccacaggataagaatggttttcctatttttaaaatcattttaaaaagtcaaaagaagagtattctgtgacaggtagaaattatatgaaatttaaatgtcagcatccatacataaagtattactagaggccaggcacagtggctcacgcctgtaatctcagcactttgggaggccaaggcaggtagatcacttgatgtcaggagtttgagaccagcctgaccaacatggtgaaaactcatctctactaaaaatacaaaattaaccaggcatggtggcgcacacctgtagtcccagataattgggaggctgaggcaggagaatcacttgaacctggtaggtggaggctgctgtgagctgagatcgcaccactgcactccagcctgggcaacaagagtgaaactccatctcaaaaaaaaaaaaaaaaattaaataaagtgctactagaacacagccatggccactggtctccctgttgcctctgcttttgcgctagcattggacaatagcaaagctgagtggctgcagctgcacccaaatgacccacaagctctacaacattcactgtgtgacccttcacagaaaagtgctgaccccttctctagatgctcgcctcatccagcaacagctaagaccagatgaatagcccagatgggagattttattccaacagtaaatggatctagtatttgaaaggcaagataatcagcttatttcattacctgaaaaacacaacatactcttataaaggttcttactgtagtgttaaaaaaaaatcatctggccttttccataggataaattttcttactttttttttttgagacagagtctgactctgtcgcccaggctgtggtgcggctgcacgaccttgggtcactgcaacttccgcctcccaggttcaagcagttcttgtgccgcagcctcccgagtagctgggattacaggcgccaccaccatgcccggctaatttttgtatttttagtagagatggggtttcaccatgttggtgatgctggtcttgaactcctgacctcaagtgatccacccgcctcgggttcccaaagtactgggattataggtatcagccaccacgtccagccaaatttccttactttgaagccactccacataacagtatttcacccagtcaaaataaataccaggaactaggggaaaatgctcagttcatgggccttctggcaagaacctggtaactccattcctaccacaccccaagaacacacacaaacactagcgctctgtctctaactgactgctaacaaactcaaaaggcaaaaaaaaaaaaaaaaaaaaaaaaaagagagagattttgaaggtgtttgtatggaacctcatcttcccgagccccagatacttccatgtgaacccagatacagtaccgcatggctgatgcccacctgcacagcctgactcacctcccccagccttgggcagatggcttcatagtgcacttggcatagtgacttctctaaagcccaaactgtatcacatcatctcttgctgaggacccttccatgattccgcacggccctcaagataactccagccagtgcatcaactccacaaccctccgggccattaaacgtgctgtcccatcagcctaagggcacctcttctctcccctggccctccacctgcccctcttcaacaggctacctcccactttccactggggctcagctcagaagttcatttcttccagaaaacctgtcctgaatctcccaagtggacatttgtgtctggcttctgtcctcccatggtgctaagaattcagcctcgcactggggacattctctcactgctctgcgatcacccatttgcccaccagtctcctcctaagaatgtaaattcctagaggacagactgcctgtctaccacagagctgcctctagcaccctgccttggttctggcacgctgtgagtgccaaatcacatttatcagctgaatggatgaataaaaagcagccagggtcttgggagggctggcctggctgggtgccacagctgtgtcttgtcttggctcctcagcaagtgggaggtggagaagggtgtagctgtggccatttgtgaatcatgcttcagagttcttaactatgtagggagtgacaattcactgtcacatgacatcagtactgttccttctttcccaggtatatggctctcctggagacgatcctgcacttatgctatgagaagcagcttattagactagcaagttggcatatgtctgcgagtcctgggtctgaaacaaatgggggtcaagagaagcttgcatttattaagaacagaaaaatatgatgcacagaatatagatgacccttggacaagggatataattctttagagtccacagttgtttttttcccaacacagtatttggaaaattctgagatacaggataatggaatgaacttggattccagaaaaaaaaaaaaacacctgggggctgataaaagagtgagtttgcaaaattctatcaccagacagcctgctttcagatgatgtggacttcgtaacccaaggcttccttcctcctcctctgccggcaggctgattcctgcttaccaccctgtgacggtagcaacgccagcaggaaggagtcaaggaggaaatgcagtggagagaagagagcccgttagtggatctgggctaaatcccaattctaccatttatcagcagtgagactcctcacttctttgagcctcatttttctcatgtaaatggggataactattctttcctcagacctgtgagacttaagggcgataataaatgcagtcattggtacagaagtactgtagctcccccttaactgcagttttgctttctgtggtttcggttcctcaaggtcaaccatggtctgaaaatattaaatgggaaattctagaaataaacagtaagttttaaattgtgcaccattctgagcagcgtgatgaaaccttgcactgacctgcgccatcccacctgagttgcgaatcattccttaggccagcatagccgcagtgtagacactccccacccatctgtcatttagtagctgtctccattatcagatcaactatcagtgtcacactgcttgtgttcaagtaacccttatggcatgtaataaaagccccaaagtgcaacattaatgatgctgacatattgttataattgttctattaatattttattagttgttaatcttttactgtgcctaatttataaattaaacttcaacacaggtatgtatgtataggggaaaacgtagaatatataagggttcagtattacctgtggtttcaggcatctatgggggattttggatcatatcacctgtggataaagggggccctattataccaataaaccaacaaatgagggctgccgtgtgacagaggattagacgaaggaggtgagaacagtatcagtggacaactgcagagatcacccctctgatgtgactgtgatatgtgaaaaggttcaactattacataaagtgagatttggtatttctaaaatgtagacctggtttcattacactcaaaatgtcaccttcttagatacctacgaatggcctgcatttcctatgcaaatacaagaactgaggcagcagggcggtgaggtgtggccagtggtcactgggcagtcactgggcagtcactgagcctaagggtgtccccaagccactccggccctaccttgccaggtttgtctttgctgccgctgctggtggagctgagggatcgcatccgctgctccttctgctcctccacctcggacttcaggtgctcaatgtgcaccaggtaggcctgctcctgggcctcccgcgtgctcagcttcagctccagggccttcttctctttctccagtaggtagagctgggccttcaactcggccatctcctcctacagacaaaggagcacagagcacatgaggcatgccctatctgagagcaggcctggctgctgccaagtgggtgggtggggggtccccggctatgacccacaggcccatggtagagttctcactttgaagttggcagtaggatgagtgggaggagacgtggcacctgtcaccacacttctaaaggaatgacgtatggacaaggccatgcactttgtcagtctatggactagacctgagacagaagggtagaagttacaggcaagattgtggttcaatatagggaaaacctttctaacaaatagagcccccactcaggcacatgggccttgatggaaacccattctctggtctgcagaggctgagctgcacctgccagaggctgtaaagtcacctatccatggaaggcctcttctggccaagccccttccaattcccattttggtttccatggcaccaaccacatgtttaatcacacccacggcacctctgttgccctgtagctgggccaggcatgcggcgaatgcctgcagcagcatcaacctccagctcttgcctacttctcagggcccaaatgaaatcaatagaaacagcatccttcacaggtgactgctcatcagacaacttctaaaagtatcctaagaactcaaatgagagcgatgagtggagaatacgaagtgaatccaaaataggacagtgccatcctgggaccaggagccagtaacaatgacagccagtagcctttactgagcacgtggcactgtgctaagtgttcacatgacgtggctcatttcatcttcccaacctgggttaggtattgcaactatctccattgacagatgggaaactgaggcacacagaaggaaatccccctgcttatggctactgggtaagctgtggagccacagattgcagccaagctgtctggttcagagctatactgcctccctccctttcaaggtgagcccacgcatgactcttgtccccgcacttctgctggagagtaactccaccagcccatggccaccaggtccagccttcccagcccaccgtgagatggactcacctgaggttagttcagattctcacaacccccgaagtcacccttctgaggtaataaaccacaggcctggtgcactctcctgggtaagttggactagggggtagatgttttcactctcaaatgtggggaaatgggtagaggacacccctcgaaagggacattagtcaatatgctcagtaaactactcagaacatgccaaccttctttaccctaaatatcagacataaaagccagaatgaaaggtgtgccacgcccagagccttcggatcttttgccattggaagcaggattctgaaggttctggcaacactgcatactgagctaatgtgatggtcgcttccagaacaaacatataagtgcaggcttgaaagagggaaagagaaacctatgggtgccagaaatgaagagggaactctgccagagagaacggcaaggagggcaggtgctggccagcaaggcgtcagactgtcctcaggccctccacccgggggcttaacattacccaaggccagggccgtggcctctgaggcagagagccacagctcagacccctacgggagcaggattctcatcaggctgcccataagacactaggaaacttcctttctggagatgtgacaagtaaacttgtcatctctcaggctctgtgtgggaaaagaaagaaaaatctctttccaggaattaaacctcaagcttgtgtcatgtgtaggtgtggtacaggaatccagagccaagaacttaataacaactagtcctaaacctcagaaactgatgagtcccaacagatctaaacatagaaccactctgtagggacatctgcaacccaggatcctcagggccccacggaagacagtttccacagaggatgagctggtgcttgcattctctccccctacccccaccaccgaggaaatgagaatgaatcagcactgacgaagaatgagcggatgcaaaaagtaagagtcagcatttacaagaagcagaaataacaatgtgcaaaactagaaaataaagatttaaaacaaagtgatacaggagtcataatgaagggataagatgttcaaaaaggaagagaaggccaggcctggtgcctcacatctgtaatcccagcactttgggaggttgacctgggtggatgacttgagcccaggagtttgagactggcctgggcaacaaagtgagaccctgtttctacaaaaaaataaacttaaaaagtcagctgggtagggcagtgcattcctgtagtcccggctactcgggaggctgaggcaggaggatcacttccagcccaagggcgaggctatagtgagccatgactgtgtcactgcactccagcctgggtaacacagtgagaccctgtttcaaaacaacaaacaaacaaacaaacaacaacaaaaagaagaatggatttgaaaaggaaccaagcacatcatctagaaatgaaaaggtattacaaaaacagaaatttgaatttctcagcagttggatcctagaaactggtgaaaatccaacgtaacctgctggataatggatttggtatgggtgagcacacatccccaagcagactgggagggactcagaggaaaaggggacggctctgatatttagccttcaagaaagtcatagggaaccaagccagaatgctagcaatggctgccctggatcatgatattatggattgttctcctcccagcttttctacttttttagaaaatttctaagatcagtacacattttattttcaagtggcaaagggagtattagaacttttattccaacaaaaatgtctttcttaggtagaataccagtaaatttatcaccccacgttggccaattttaaaaaggaaatccttagtctttggccaaaagaaacacaatgtttggaacaaatgatggaagggtggcctcatagctcgtgccacaggctgcaagcatctgcaaacagggctcccagttgggggaaaagtcgctacaatgatggacccaagtctagctcataagcaatgagaggtggaatcagccaaagcagcatgaggattctctacagagaggtcaggatgggagctgcgtggcttgatgaagatgagccagtttggaaatcatgggggtgggggtgggaggtaagattcctgtatctgttaccactgcctagtgtcttcccaaacttcgcccagattctagctcaagaagctcccaaggacagggctgtgctgagtgagtcacccctgagggtgtcaggatggctgctgttgccagctcccctccactctccagagatggtgcgaccagggggttgtttttctccctgctgcggacagtactgatcctaataggagccattaactctgcactgccacgacctgctctggcttgctagactccagttcctgaccggtcctaaactcaatctctggctctcttcccctccccggaggtcaggtggctgaaagtcccaatcctccaacacacgcctggtccttctggtgaccagcccacattctgaagctgtctagggcccaccataagtcacctcatcagcatcacaaagacacccctagctcagcaagaaactccaagggtttctcaaactctgtcccaaaaccaaggacaaatatcagatatggtcttatttataccacagctgccttgtaagagcaggtaccaggtgaagggctggtgcctggcattccacaccagaaacaggcaaagtgatgtcttgttgtaggtatggcggtttaactacttcccagtaggggacaccagctttccaagaaagctcccttctgtagaaataccagcaggtaggtatctccactagcagctgaagggcccagtgtttcagatccactgaaacactgacctcaacagcactgtacaccttcactggagggcactatggtctgagcaggctcgacattgcaccaaaggtacagggtgtcaggaaactagggctctcggccaaactctacaactggcctcaccctgttctccccctgccggagttaacatcagcatcagcaacccaagacatatttccaagcattcttgagattaggggtcaatttagatggacagaggctccaccctgcagaggtctgacctggcttctcttagaggatgaagggctccaaagttgggctgggacaccctgagaaatcccttagaaattcaactcccctgtccagaaacacgcagcccaagtgacccccagacatagtgaaaccagctctgtctataaacaagggtctagctcttctctgggcaggaggggttgattcctccttatctgctggacctgctttcagaggttgtttagatttcctcctggtggcagcctagcacatgggacccacccaccacataccttcatggccatgagctcctgcataagcactgcgttttccagatccagcctctggctgtctccccgaggcttgacgtcatagctgagaggatcgatgtggatgctttccagctccagcatggtcagcttgaccgcagccctgtcattcttgagctgctggatataatccttcagcctctgctcgtcttctttagtgaactcggtgtcgcaactactggctgtggagctggttgtgctgagaaagaagaaaaacaaagacccaccaccctgtgttattccaagtcatggcaaatagatctttcctcctcactcttctccacattccctctccccagtgttatttagatggtaatccaaaaatcagttttcttcacagcataggaaaatgataccaccttttaggaaagaattaagtatgaagaataacaaatgcttacactccttgacgcaacactgtggactctagaaatgaatttctaaggaaataattccacagaagcaaaaagatacacatacaaaggaacataatctaaaatacagtttagtgatttatcacacctatcaaaaggagggaaatcatgtggacattacagtgataattgtaataagtgaaattatagtgatatcgacaatggtggtgatattttgaggacataggttaaaagatattatatatgtaataaaaaagatactcatgtggtcagaacttaaaaaaggtatatttaaggcaacaaaagttgaagcacaaaactcctatggcatgatccacagatgcgtgtcacaccctcgcacgtgtacgcaggtgtcccaggctgtggcagccgtccctgcggagcagcaccgaagggggctgttttgctgtgtttacttctgttgtttgcaacatgtaccatgaaaaacacaggggtgcacaacacagcaataaccactttgggagtagggtaccccctggccttcacaggatagtctgagtatagtgttcactatagggactcgggctggcccaagggcccttggcagcccaaggtgaatggtgaccaggcagggagcccccagctgaaccccaggcctgtggcagcccaggaaggtttctaggggaccaaaccaccatgaaagggggagcaccactggaaaacggaggccacggctttcaagtgggctctggccttttccagcagtgggcaggctgctccccgtgcctccgaataaggcccactccactcggttgaggactctgaggccagtgtgcaccgacagcagtttctctgcacttgcactgggcctccctaggggtgactcgcccctcatggaactggtctgaagatggcagaggaaaaagcagaggcctactgaccttgcatcaaaacaggccaggctgtgttgtcatgtctgttgctacagatttggaaagtgaagctcagagacatcaagtggtcagccgagtcatgcgactggaaagaggtgcaactagacttgggccgcagcctcgtcccacagccctgtccttgtccccagaatcctgtagctagaagctataccaggggccacgagtgatctccacaggccgccagatgccacaaacccaggcctgccctcctcatctcacactgcaaaagggtaagagccaggaccccaactcagtagctgtagtccccacagcctagacatgagtgagggcaggcccactcttgtacatgacacattgctacgaagacaaggcttccggggagagaaaagctgaagagagatggtggctggagctttgctgttcacaggaggaagaggctaccctagggcttggggtggtcttcaagtcagagaaccccttctagaatgggaaactcctgagcactagaaaccctttggggctgcgtctcactccctctgtaccatcaggacgggtgggaagtcccttggagataaggtaagctagatcagcctgaccattaaacaccatctcttcagaggctatgcccagtaagttcccacgtcagctgggctgggctatgtgcgcagttgcttggtcaaccaccagattaggcattgctgcgaaggtgtttgttacatgtgattaccattaaaatcaagagactacagggagactgtttccatacagtgagtgaacctcgtctaatcagagaggccttaaggggaaagacaggtcccccaaaagggaaaaaattcttcctccagacagctttcagactcaggatggcaacatcaactcttccctgggtctctagcctgacctgcagacttcagatttgccagctccattatcaaatgggccaattccttaaaataaatcactgtttgcgatttactagaatctatatcaagagatcgatcttgatctttctatctaggtatagatgtctccatatagacccacctcctattggttctgattctctgcaatgccctaagagcaaagtgctacctttacgtgtgacccaagcgtcttacatactttgaatattccctgtcttctcatctctaaaatgaaggtaatcatagtacctgcttcataaagtcagggtaaggaataaatgaggtaaaattagaagtgtttgtaatagcaaagacatggaatcaacctaaatgcccatcagtggtagactagatagagaaaatgtggcacatatataccacgaatactatgtagccataaaaaaagaatgaggtcatgtcatttgcagaaacatggatgaagcgggaggccattatccttagcaaactaatgtgggaacagaaaaccaaataccacatgttcttacttataagttggagctaaatgatgagaacacatgaacacaaagaggggaacaacaaacaatgggcctacttgagggtacagaatagcagaagggagaggatcggaaaaaatgactaatgcatacgaagcttaatacctgggtgacaaaataatttatacaacaaacctccatgacatgagtttacctatgtaacaaccgtccacatgtacccctgaacttaaaataaaagtaaaaaaaaaatagaaatgtttacaacagtgcccagcacatagtaagcactcaataaatgcagaagtcatcattcatttattcaagaaatattggagtgcctactatggggtcctggaaaaatccctgccctcagggaactcatattctaatagagtaggccaggaagtgaaatacacagtccatgagatggtgaaaaatgaagcagggaagaggcgtggggaatgcagagtgggcatgaggttattatttgtgattgagctgcagggaaggcctgtgtgatccagtgacatcagggtggacctaagggaggcgagagagggagctacgtggatgtttgcaggacacagtaaatgcaatctaggcagggagtgcggccagcagaacgagatggtgactgaagcagtcaggcaggggagagaaagaaggagaagtggtcagagagggagtgcgtgggaggggctgggtgccaggtcatgcagcattttataagggctgtgtctttttctctaggattaggatggaggccattgggggttttaacagggagggatgtggtctgctttattgttacaacaggatccatctggcctctaggatgagtagagatgcagggaggccagggcagaggcaggggtgcaccttgggagctacagcaacaattccagggagagatggtagcagcttggagcaaggtgggagcagggaaggcagggagaaagataaaaatgactactgatcatcagcattatgttttctcaagctgtattttaaaaatgagaggggagaagcagcaacatcctgcagctggaacaccacgggctattccacagtgaaatgaggcagctcaagggaactgcaaagagagcaaagcgcgcccacagcagagggcactgaggaccccggctgtgcatcagaggacgcatccaaaggaccctcagcatctcagcgaaggcctgtctgcctgcaacctgctcagcggcaggcatgcctcgtacaaaacccccaagtagagctcaggagctcaccttcacaaatcatcaacactgatgtggagggacagacatctaatgttccacaggcgaacgcgcgacaaaattagagcaaactcaagtactggcactgtttgcaaagcattctacagacagggctgagggtggagatgtgctcacagcctcgacatgtttagacagcgtggcgctggcagacagcagcacttctcttccagttacttgggaggtttcaggaatgaaatccttccttgtaaacctgggacacagggtgtggggtttacttacacctctagtctttcctttcattaaaaattattttgaaaactttcaaacctatagaaaaacaaagaataaccaacagctgtgcgtctaccacccacaagacactgaggtatattttcttcagactactttttgggaaatataaatttatacttgaaacactttttgttgactttcatttaaaataaaaatcacaaaattcaaagagtggtaaaagctagcattctctaattaccctgcaggaactgaagtgatactattttggcagattttccatttagcaggactggtccaccccagcagttttccaagaggggtcccgggctggccgcatcagcagcacctggggacttgttagaaatgcacattccggggcctgctgtcaagacctccacagtcaggaactctggaggtggagcccagcaatctgtgttttaatataccctctaggtgactctgatgcacgcttaggtgtgagaagcactggtctccccctcaggctaagtgggcatttgctcaggagcctgtgaggtgactggatgctcctaggttttctaggtagaggccacaatgctcctggctgccctggtgggtgtcagggtctacgagcaggtctctgatgtcagtcaaacctggataaatgttcctcctctgccacttccttgctttatggcccagagtaaattacccaatgtttctgggctgcaggaaataggaatactaagggttcctgcctcactaagttgtggaaaggatacggcaggccctgaagcaggcagctggtgctgccacacagcacctgtcctgtgggagtaagagagaaggtggccactttcctgatggctttgccaacagccccacaacacctaacaccagactcagagatgccctgagctattggccaccagcaggtcatccagaatccctccatcccagggagaacgaaagctgccagtggttgaatggacttgagaaatcacctagccctaacacgaacgcaggcaggcagagactgacaggcgctgccacccttagggcccggagcctcatccatggcaggcagggaaggcttttgtttcacccaccttgctatgagtatagttttcaaagaggaaggaaataaaaaaaaaaaataacaaaagatctcagtccacagatcttaccctgttggaagcacagagctttaaaatgcttttagtggagaaagtttaatttcaagataaacctcacagcccctccggcttcccttctcctgcttccaggacagcagcggggaacagatcaggcgaggttaattacaattctgctttgagctcttaacgtttcactgcggaatatgattatgacaatggtaggggaggggaagccactggccttttctctggcctcacagacaaaggcgctggcggtctcccaagggcctgctgctggctgctgggcaagggttaagtcatccattaattctcccagcttggaatgctggatgatctcagttgtcaagggggaatcaatcactttctgtggctgcattattcctcctctccagaacaggagcctgtctgtgttctctgagagcgactgtgggggaaggctaatgacaaaaaccctcgccacacatgtgtgtcttgctctggcttcttgaggagctagtctaggatgtgtgggtttctcctttccgtgatgctctgctggagctcccgtcacgctggctttcctctgcatctgttcattgccagcagctcttccagcacaaagcatacacagcaggcctgtagcctggtgggaatgcggggctggctggttcgggacggttcgggccgacccactctccacctaccctgtccactataggagaagctgttcaaaccagctatcgacgtcaaatatcctctcttctatccctctccaccatgccccacctctgtcctcaagacagtcccccagcctgctcattagaagaaaaattcatttttcatagcctcctcagcttgccttggtggaaggctagaaggacatttcatttcttttgccttgaaaatccgtgatgacattttcctgaagttttcatcaacatcttacctggccctagctgagatctcatttccatcaaggagcagctctttttgtttgtttgtttgtttgtttgtttgagacagagtctcactctgttgcccacactggagtgcaatagcatgatttggctcaccacagcctccgcctcctgggttcaagcaattctcctgcctcagcctcctgagtagctgggactacaggcatgtaccaccatgcctggctaaattttgtatttttaatagcaacaggatttcactatgttgtccagggtggtctcaaactcctgacctcatgatctgcccgcctcagcctcccaaagtgctgggattacaggtgtgagtcactgcgcccggcctagcagctcatttttagaaggaaagtgccctgggggtgggcatctgttttgctgagcatttgaaatttatctgaatgagtggggtcagtccaatgtcctttccagtgagagtcctagaatggagaactttaccatcctatgcattttgcaatgctggcattttaattgcttagttttacaacaaacatacagttcttttgaaatcaagaagttagatctcactagaaaaaaaaccataaaaagcattccatgtctataccttgttctcatagaacctaaaaggtaagtgatgaggacatttgagcaggaggactgatcataatgctgtcatgtcaaggatgtgtcggggctggtctctagagctcactaacaccagtaagcgtttgtctcaaggactttggatagactctcctgacacacagatggaaaagcacctctcctcagtaaagatgactgtttcagccagatctagtctgactctcattccctgaagcttactgatgcctgttctaactaggtggctgtttcaaaaaattcaccctttcaatggacatgatttcactctcctcaaccattttttctgccccaatgaaactttaccttaatccagactagttcaaagagtgagagctaggcatctcttgagctctgctgctgtccagtccaacttggggattacaccccagagtgagtggccacacaggcagcaccctggctacctggaggtacctagaggctcacggcaaggctgcaaccaccattctcacagctctccagggtccccacctggtgctgagacaagggactcaatttcagtctctgagagtacagacttgctgtggccgatcctgtcttggccacagttcctttgtggattgagatcgatgactacgctgcacagaaggagctgaactgtgaggcctgccacagagggtgggcttgaccaaggattcctatttccacttcctaacattttagtccttgtgcctctttgtcatgatatgttgataaagccatccaggcaatcaacctagtcactctgtccataagactattatactttctgatgaggccatggctatatttttcaaaaatgaagtggcaccgaccctgggcacctgccaacagtcaactgagggttggctatcacttttattctccttgctggttaactacccctctgctgctcctctctaaaaccattaaccctcctgtcgttaggagctgcctatgggctgccagaaatgccgctggaggcacaatactcagcgtttctttcctgaacccttgaggggcagttgatggacactctgattagacctcttgaagctgggtggttacagcggggggaaaggagatttgctgggccacataaagctccaactcagaaagatccttttctttattttcataaacttgacaagggggaatgtctgagccagaatggcaagatttacaaacaaaattactataattatcataattatgaaaggggtctggtgctttgggactttattctaaacccacgtttaacataaagcagtctaattgcatcaggttctaagaatgtggagtgacaaatgaatgcctcgtgtgtggttcttccatcctcggagctgctctgatttgggcgggagggtaaaagtgattttttaaggagaattgggtgacattggagctaaagacctctgtactttgatgggaagatccatttgagactgaaattaatttaagaaccattctttggtgaggttatccttggaaacaatgactctgtgttttgaatttatctcaatctgcagaaaaacaggatcccaaattaaatttctctaagaaaacagtctcaaaatcaaggctaacctgtaagttcaagtacttctaacaaatattcaaaagctaaatagatggtgataaaattgttctccctcctgactggttctaaatttgtctctgattcagaataaaaccacaacattctttttgggggtagggaggtttgagcaaatgatccgtagcacaaacctcataagctactgaaacagcacacatttcctgtcaagcaaactcttatgttcactaataaaacaacacagcatcactgacaacatgagaactacatttctatactaaataaacacacaaattatagattatacacatctggaagagtcattaagaagagcatctgctttctgtgtttacacagtagaatatggttttatgaaaaaaattataatctgtgcttcactgaatgagacaattgttgctgaagtaaagaagaatcaagtcccttttgtttgtgggcacctggctgagtgcattactgggcatgttccctctcctgggacacctgggccagtagaggtaaatggaagcgctaaggtagatggcgggtcccaccaggggagaaagagagaggggaacattaagttgctttccagcaccaagaaagcatcagtatttctcctctggctctcaacagtcaatctatctttatgcagttctggtcacttagtctgcaagtagacactgttttgttatgtcatgagatccaatgtgggaagaacaatatgctcgatgctaagatcccgggttcccatccaggtttccctcttatcaccaggcaggtcactgacattatctctgagccaaggtttcctaacctgtgaaaatggagtaagttacccttccaagtctttcacgatttggcaattaagtaagaatctctaacaaagtgtcttctaaactgaggactggtaaataaagggaaggcattcgtgtttttagggctttggtggcaagaaatgagaaggtaagtagaaagggttttgttctgactctccactcccatccaaagaatgaaatgacttcagcaaattatgctctgcaaggtcttcgccgctctcttcctagcttcctttttcaagcacccactttaatttcctagattcacagacagtgaacttgacctcaggttcatgactgagtgcctgtaagcatgtgctgtgaatgtggcatcattccatgaggcaaaagagatgagaggagaggctcttgcctgagaagagcttatagacgatggaggcacaagaagacaggagagtgatgtctggaactaggatgagctgggctgggccttgggaccagagggaccatttggagcaaacggctcttggctaccctaagtgcttcctggaaatgaagacttataaagaaatggagaacagaacaatgcagagaaaatggatctgacagaaaggtaggtttgcattccatctctaccactttccacagcaaatctctccaatctcgactgcagtttccacattggcaaagtgagagggccactttctagctcttctgttctgatcttctgactcctttttggatggagcaggctgcatgccagaagccatgtctgccttttcccaagccacacagtccccaagagctgggtcactgcacaccaagtccagtgaacagatgccatgtggacacacgcccaccccagagcagaaggctgagcattacctggtgtggctgttggaggaaaggctctcccagggctgcacgctgcagccggccacggcaaaggctcccccacagctgccgtccagcttcatgagcagggccttggcagcgttctcagctgtcttccggcagtcatgagctcgcttgagcatctgagtgatgttttcatcccccgactggtctcctatgtggcagagaagccaacggattaatcaacataggcctggacaaggcacgcctgggagggactatgcataattaactctgttacttagggcagaggtggcactgtggaagggaattggcagtgcccagccgaagagaagatctgtgttctgggcctggcactatcacttagacgctacatgtgggaaggtatttctctgctctttctctgggctccactggcctcagggacaagtgtaggagttaaccaatgggatcaccacatttctgtttccagctctaacacgctctgatttttctaatgatccaggctcctggcttctcctcccattcagccacaagtctaccatttggccattcctctgtgcattggcacttccctgtgaatgagggagggagaaactagggcaaaactgtgccatctttccacatgtctacagctttggttagagccctgtgtgggggcaagagagacaaaactaatggttcagacgagagctttagattggctctgtattataggtaccgatgccacccctgacccttctcttggcttggtaatcggcgtgaactcaaatgcctccaggagccaggtaagtgggctagtgcagaacatcagggtgtggtgggcactcgcacagaccaggcagtgaagtccctgcccaaaatgttcacattcctattgtgatttaagactgtgctggaaaagacagaactatagagatattgaaaagatcatgggtggctgagctgaggtgggaggactgcttgaacttaggagttcaaatacagcctgggtaacagagcaagaccctgtctccaaaacaacaacaagaacaacagcaacagcaatggttgccaggggatggggttgggggaggaatgaataggtggagccagagaacttttggggcagtgaagctactctgtatgatactgtaaccgtggactcaagttgttatacattggcccaaacccatagaatgtacagcaccaagaatgaactctgatgtaaactatgggctctgggtgatgatgtgtcactgtaggttcatcacttgtaactaatatactaccctggtgggggacgctgaaaacgggggaggccgtgcatgttgagggttggaggcatatgggaaatctctgtgccttcctctcagttttgctgtgaacctaaaactgctctaaaaaaacaaagccttaaaaaaataaaacaaaacaaaacagaaactgtgctggctgaacaaatcactggtttgctacctgtacagcacagatccatgcttttccaaatatttttaaatgaaatcttacaccaaatcatagaaaatgctatcctaacatacaaaaaaggtaaatgcggaattggatgaagtgggcagaagtgggagacacactcagagtcccaccctccaaccccactgccgaggcccagagaaactcctccagcttcccagaccagtttgaaaaccactagcctaaagcacctgtgaatgaaagaatgaacagaatgaatgcctgtgacatcaacaagaaacaaagaaaagacccacaatcatagatactgtgggtgcatgtcacaaatgagttcctgctttgctgtgcaacagctctatggcatgatgggtggcatgatggcacagtatgatgggccagccactcctgtcagcggaatgcaagggcgaggcttaatggggaactgctaaaaatcaagcctgccctcagtactatggagagtgggcaggaaatggggtggacccattctgcaggccaaaaatccctggaactccctcctgtcatttctctgacaaacttcatgcctctcttctctccacaaataagacattttacatacatctcaccactgactgctatttggaattaggcatgacattacttactggctcatattataaatgtatacatgaacttcccagtattaggtaaatacaaagcatttcattattgattttgaatatttaaaaggcagatttatttaagctctttcagctcctacaccaaataactgcactgagtaggtacatgcctaatgaaaggtaccttgtgaggcctgaacaggttaagacactccgctgataaccaactggaaatacgattgactttttcctttaatttatcatttttcttaatacgtatattaatttaaaaaaatcctgacagcaggccaagatcattttaggatctgtttcatatgagaaataaagttttatggttcagttaaaagaccctgaaaaatgaggtttctaatggaaatgctggcagagtttctacttctgggctgggctggtaatactatttaaaaaaaaccagagggaggatcagagcatcactctccatacaaatgaaggtgtgctcctttgttggattacttggatatgaagcaggaaattaacacccaggataccttccttccttcacttttgcttcagattcctgtgcaagtcgaaactgaaggaggaaacacatgtgagtgttcagtgcaaaagtgagcccccagacaaagggggaggagcggggaagaaggacaggaaggtgcattcagaaggtgcctggatggtgactttctttgaagggtgtgtcctggatggacaagtcctaatggaagctcacagcagaaatccagtccatgacagaggcctggctaccacacatgggaatgcctggcctgcccacaccatccatctttggctctggagagacctggtcaccttggctttctgtttacttgctattgcctctccgaaggctaagggggtgtccggggcttagttctgcatggagagacggccacctttctccttgggtctctctttcctcttagcactgtttctactgcagtcctccccacatcactgcaggctcggagccacaatcactggccacgttttagcaaatgctgccgcttcctagaatgacatgcttgtgtccaattagatactccttccaccttactcaaaattgagggacagaagtgagcaggcagtgcagatctcgaggtacaggtcaggccaacagggcacaggatccccgggctgggggaaggacaggcacaggaaagcgaggtgggcgagcattctgtgatgctgacaagagcagggggtgaaactacttcttctttgttcgtaagacacctggagacctggcaggggaaacccatgtttcaaaactactcaaaagccgggcgcagtggctcacgcatgtaatcccagcactttgaggcaggtggatcacctgaggtcaggagttcaagaccaggctgaccaacatggtgaaactgtctccactaaaaatacaaaattagccaggcgtggtggcatgtgcctgtaatcccagctacttgggaggctgaggcaggaggatgcttgaacctaggaggtggaggttgcagtgagccaagattgcaccattgcactccagcctgggcaacaagagcaaaactccatctcaaaacaaacaaacaaaaaaaacaactactactcaaagaggtaaacttggagaagctcagccaatggaacgagatgaagtgaaggccatgtggcggcagcatgtgccttgacaacaggcatcagagagacagctgcagaaacgctggcccctttcatcgctgatgcggcctcagctccatctggccccactgtcagcccaggagaatgcagctcctaagaagtcttgtttgttttaacttgtctgttattctgtttccactccagttcttgctgcattcaacataaacaatttacccattcagtcatgaggaaaaacgaaaaacacacttgacaaccaaattttgtgttgtcgggagatgattcaatgccagttgctgagacaggggcagaagcaaaggaggcagggagacaagaggaggaagagggactctggagacacttaccaggggaggaccccacgcccgccgctcggaactgccccaggatgaggctctgctcactctctgccagcgccaggaggagttcgtaggcttcgatgcactgctcgctgaaacaaagcacatggggcctcagcccttgcagagaacagcggacaccttcaatgtggcgccggtttctgtgcaggaggcagctcaggtgctgtctcggcctcactctccacacaggcaaggaaaccacccatgaatattcccagggcagggccagtggcttgctctttcatttggcctttttatttttaaacctttaacttggttctggaaaaatacaagagaaacaataaaggtgggagaggcaaatgtgtcgtcccttcagtgaccacctgaaaggaccatgtgattcccttgtggtaggccactccaggtagtcccgctgagccggcaccctggtgtccacacccttgtgctgtcccccatctgcactgtaccagggttggtctgtgtgacagaagtgacagtaggtcatttccaaaattagcttactaaaaaaccctgacttccatcttggtcactctctctcacttcactatcttggaccatcctccccggagcaggccagctgtcgtgtcttcaagattctcaggcagccctatggagaggtccacatggtgagtaatgactaaggcctccagccaacagccaggtgagtgagccttcttagagcagatcctccaatcccccactgaggtctcagatgatacagccctggctgacagcttgaccagaatctcacaagagaccctgaaccagaaccacctactaagccacccccaggttcctgatccttgaaactgtgatgcagtaagtgattagtcatacaacaataggtagctgatataacatcccacaaggagatgattttgacctagacctgcactattcaatatagtatctactagccacaaatagctacttaaattgaaaatattctgagttaaataaaatgaaaaagtccattcctccattgcagtagccatacttcatatgttcaatagccatacatggccagtggttaccatattgggcagtgcatgtagagaacagttccaccatcacagaaaagttctattagattctcataaaactaagtgcttaaaatgtctcatgaaacattcttaggccttcacaaaagctctgacaagagtttgagtttggatttctaggaggaggaaacatagtcactcttctttgtgcccaacattcattgggcaaacaaggtaaaatatcaaacaacagtccctttcctgtagcgtgagacccacgtggcccacgtccacacaagaggaggtggaacatgtgtacagcatcctcagggtcccagataatatgcctgcagtaggaacatttcctctttaagaaagtaactgtctagcttcttcaagctgaacaggggatatgttgcttcatttagtcaacagacaatttcctttgattgcctttcttttttttctttgagacggagtctcgctctgtcgcccaggctggagtgcagtggcacgatctcagctcactgcaagctccgcctcccaggttcacgccattatcctgcctcagcctcccgcctcagcctcctgagtagctgggactacaggcgtccaccaccatgcctggctaacttttttttttgtatttttagtagcgacggggtttcactgtgttagccaggatgatcttgatctcctgacctcgtgatccgcccgcctcggcctcctaaaatgctgggattccaggcgtgagccaccgcgcccagcgtcaattgactttattttcattgtcctttactaagagttaagacaaagggctgaaatgctagccctaggtgataccagctcctcgtttcaaaggcagttcatattccagagatgtgaggacatttccttatccatgaggttgtactaatgtggagaaagacctttctgctcaaaggcagattgtgggtggacagcaaccagcttcaacggttatcacagatggattatctgcttgctttgctgtctgtaaaccagaatgattgctctctagctttggtctcattcattttgctttgataatttcctgaataaacaagaatgtttcttaaacaataccgaactttttagaggatgctaagtgtacgatacagtcaactactctgaggccttggcaaatacacttaagtggtaacactaataaaagaaacctatgatgataataataaggcatagttttgcagctttaaacaagcagtaatttaaaaacagataaatttcaaagtgatgaggcagaaaaaaaaaagtggcccattcaaattaccacttgctcaccaatgagtgaactgtagttatttaaattgacttgttttcatgacaaaaaatcagcagcatgcctgaagaccaggaaaatattcatatcctttgacctacaattcctgctttgggattttatccagaggaaaatattcaaaagaatgaagatcttatctgcattaaattattcatcatagaattatttttaatatcaaaagtctaaatgtcttttagaaaagtgaataaattaacaatataaaaacttgttggaggggttacagccattcagaatagagactattaaaagcaacattttaagactacaacaaaatgaagaactagaatgcactagatttataacaatgtaaattacatatgaacatgaataaagatctgcaagaagaaatgaacatgtaacatgccaaaaaaatcgatattttgagtgatagtacctaaatgaaatgatatttaagatgaatatgctaggagaaatatacctgtttactaacatcatattcattactcttagctatttgctgtccaaaccgccagatatgccttggtccaaactgccagatatgccttctaaaagcctatttcctacttttattctgaaggttactctggatgcacttctaccctgaagtagctccaaacatcccagtgtgtgcctacctgtactgcaaggccagcctcagcgctgtggcattggattcgtattttcccaccagcatgctcatcctctcggcattgcttttacattcctccaaggttatggtcaggaggtcattttgggatttgaggtgctcaatccggctacaaaggaacaaaaatcagattcacactagggttacagttaatttgccaatatttcagttgtctcatttatattcagggcagaaaagcatgtgaggatgtgggcctgtcagattagtagctgacacagtattttgtcaaagaagcaactctacataaaagtatcaccaaactctgtgtgaattacaaataaaaaataagccccctggttaaaaataagccccccagccattgccacactcactccatgtctatcatgagcagggcacagtgctaggctctggagatattccaaggaaaggagacagttgtgcaacctccaggccgccatcatgtggaacgtctggtgggcttagataagtcaccctccacatgcaaggatgaaaagcagcaagacagcagtcatggctatttgttaagcctttgctttagtgattctcctagcagccttttgaattaagtgttgttactcccatttcagatgaggaaatggaggtccagaaacattaagtatcttgccctgggatttgaaccgggaagtgtgaccccaaatcccatcctcataatcacaaactacagagagaaccaaaggaagaatcagtgagtgaacaggaaacttcccctggtggcctttaagtgggaaatggacgaggagctatggattgtacccaaagctgcttttgggttacacagtctagcagctctaactagtggtaggataagcattgggaacttgaagttttacaagattcagaactgtagattcagggcaaatgagtctgtggcaaagttagcaaacaaatgaataatatgatccttcagcttctccgttttccatctcagggtacagatgctcttgatgccacaagtcattttccatggacacatctatttgtagtactctgaccactaactcttaaagagaaagcttcacacaaacaaactgcaagtgacttgaaatgttaaggggtttggaagccattagcttcaaggaaaaatcttagactcaagccttagagcagaatatggagacacttgccaacatgggagacatctggtgagtgtagaagaactaagatcactgccaggctctggccattccaaggtcacttcaaggtaaggtgccacaagaatgcttttctgcccctgttcacattaagacttcttgaaaagagtcaccattctctcacttttcaacttgctccagtctacagtctgtcccggctaattagataaagcctttacccaactcatagacctccatgtagccaagcccatctcagggcccttctcagacaacaccccactgatctgttactctttccttcttaaagagctcccctcacttaagccatggtgggtctctgctggttttcttcctgccctagcggctatttcctctcagtctcctttgctagatgctcattctctataaaattagtaaggcttgccattctcttggggctgtcccggggtcccctctgctatcaacactcccaccctaggggtgatttctatccagtcccatgatgttattaggcaggtatgctccgctggctcacaactttctctagcccagcgctttcttctgagggccaggctcacatatccagctgccttcctgacatttccttttgctgtcacattgccacctctagtttaacattccaaagtgggattcttgatttcccctgaacctcatcctcccttatcttctccatctcagtaaatgccaccaccgtctacccaacactacatgctagaccaagcttgtccaacctgtgggctgcatggggcccaacacaaatttgtaaactttcttgaaacattacgagatatttttgcaatttttttttttttcagttcatcagctgtcatttgtgttagtgtattttatgtttggcccgagacattgctcttcttccagtgtggcccaggaagccaaaagattggacacccctgcactagacccctgaggatcttttttgagaccattcctttctcttattcaagtgcaacccagctgcagtttccactgctttcagcaccacacatggcgtgcgtgaggcccctggccccatcctgccagagctgccctggcataccacaaagattgtgctgcttccactcttatcccatccttcccattctccacacccaggtaagcttccataatgtcaatcagatcttgtttttccacattcgaaaaccctttaatgacttctaattacacttcgaataaagagtaaaatttgtccgtggcatcaaaatccacagctgagccagcccctgctctgccacctcgtctcatgtagcttcttccccttactccatttcagttccgctggcctttggacaattcctctttcaggcctcatggttgttaagtggccataagaatatcagttcgccatatggctgcttttttttttttttcttttaaatccatctcaatgtaagcctcccatcttcagatgcctgccctgactacccaccgaaaaattaaccttctctggggtcccacgcccacggagcttcgctcactgctagcacagcagtctgagatcaaactgcaaggccacagcgaggttgggggacgggcgtccgccactgctgagggttgagtaggtaaacaaagtggctgggaagctcaaactgggtggagcccaccgcagttcaaggagacctgcctgcctctgtagactccaccgctgggggcagggcatagctgaacaaaaggcagcagacaacttctgcagacttaaaagtccctgtctgacagctatgaagagagcagtggttctcccaccatgcagtttgagctctgagaatggatagactgcctcctcaagtgggtccctgacccctgagtagcctaactgggagacacctcccagtaggggccgactgacacctcatacagctgggtgcccctttgatacgaagcttccagaggaaggatcaggcagcaacatctgccgttctgcagtatttgctgttctgcagcctccgctggtgatacccacacaaacagggtctggagtggacctccagcaaactccaacagacctgcagctgagggtcctgactattagaaggaaaactaacaaacagaaaggacatccacaccaaaaccccatctgtacatcaccatcatcaatgaccaaaggtagataaaaccacaaagatggggagaaaccagagcagaaaagctgaaaattctaaaaatcagagtgcctcttctcctccaaaggaagacagctcctcgccagcaatggaacaaagctggacagagaatgactttgatgagttgatagaagaaggcttcagacgatagataataacaaacttctccaagctaaaggaggatgttcgagcccattgcaaagaagctaaaaaccttgaaaaaagattagacaaatggctaactagaataaacagtgtagacaagtccttaaatgacctgaaggagctgaaaaccacggcacaagaactacatgatgcatgcaaaagcttcagtagctgatttgatcaagtggaagaaagcgtatcagggattgaagatcatatgaatgaaatgaagtgagaagagaagtttagagaaaaatgagtaaaaagaaatgaacaaagcctccaagaaataagggactgagaggtgacaaagtgctagcagcccttgcttgctcttggcacctcgtcggcctcggtgtctgctctggccatgctcaaggagcgcttcagcccaccactgcactgtgggggcccctctctggggtggctgaggccagagccagctccctctgcttgatgggaagtgtggagggagaggtgcgtggcactcgtgggccagcacgagttccagctcagcatgggctcaccaggccccgcacttggagcagccggctggtgccactggccctgggcagtgaggggcttagcacccgggccagcagctgtggagggtgcaccgggtaccacagcacttccggcccgctcgcgccacgctcgaattctcactgggcctcagctgcctccccgcggagcagggcttgggacctgcagcctaccatgcccgagcccccctcaccccctgtgggttcccgtgcatcccaagcctccccgatgggtgccgccccctgctctgaggtgcccagtcccatcgaccgcccaagggctgaggagtgtgggtgcatggcacgggactggcgggcagctccgccagcggtcccagcgcaggatccactaggtgaagccagctgggctcttgagtcgggtggggtcttggagaacttttaagtctagctggaggattgtaattgcaccaatcagcactctgtgtctagctcaaggtttgtaaatgcaccagtcagcaccctgtcaaaacagaccaatcacctctctgtaaaacagaccaatcagctctctgtaaaatggaccaatcagcaggatgtgggtgggacgagataagggaataaaagcaggctgcccgagccagcagcagcaacccgctcgggtgcccttccatgctgtggaagctttgttctcttgctcttcacaataaatcttgctgctgctcactctttgggtccgcgccacctttaagagctgtaacactcaacgtgaaggtctgcagcttcactcctgaagccagtgagtccacgataccaccagaaggaaccaacaactccagatgcgccccctttaagagctgtaactcactgtgaaggtctgcagcttcagtcttgaagccagcgagaccacaaacccaccagaaggaagaaactccggacacgtctgaacatcagaaggaacaaactccagacacaccatctttaagaactgtaacactcactgcgagggtccacggcttcattcttgaagtcagcaagaccaagaacccaccaatactggacacaggactatgtgaaaagaccaaatctacatctgattggtggacctgaaagtgatggggagaatggaaccaagctggaaagcactctgcaggatattatccaggagaacgtccccaacctagcaaggcagaccaacattcacattcaggaaatacagagaacaccacaaagatactccttgagaagagcatctccaagacacataattgtcagattcaccaaagttgaaatgaaggaaaaaaatgttaagggcagccacagagaaaggtcgggttacccacaaagggaagcccatcagagtagtagctgatttcttgggagaaactctaaaagccagaagagagtgggggccaatattaaatactcttaaagaaaagcattttcaacccagaatttcatatgcagccaaactaagcttcataagtgaagaataaataaaatcctttacagacgaacaaatgctgagagattttgtcaccaccaggcctgccttacaagagctcctaaaggaagcataaacatggaaaggaacaaccggtaccagccactacaaaaacatgccaaattgtaaagaccatcaaggctaggaagaaactgcatcaactaacaagcaaaataaccagctaacatcataatgacaggatcaaattcacacataatattaaccttaaatgtaaatgggctaaatgtttcaattaaaagacacagactggcaaattggataaagagtcaagacccatgagtgtgctgtattcaagaaacccatctcacgagcagagacacacatgggctcaaaatgaaggcatggaggaagatctaccaagcaaatggaaaacaaaaagaagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagacttagactcccacacaataataatggagactttaacaccctactgtcaacattagacagatcaatgagacagaaagttaacaaggatatccaggaattgaactcagctgtccaccaagcagaccaaacaggcatctacagaactctccaccccaaatcaacagaatatacattcttctcagcaccacatcacacttattccaaaattgaccgtgtagttagaaggaaagcactcctcagcaaatggaaaagaatagaaattataacaaactgtctctcagaacacagtgcaatcaaactagaactcaggattaagaaactcactcaaaactgcataactacatggaaactgaacaacctgctcctgaatgactactgggtacataatgaaatgaaggcagaaataaagatgttctttgaaaccaatgagaacaaagacaaaacatacaagaatctctgggacacatttaaagcagtgtgtagagggaaacttatagcactaaatgcctacaagagaaagcaggaaagatctaaaatcgacaccctaacatcacaattaaaagaattagaaaatcaagagccaacacattcaaaagctagcagaaggcaagaaaaaactaagatcagagcagaactgaaggaaagagagacacaaaaaacccttcaaaaaatcaatgaatccaggagctggttttttgaaaggatcaacaaaattgatagaccgctagcaagactaataaagaagaaaagagatgaatcaaatagacgcaataaaaaataataaaggggatatcaccactgatcccacaaaaatacaaactaccatcagagaataccataaacacctctacacaaataaactagaaaatctagaagaaacagataaattcctggacacatacaccttcccaacactaaaccgggaaggagttgaatccctgaataggccaataacaggttctgaaattgaggcaataattaatagcctatcaaccaaaagaagtccaggaccagacagattcacagccgaattctaccagaggtacaaggagaagctggtatcattccttctgaaactgttccaatcaatagaaaaagagggaatcctccctcattcattttatgaggccagcatcatcctgataccaaaaactggcagagacacaacaacaaaaaaagagaattccagaccaatatccctgatgaacattgatgcaaagacctcaataaaatactggcaaaccaaatccagcagcacatcaaaaagcttatccaccatgatcaagtgggcttcatccctgggatgcaaggctggttcaacatatgcaaatcaataaacgttaatccatcatataaatagaaccaaagacaaaaaccacacgattatctcaatagatgcagaaaaggcctttgacaacattcaacagctcttcatgctaaaaactctcaataatctaggtattgatgggacgtatctcaaaataataagagctatctatgacaaacccacagccaatatcatactgaatgggcacaaactggaagcattccctttgaaaactggcacaagacagggatgccctctctcaccactcctattcaacacagtgttggaagttctggccagggcaatgaggcaggagaaagaaataaagggtattcaattaggaaaagaggaagtcaaactgtccctgtttgcagatgacatgattgtatatttagaaatccccatcacctcagcccaaaatctccttaagctgataagcaacttcagaaaagtctcaggatacaaaatcaacctgcaaaaatcacaagcattcctgtacaccaataacagacaaacagagagccaaatcatgagtggactcccattcacaactgattcaaagagaataaaatacctaggaatccaacttacaagggatgtgaaggacctcttcaaggagaactacaaaccactgctcaacgaaatagaagaaacaaacaaatggaagaacattccatgctcatggataggaagaatcaatattgtgaaaatggccatactgcccaaggcaatttatagattcaatgccatccccatcaagctatcaatgacattcttcacagaattggaaaaaaactactttaaagttcatatggaaccaaaaaagagcccacattgctaagacaatcctaagccaaaagaacaaagctggaggcatcatgctacctgacttcaaactatactacaaggccacagtaaccaaaacagcatggtactggtaccagaacagagatatagaccaatggaacagaatagagccctcagaaataataccgcacatctacaaccatctgatctttgacaaacctgccaaaaacaagaaatggggaaaggattccctagttaataaatggtgctgggaaaactggctagccatatgtagaaagctgaaactggatcccttccttacaccttaaacaaaaattaattcaagatggattaaagatttaaatgttagacctaaaaccgtaaaacctctagaagaaaacctaggcaataccattcaggacataggcatgggcaaggacttcatgactaaaacaccaaaagcaatggcaccaaaggcaaaatagacaaatgggatctaattaaactaaagagcttctgcacagcaaaagaaactgccatcagagtgaacaggcaacctacagaatgggagaacatttttacaatctacccatctgacaaagggctaatatccagaatctataaacaaacaaatttacaagacaaaatcaaacaaccccatcaaaaagtgggtgaaggatatgaacagacacttctcaaaagaagacatttatgcagccaacagacacatgaaaaaatgctcagcatcactggccatcagagaaatgcaaatcaaaaccacaatgagataccatctcacaccagttagaatggcaatcattaaaaagtcaggaaacaacaggtgctggaaaggatgtggagaaacaggaacacttttacactgttggtgggactgtaaactagttcaaccattgtggaagacagtgtggtgattcctcaaggatctagaactagaaataccatttgacccagccatcccattactgagcatatgcctaaaggattataaattatgctgctataaagacacatgcacatgtatgtttattatggcactattcacaatagcaaagacttggaaccaacccaaatgtccatcaatgatagactgcattaagaaaatgtggcacacatacaccatggaatactactcagccataaaaaaggatgagttcatgtcctctgtagggacatggatgaagctggaaaccatcattctcagcaaactatcacaaggacagaaaaccaaacaccacatgttctcactcataggtgggaattgaacaatgagaacacctggacacacggtgtggaacatcacacaccggggcctgtcgtggggtggagggagcggggagggatagcattaggagatatacctaatgtaaatgatgagttgatgggtgcagcacaccaacatggcacatgtatacctatgtaaaaaacctgcacgttgtgcacatataccctagaacttaaagtataattaacaacaacaacaaaaaaaaaaaagaaaagaaaaaagaaaaatcacccctcccagagcttctgttggtgtcctatttatttccttcttggatctttcttatcatcttatttgttttctctttggtctattttccctaacagaatataagctccatgagagcagggaccctttctgttttactttgctttgcatgccacatagcctagcatatagcagatgcttaacacagatttgctaaagaaggaaaacattttggtgggtagggatgaccccccctcccctgccaatcatgaagttaaaggctaacatactttgagagtaataggcctccaactttgaggtagttagaatagcagacatcaggatatactggtagcttatttctaagaacccccaggttcccgcagcagctaggatcacagagatgacaatggaggtgaggtcaaagggtaagggttggaattctgtctcagctacttaatagctctggatttaaggcaagtcactcaacttgggacttcaaagcctttgttttctcatttgcaaaacaggactactctaccctcacaagctgaggattaagtggctgtctgcgagagccctttgtaagctgttaaacaccataataacatcagctaccagcaaaatatttcccccttctttggtctctcctgggtgtatataacggagtagaaagcaactgccctattcaaggtcagccacagatccaacttgttaaagcccagaatctgtagagaggagatcctcactaaatcgaggtccccctgaaggcatctgacttcattaaattgcaaagggcatatctgattcaatttttaagcactcccagggcagtgatactgaaaagactgcttctttactgccactaagtaatcaccaggattatcactcttaagtattctggatttaataaggaaaccatttaatttcaagatttaaaatgacctagattgccaatttaccttagttctcaagaactgtattaaacagcttcaatcaggcaggactaacatgataattcaatttattctggtttgccatacacaagaggaatggaattaagcaacagcggatggggaacggtatccctatttcttcctggttagctcataagtctttcaaattcttacaatgctctcccactaaagattggtaggtcaaggcagccacaccacactcggatgtgactcaacagtccattctgccactgcagaaccaattctgaggccaagtggtttccatggttttgccctggtcattctcctttgctttgttagcaactccctcatcactggcatgacacataagagagtctttgccaacaggcaaaagggcaaactgaaactacctcttttgtaagacttgaaaagaatccataaaatggggtatatggtaaaattactctaggtaggacagttaggataggatgtagggatccaagactgagcacatttgcgaagaacataaataaaactaggcaaccatcaggaagatgatctaaatcagcatgcctggtcgatgccaggaatggctctaccagattgcctgtgctgtttccagtagctccaagtgcctctaggatgctgactcaacattccagaactcccttctgtggttctctgcagcacaggcctgcatgcttggcagccacctgtgacctacttgccattctgtagggactgctcccaggactcactatgtaatttgcaaggtccagtgtgaaacgaaaaagtggggtccgttgtttaacaatattaagaatttaaaacgttgacagcagagcagtgaagcaagtatggcacctttctaagcataaggcccatgtgaatgccaggtcacagccatgatggcagctcagactgctgtgagcactcctctgatgaccaaggtggtaggaacttccatccccaccagcctgacggtactgctctatgtcacaatacataagccaccttgaacagatctttggaaagagaagtgaggagtagcacctcctccctgccccacaatcaaatcgatacgatctctcctcacctattcagccgttctgtttccacctcaaactctctaatcttgctttctgagatggcagatccgtgtgagtagagtgtttggaaaatctcttggatattggagcagtcctgaagtgagtgggccaggtgttcagccacactgctggatacctgcaaaaagaagcattaattcccctttggaacatatcatttcagagatgcatgttttgcatgcaaaagaatttaaagctgatattccgtgagaatcggggactgggaggatggttaccctgaaggttctcagtttgtaggatagaatcctagtatgaaaagctaactattaaatactataaaagcagtagaaaaaaaaaaccaggatcaaaatatggctccttccccaagcacgtggtgctgggcagccaggatggggagatcatgccttcttggagttccttaaattctgaatgtggaacagagtcaggatttctttcccctatcctgaattccctgccactccaggccactgtttttggtttctgtagcccaggagaggggctgactccttcattttcacaatttggctttggcacagaatctgaatgcatgcatttttgctcagtgtaaaattctaaattagggccttaaaatgctattcaggctctctctgcctctgaggatcaaatagctggctctctaagcctcatccccaatcctaaaagatcccttaaagaaatgaaactactccttttcaccatccatcagctcttacagtcccagggggtttccagactccacaaatgaaaactctggaactaaagtgaaggttctggtctttcccaccactgggctaggcttcaaagacaacattcctcctcagtggaaagcacatcccctttcaagatggatgtgcaaaagacaaagttattttagagctcttggtctctggggtagcagggtgatataagacagatacttcaagactttcatctatatcaccaagaactggacctaaatcatttgtttctgaatggtttcaaggaaaggaaaaaaaatctcccttaaagctgaagaagtaattcaccatatggatggaaatcatcatacattttaatttaatcctttggaaggaaatcaggtatgatttactattataactaactggtttattggagatagactttggaagttcttctgtcatctataatccattgtctgtgtagctctgccgggtactttcttgccttgcttctcatgaacactcacccctatgctactgatttctgagcccaggactggccgatcagatgatgacgattcggaccttgtctttgatagcttcaccctctcagcaatcttaaaaaagaaaacaaaacattatagaaaactacacaccactcctcagataaactgttgggactacgcttatacagggctactttttagccatgtcaactaaatgattaaagaacttaagaacagctcacgtccaatttttctaccaccagcttaagccagggcctttcaacttcagcactgctgatattttggcttggataattctttttatgggggtctgtcctgtgcattgtaggacatttgtcagcatctctggcctctagccacaagatgccagtagcactccaattgtgaccatcaaaaatgtctctagacattgccaaatgtcccctggaggatgaaatcacttctggttagaaaacactggtttaacctaacttattaaacttgatagttaagaatcaaccttattgtggtggctagcagagctaccaggcaagccaacaggcataattttaatcatctgagacagactcaacataggtactggggggctgtggcagtgagtcagtggggctacttctcacagctgccacagcctgtccatcataatctatttttctttttttgtggcagagctgtcagtcttgtgagtggggagatcattggttcattactcaaggtccctgactgggctgaaccttagtctttgagagcaactctgtccactgtgaagtactggagcacttgacaaaacgtctcactctccataatgacttgtcagctgtgacattctccagctggctgattaatgagagctggcgtccaggttgcagctgagagagacttaaaactattagtgggttatctctccttgcagctcctgcatagaaggcctgcgtaaggtcccaggggaagccccttgtgctgtctcagctaagggcatgcctgtacagtggctaggatgagcctggtgcttccagataacaggaggtgttcccgctcatcgggtccatccccaggaactcaccttggcgatgggaatgtcattgctgctgctgcttgtgctcagctccccagtgctggggttaatcgggcggttggtggaagtgaggcggccagggctggagggacctgtggcctgcacgctctgtagtcgagtttgaagctctctgacctgaaatcataatgcttttagacatagttggtggtttccctggctaaagagcaaaacagccagatgggtaggtggtggggctttcatttacattgagggatcagcccactgaaaagctaggttggttgagtccacataaaagtcattatattccttttttcggactaataatttttttttaatgaatcggtttcttaaatcacatgtaatacaaaaagtagagttataaaccaaagtgatgatattactagtttttatatttgcctaagagtcaccatattcttaacggaatctgccacagaccatcacctattcttcacaagcatgaggtgaacatattatgtaaggccctggaagcttccaggatggatgaccatctttttttatttttatttttttgagacagggtcttgctctgctgcccaggctggaatgcagtggtgcaaccatggctcactgcagccttaatctcctgggctcaagggatcctcctgcctcagcctcctgagcagctgggactaggtgcacacaccacacctggctaatttttaaattcctttgtaaagatagagtctcgctatgttgccagggctcgtcttgaactcctgcactcaagcgattctcccacctcagcctcccaaagtgctgggattaccggcatgagccactgtgccaagccactggataactacctttaaggaatgtttattctttcagccccacttgcctgactgtgctggggactgcggacgaggacccaggatgatatcacctctcatggaatcatcatttcagagcccagaggagacaggaatgatttcaagacaagtgcacttgagtgttataaatttctatgtcaagtgttacgggaagcagaaaaagggaagaatataactccagctgaagtcatccagagaaagctgaatgaagacagtggtacttgagcaatcttaaaggagaacaagtgaggagatggctttagtggtgatatgcctggggggttgaacaggtgctaggatgatatgctatgtttgaagaggtgcaagttattcaatatgtgtgttttagcagaagtgtctgtattggggaaaatattaggctaagagaagagacattgatggagccagcaccttttccccaagttacctacagatgagattttccctggaatagtaggtaggaacgtctaaatagtccttctatataaaaaagaaacacgggaccctctaagttacatttaaaacgtgcatttacctgcacagaaattaaatgtccaaatcctgctcctctatagttacaactctgtgacttccaaagagagaagtattccaagtagctgaagagagttgctagagattggtcttttataaccttggtcgcagtttcagcatgagagtgcagtgtctacctgaaagagcaaactaactacaacacccagcggtccttacaaatggacatcagactttgtcgggctgggaagagttagcactaggaaatttaagacagggctttctaaacagaatgtgtactagaatcccccagagggcttgctaaaacagattccagggccctaccccagggattctgatttagcagggtctggatgaagcccaagatctgcatgtctagtaagctcgcaaaagatgctgatgctgccggtcggggaccataccttgaatagcactcacctaagggacttccaaggccacaaagcactttaatcccatagacaggaagagtggagccatgccccggtgccagccctgccgccaaaagtcttctagacagggcagagaacaggcaggcacatggccccttctctaaaaggcactggaaagcttttcatattaaatgtctaggatgtctccatcctgctaacttgggaaccaaaagtaattgaaatttcaataattcatcaacatattagaagctaaaataggaaaattccctcaaagcaaattgcattcaatagtgcaacagctcaaaagtgcctaatgctctgccacggttccagtaacggaggatcgatggaaacgcttgctgtcctcaaaacagaccagacacagggctaaactcaaaatagcctaaagaataggaaaatatatccctgtagaagccaaatggtactgctgatgaaggattacaggactcgttctgaaatggtccctcacaaaccaaaaatgggtacaggggtggatacctcattatgccacaaagagagactgggcaaagagagagggctcattcatttcctcagggactgggggaaacctcccggtggagacttgcaacctccggtgaattcaacctcccggtgaatttcagtttttactgctgatgagtctgataaggtcctgaataattaacaatgttaacaccactccaaaacctaaatggtgtctgaattgcactcaagacaatcagtggtctgttcttagaatccctactggcctactcatctttttttttttttttatatctctatttaaaaaaaaatacagataaaaaaaatcctgggcaatttataaagacttcattaaaactatccatgttttaaaaacatttcttcttctaatcacaaaagtaaaacatgctcactgtggaaaatgtagatgacactaaaacataaaaacagtcaaagtgcttatgttctttcttactctacagaggcaatttactctaatcattttccttgctgtgtatgtgcacacatgtgcttaaaataatttctaaatctaaatatctactttcactttaaaaacttcggacccagagaatgtctttaaaaactaaagatgataaacatgtttattttgggctatgctttattatttaatgatagttgctagccagtggaaacaaacccagctgaagggagtgcagtgtgcctgtcagggaaagaaagacagctggttaagtggccttctcccccttcttttgatttgagagtgagaatcttaatttacaggaataaatgcaagaaactaaggctaaagccaatatgctgagtcagcttaggcatggcttcggaaagaggcagaaacatagttaatagagttctcacttttattctcacccattgtagtgggttggattatgtctcccccaaaagatatgtccaaatttgaatcctcagtacccgtgaatgtgaccgcatctcaaaatagggtctttgtagatataactaaattaacgatctcaaggcaagataatctgatttgggtgggccctatgtgcaatgactggtgttcttttaacagaaaaggaagggatatttaagacaaagacagagagacacagggaagaaggtcctgtgaagatgaaagcagagattggacacaagtcaaagagcaccaagagctatcagaagttcgaagaggcaaggaaggattctctttcaaagccctttgagggagtgtggctctgctaacaccttgagtttggactcctagactccagaactatgagagtttgtagtaatccaaatactccttcttcattgaagacttatttttttgagacacggtctcactatgttgtgttgcccaagctggcctcaatctcatgggctcaagagattttcccgttttagcctcccaagtggctgggactacaggggcatgccactgcacacggctatttttattgaaggaattatgtttctctctacaaaatatatattttggagtcaagagatagccaagaaccagggctaacctgaggcagggactgacacttgcgggaacatcattcagcacccttcacagcctttctcaactggggttcctcaacaccagaacatgacctgagaggctgttttttcacttctcctgaagttactgcgtgtctggtaaacattatgatgggaaacatgctctgaaagaggggtatcaacaaggagtgtcaaagtgcagaagaagaaacctggctggcctctgccttcctagagcaggcaacgctagaactcaatcttgaaggctgaactgttcaacaagcaaataaagaggaaaagataatggggagactctggaaggttcaagtagggaaatgacattaaaaggttgcagttgttaccctctggtatttcttcaagggttttgtaaaaatcatttgattagaggagaaaatggactgaagtaaggaagaaaaagttggtgagccaagagctctactgatggttcagataggaaattatgagggctcaaatacagtcagcgaagtgggaataaggatggcaaaatacactctagaccagtactatccaacagaacttcctgtacagacggaaatgttctagagtggcactatctgctatggtagcctggtgccacacgtggctgtaagcacttgcaatgtgcctggtgtactcaaggaactgaatttttaattgtattgtattttactttatttaaattcaaatctaaatggttgtatgtggctagtagctactgtacccatcagtgcagttctaaaaatattcaaggaggtgaaaaaacaaacaaaacacccaaacttgtagctggggtgattcagtggatcatggagttacttagcaatgagaaagaaaaacataaagagaagctgatcttttcggaaagaaatgaccagagctgacaatgtccggagctgacaatgatatcagctttggacatgctgaatttgagaaaacaactgggtatgtaagagagggcttatcagtcaacaattagagatgtaagtctgaaggaaagcaattagaactggatagatagatttaggaatgctgggcatggataaggtccaggaaggaggtgtggcagtgtggtgggcagagtgcctgtgtggagctggcaggagtggagggtcagtggaggacagggagatggggacacctttttctcggggagaaaaggaaaggaggtgaggacgggcaataacaaacgtgatttgcagactgtcaggggaagatgcgaaacagggactcccatctgatggcttctattttctctgctaggcatgaggggggaatgtcagaaatgagaaaggaggctgacctaggaccaaaaaagaaaaaaaaaaaggaagcttacacagcagcactgacagctcagttgagctctctttgaagacagtagactgaagaacacattgttttcttccaactctagagacctcaataaataatagtacaaaataaaaaaggattaaaaccacaacggagataagaatgtgcctggggcattggccgaaacaaaatttggacacgttcctcaacggccaagtgaaaagaagagcactgatgaaagacacagaataaaaaaagtctataatgtatacaaagagaggcagccagtctacccagaaggacgatggcagactctaattcagctttggcagagagcaggaaggacaagaatgagaacagaggctttcagaggttaacagaggttgcagctatgtaactgtacacaacaattgaaacttcccggcatatgacagcttcagctaaagtcaacaggtgctcctattaaaaatgcatagaaatcctgcattaaaaaaggaacaatgagaaataaattcattgccaaggtcaaaagacagcaaaatctccagatgccagaaatgagaaagaaggctgaaggagttgccaggaggtggtgccaccgcaagcccaggggctgtgagcagggcacagaatgagagcgtgggagggaggagatggagggcgcctgctagtctagctgcttgagctgatccctctgcctcacgcctggagcctctctgctcgacccataggtgaaaagctgaaagtgctgtccacagaaggaatcctgaggctgtgcagcggagtcaaccttcagaaaccaaaaccccagaccagtggcacctttgggtgtgaggtccaaatttatactatctgcatactgtgggactccaaacttgacatgaacactggaaactggtttggattttgccaggccacccactgcctcagaaactgcctaatttgtaaatcgcccagtatcaagagagaacaggagacttaggcttcccatgactgggagcccaggtccacaaagctgccagacacagagtgaggacaactacagagagcaaaagataaaacaagagagccagcagtctgaatcaggagctgaattcaccctaggggaaatgaaaataaagcaactggtaaaccacatcacaataggtacactgaggaaccttaaagagataaggggaataatttccttaagattaagaaataatgaaacaaaaatagacaccaaatcttaaaagccttcttgtggggctaggcacggtggctttggtggtaatcccaacactttgggaggccaaggtgggaaggttgcttgaccccaggagtttgagaccagcctgggcaatagcgcaagaccctgtctctacaacaacaacaacaacgaatcagccaggagtggtgcgtgagccagtagtcccagctactcaggaggctgaggtgggaggattgcttgagcctggcaggtcaaggccatggtgggctaggaggatcacaccactggactccagcctgggtgatgcaatgagactcagacacacacacacacacacaccacacaaacacacacacacacactgccttctcatgggatagaggcatctcaggttctgtgggtctgtgggtgttgttctgtttcattcactactgcattgccaacaccttcaacagggactgacacagtctcaataaaatctattgaatgccactaaaaaacctatcaccttaaaatctaatgcctacttagaatattgtggtaggctgaatgatggcccccaaaggcatccacgccctaaaccccgagaaatgtaaatgtagccttgtacggcaaaagggaactgagatgggtagagtatcatggatcatctaggtggactcagaagtcacaagacccctctaagagggaagcaggagtgccagagttagagctctgaagatgctatgctgctggcttgggagatgaaggaaggggcatactcaaaggatgcaggctccctctagatgctggaagcgacaaggaagtatattctcccctccagcctccagagagatgcagccttgccgacactttcattttagtgaatgagatgcattttggacttctgaccccctaggactgtaagatgataaatttgtgttgtcttaagtcactaagttcatgataatttgttacagcagccacaggagattacacagctattatcaagagtgtgggcaaaaataaagaccctctcaaagattaagaatctatcacctatagatctttgctgaaagaatttcctaagaatacatgattttcagtaccaaagaaaattaaacctgagaaaaagaatgagatgaaagaaacaatgaaagtacaagagctgacactgacgtaggtggtgaaatactcctttgctgctgttgggcggatgggctggccagatttcccaaaagctgccctggggtacttggtcaaagcaagactatacacactctgagactcagcagtttcactcctggacatgtgatcctgagtaattcccaccaggccggaggagacatgtgcaagggactatgccccggagcattgtttgtggtcatgggaaatgggaagcaatttgattgtcagctgctgtaaatgcaataggtgggtcactatagaatgctagatgtccttagacacacaggaccagatgtacacacagccatatggacaaaccttaaaatcagagtgctgaggagaaaaacataagagaaggcgacagcagagtaacatttaaataaattaaaagtaatgcaaaacactatcttaggacatgcacaaaatggggggaaggggatgggatattatatgggataaattatttgcaaggaataaattaaaagagggaccagtgaatgtgactagtgaatataattatcttctctctctgtcctgagtgccaaattacaacaaaagccaggcatggtggtgcgcacctgtagtcccagctactcaggcagcttgctatgcaggaggatcgcttagcttagaattcaagggtcgagcgcactgtgattacacctgtcaatagccactgcattccagcctgggcaacatagccagatcccatatctatcttatctatctatctgttgatctctctctctctctctctctcaatcaatccaaaagaaagtaaatgatgcaagccaggagcataagggattaggcagagtgggaaagtgagatgttggggggatttggccctagagctgtcaaacacaaagagtgtgcacagaagcaggtttccaaagtggtaggaaattccttggaaacgtgaggctaggcaagtatgagacaggtcagctatgcggatgcttcaatctctgagtacaattgtgggagcacagacaagagtcagctgatgaagtcatctgtgaatgtggctcacagatgagtgacaagcaggaaggcaaggtggcaccagagtcctgagcaggatcagaaacatttttattagccataaaagaaagagcctgttctgctgatgatacgtagcagtactcactgggtagttgtaatttcaggcaattaggctgtaattcataatttcactgtgtaatggagctggttgagatgagatgattcccacactatagaatggtgagaatcactaggctgggaaagttctacttaatgagcttcatgcagttagtccctgtgtagtttttggaaagctgctatctcgaagtccagggtttgtagatattttgccgagaaccacacctcttattggagattttatatgatttttcttagagccctcaaataatcagaatctatttacagcaaatatttatttctttctataaatcaaatttacatggtgtttcaggatagtggtattttattgttaatggcaattttgactagatggaaacagaagagagagatcacaaaatagaaggagaaaacatccaacagcatttccatctctcggtaagtttgatatgtgtgctattttctcttttgttttatagcccactaaagtacctggatgtgttataaaaatggttgcattggaaaaggccagcattttggcaatcttccttttttttttttttttgagacagaatctcacacgttgcctaggctggtgtgcagtggcgcgatcacggcttgctgcaacctctgcctcccgggttcaagcgattttcctgcctcagcctcccaagcagctagaattacaggcgcccaccaccacgcctggctaattttttgtatttttagtagagacggggtttcactatgttggccaggctggtctcgaactcctgaccttgtgacccacccgcctcagcctcccaaagtgctgggattacaggcatgagccaccgctcccggccaatgttcctaatttcttaccagctttttgacaaattgagtcagcttctttcatgacagccaagagctagccttgaagcagcctggcctcctcataggcacatgaggctggggtgagtaagcaaatactggtgcccacagcaggagttgcctcacaatctccgtggctcaagtgtgtgtaaggccctcatgaagtaactgggagctgtgtccatggaagaggtcaaagaaccagggttctggggattctctgccttggattccccctaaaactccctcagtctacagagaggaggggaacacaacactggactcaggtcaaggtaaaagcatgcataccaccagcttcctattttctgcaacaagctcagtgtgccttcatgtagcattagaatgccaggagagtgggtctgtgaaaccctaaggaatctggcccccatgttgctgtaacagaggacattttacccactgttggtctgcatgggagtggggctaggatgaggacaagggtggacagaaggctacaggaaagtggtctaaacaagagaacaatgacaactgcctcccctaataaggccaccagatcccaaattttggtaccaagagttaacatcaacgtagacttgggcaagattgttaaagcttttgtaggcctctgttttcccatctctaaaaagggtataataatagtacctatcagctaggattctggagcagattaaacaaaatgtgcataaatcatcacccatcacaaataagtgtttgaaatatgttctgggctattatcataatttaggttttcaaaattatttatttttagagacagggccttgctattattacccaggttggagtacaatggtgtgatcacagctcactgcagacttgatcacctgggctcaagccattttcccacctcagcccccgagtagctgggactatgggtgcacaccatcacacttggctaattaaaaaaaaaaaaattttttttttggtagaacagaggtcttgctatgttacccaggctggtgatttaggctttgagtaagtcccgctttgcctttagaggtatctgattttaatctggggggtgtctagtctgagaggagttcagtctgcaaatattcacagaatgtcaatactatcaatattattaacagagcctttcttaaaaataagccctactgagcttgcactggtaagtggctccctgtggaagtgatttccttcatggggtgagctgggggacttggcactgggccaggcagtgcctccatgccttgggagccccggggtgcctgtaccctggtggactccaccctccctccacttctagctcagatgaccctggtgaagggacagtgcagggcaggctccacatagcaggcagcttccctagcagatgccgggcttatcactgctacatggtgggcccaggaggagcaggctgggcatgaggagaaggcagaaagcctgtagctctttctctcagttcacctgcagaggggaagtagaggacacttggagaagctcttggcccatgtccagtgggtgaccaaaggacactgcctctcccttccttgtctccaagtgctgaccacaatcataatgtgggggagtgtgccagggtgctacaccccatttactgactctggctcatggaaaggcctgggcacacatcctctcaaagagcttcccagtgattctgacacacacgtgtggggtcaccacaagatggatgagtgaaactgcctgtttctctgcaactctgattcacggccaagcccggctggtatcatagtcaaagcatgtaaatcagctgcatcagaaacttgtactgttgaatatccacatgttcctaagcccctttatggttaggtaaagccatctgcctagttctggtcaacaggcagggcgcagaagcatttaaatgctgtggtgggagcctttgagtgggctcttaggtggtggatggccaacagtctgagtttctgagtgaatgtatggatcagagacgtgcacctgtcccctaacctgcactgaatatatggtgcaggcaagaaacaacgtgccatgccactgagatttggggagtgaacctgttattgcagaaaaatctagcctcatactgactaatataccagccatacaaaagaagagccacctgagcctcccatgtggaaggagcacactgaagccagacctggctcctctcagctccctcccatgcagctagatgacagctggggagagctgagaggagcggtgttgagacaggacttggttttacagaacttttatgaatttaaactcagctaatattggcatcctcttccttatcctgaaaagaaattcccatgaagaaatggaacaaataagaaatgaacaaagttccataaaggacaaaaaagaagactcagcttatatgtgaatatcaaaccattaaaagctgtgagatacagatcattctccataatccatacttttttgtttttgcttaatttgaaaattaaagaggacaaagaagaaaaaaagcaatcgcatacttccactgcccagatttaacctgttaatattttagcatatcagtgttctatttctatgtatatacttctgcatattaaaaattatacaatgatatgaatacattcattaaaaacataaattagaacattatagagaagtttaaggtccctttgaggccaatacaacatattaccattatgatgttggtttatatttttctggtctattttcaatatttttatatacatacatatgaatatctatgaaatggaaatttatacagctataaattcataataaatataaagtactattttgcagtctgcattttctctatatagccctgtctcaagaaaagcaacaccaaggggaggtagagtgggaccagctcagacgggactatggccaaatgaggctaaaagagatgtgagggaaaacatagatgtctctttatttaacctctgtaagatcacaacacttacacttccaggctggtctcaaactcctgggctcaagcaatcctcctgcctcggcctcccagagtgctagaagtataaacgtgagccaccgcacctggccgagggtgacttttatttggttcaaaatagcatgtctacttgtctcttgaatttactgtggcaatgaaaccagaagccagacccccaggatgagagaggcccaggagagacagatggaactcattccaagacatgcagaaaatacccaggtagagcacagtgtgtaaagaagaaattgttaacaccttatgacatgaacatgcagaagaattctgtaaatctgaagaatttctagaaaatctcagaaggaacttatgtggccgatttgtgttcaagtctatggttcagcgggacacagtttcatgtgcctgtggtcatatcaagtttgctttgccaaacacattggggaaagcgctgattatttttgccacatcatggctgacttaaacaatgtagctaaaaaaatgggaacaatgtggagaaagtggttcctgccatcacacgactctctggggagctctcagggcactctctgtgtttacctgtccccaccacttgacataaaccttgcaatgatctgtttacttgcctgtctctccaacatccttgaagccagggactgtgtcctgttcatcactgtaacccctctgtctggcacagagatgaccaatcacgtttgtgaaatgaatgaatgaagaataaagtaattcctttacagagtaattctcccttgcctacattaagcccaattctttatgtgtgaggaaatacatggttatatcacagagcaaacagaaataaatgattgcctcattcagtaatgaactaggaccaataataaaattgcctgttgctccttaggtactgctctgccactagcccaatttgttaactgactacattaaagatctaatttaattaaatcttgaacaaagctcagaagacctacagagagcactttgcttaattacaggcacggttcaagcaccaatcctattgatctggtcggttaaaattctatacaatgaatgtgggcaaagaaaaaaagaaaaagaaagtggccccaattgctcgtcaaggaactttgatgaactatggattcagagctgctacaaagacagcaaaggcaaaccagccttgtactctgtactgtcacagggtaaaaataaaatggtacctcagtcactctgcagagctacacatcgtcaagaacagaagacaatgacaaccacgaaggacagatccctcctgagggaaataaagcacactaggtgggtgggtgagtgacggctggaagaagacttttggcacttaaagtctagtaaacaggcattcaaatgcatctagtacactttttgagatctacactcatcttgaaataaaaagcaataaatccaattcatggtatgtatataaattcctgagaatatctctagttgaggaagagataaaagttaacattatttgaaggtaactgaaataaaaattatacaaaactatactagttgcacaaacttataaaaggtaacagatgtgactggaagaaaggctttgactaaaatgtgtctatgtgtgcaggcctgtatgtgtgtgtgtgtaattatccaatgtccatgttggagttcttcaaacatctaaggattcctatttaaaaaaatgacaggatggtgttcaactttccgtatcactcgacaggtaactatatattttactccaaagaactactactaattttttgagcatttactacgtgccagacatcgcctaaccactttacgagtattatctaatttttgctttgggtgctattattgtcccacttcgtggcagagtaaactgaggcacagagaggttaggcaacctgccaaagactcgtggtgacttggcaggtcaggctgtgcatgacccaggcaatctggctccagagccctggtacctagtgtagtgcctccgcactgtgctattcttaatactgacctccagagttggagaaaacactggaaagtggggaaggggactttttattttttgctagtccaccatgaagggctggcaagtgagagaagaaaattcattctaaaccacaatatgtaattacaccaaagaccaacaatttccctcacaaaacatgcaccatcagaatgcacacactaagagcaagtacatacctaattaggacatcagtgataatcatcggggagtgtaacccaggaaattacaggtggcgtgggctttagtgctaagcaaatttcatcatgctgcccagataaagcctttgctgactgggatgatttacacctgctgatgcaactatggagactgtcatccgatatagctgcatactgaaaatatgcttatgcacgtgagttaagacaaaatgatgttcagatatgagaggtagtagtgccagccttttaattatgacattagcacaaatgaagaagagttgataacattcaaaaatagtaatttcttccatatttttcaaatgaggaagagttgataacattcaaaaatagtaatttcttccgttttatataatggcaactaagaatacttacaaatggattaaaaacaaaatgatgtacacatcctgagctcgttgaagcatagaagagcaagttatttacaaggtcttttttatggctaagggagcaagagcaatggtgaaggatgatgagacccactagatgtatttttcccttttttttttttttttttttttttggacatggagtctccttctgtcgcccaggctggagtgcagtggtgcgatcttggcccactgcaacccccgcctcccgggttcaagcgattctcctgcctcagcctctcaagtagctgggactacaggcacacagcaccatgtctggctaatttttgtacttctagtggagacgggggtttcatcatattggccaggctggtcttgaactcctgaccttgtgatctgcctgcctcggcctcccaaagtgctcggattacaggcgtgagccactgtgcctggccagtatttttccccttctaagtcaactttatctgtgtacaaaattagcagtcagagcacaactagaaaacaagcttctaatattgccaagaccaagaaagagagtcaagtaagtctagtaattcaaagtgaagttctgagggaagtgtttgattgaggaattcattgcttcacccccagtccaatcacagatcaaactcacagccaaacacagaagtgcttgtgggttcctgggattaaaaacttcaccttggaaaaactgaggctttaacaattctgccgaacatttctatcctgaaacattagctccttcagtaatggatacatgtcctaaacaaaatgatactcaaactaggtcaggccctagggtgaatagcaggagtcacacatacacatctgtaaacacagagacacacacataacatgcacacttaaacagatgcacatacacacatacatatatgcacacaatgtacaagatatggctattttaacttcagtaagtctgcaccaggagagacgacattctatactagattcagtataagcaaatgagagcaggtacaataaagctaaataaaattttatagaaaaaaattaaaaaggtaaaattccatttttttttttcaaattctaaagactattagtttatcctaaagaacattttaattgagcttagaaaagatgtgcttaccctggaaagtttagaatcactgccccgatgtaattttatcaaccagtcagatttaagattccagagaaaagtgtttgctttttttttttaaatcttacctctataccttagcaatttcgaactactttcaagaaggacttcataacaggaaagagacagtgattcccaaaattacaaatgccacaaaattctcacggtgcccctggtgctatacaccagcctctctcagccccatgcccaggaagggcctgaccattatggatgcagcatgctcaccctcctccggagccggtcccgctcttcccggatggcattcatggtggccttagtccggttcagttcttcctctttgctgcacagcatggcagtcaggctctcattctcttccctcagcccagccagctccttctcccaccgagacctctcttcagccaggttgggatacaggtcccggccaagcaccccctcaatctcctcgactgtctgtaaaacacagccccaaagaaaagtcaagtaagttaccttggagaaaggggataggaagaaaataggctgaacaggaataaatgtccatagaggagtgtgttctagaaccactttgttataaatagtgatcatgactacagacaccccaaagttatcctgtctccaatttcagatgaggctctgtcacttgcctggggtacagtctgtgttacctggcaaccttcagagtaagaaaaacagtgagtcctctcctggcagctgagtctgtctgtggtgctagctgacacatccacacaatgcttatttccttcacttgagttccagagttggtggatacacacaaccaggcagaaggccatttagtgatcctggtaatgtgaggacaaacatgaggttgtaaactgcatacaaaatctaacttgaagtttcctaaattataggcctcccacatgccaactcagcgataagataggtcacattaccatttccagcttttagtgccacatccaaattcagatggtgcaaatgaggttcagtctcaagatgtgaaagacaaaaataaacctcattgacacagaaaagaggaagctcattgtggagatttctaagacagcagggattaaattaataatacagcttcaaaatttaaaggaaaatcttagtagcacatagttttaaaaaattcatttaaaaacatttaatgaagaagaaacatgcatattagggaaaaaaggaagaagtcattctgcttactcttataaactgttcattcacatttactgtcctttgaaaaaggaagcacaagccagtggataatgaaacaagagggagaattactatgaagaggtagaaggcagtgaagagatggaataagaaacagaagactggccgggtgcagtggctcacgcctgtaatcccagcacttgggaggcccaggcgggtggatcacctgaggtcaggagttcaagaccagcctgacctcaggtgaaaccctgtctctactaaaaatacaaaatttagccgggcgtggtggcgcccgcctgtaatcccagctacttgggaggctgaggcaggagaatcgcttgaatctgggaggtggaggttgcagtgagctgagatcatgccactgcactccagcctgggcgacagagcaagactccgtctaaaaaaaaataataaaaataataaaaagaataaagaaaagaaaagaaacagaacgcctccaatactaaaaaacataagggtacatcactcttggatgctcatgttggttctcaaatcttgctgccacttttcccatgtgctgctttgtccttcctttaaatctggagactctcatcctacttggctctgctccagaccctgtggctttgtccctagctggttggtagaggcccttggcctcctccttccctctcaactccgaggttggggctagacccaagttgacattacaatcaaatatagggcccaggagattccagagaaagaaacaccagcaattgcttctccctgccctgaactacatcaactacatatttgcaattgagatgaagaaagatggaaaaccagcagtgttacaaacatgcatcgtggtttaccttgtgacaccacagttcttttgtgcaatccaggattcctacttatagaaacttgggcctgcattttctctttatgggctcctcctagacttttaaatttgaattgctatgcccaggtcactaagttacgttgaaggaatataaagataccagaggcctagtatcagtaagccttgactttcccatcattcacaatgagtttgtgcagatgcaacaaattcctgtcaccatctcaaacagcaagaggaattgatgaatggactcctgaaatcgtattctagaggccttagagctttaacaaaacttccaagctaaacttacagcttacgagtggctctatgatgaaccactctaaaatgacgtggttcaatactagcagtcgaatggtttccaagtaaattgtcctttttaccgcaaagccagtgaacctgactgctgacatcatgactttttctgaaataaatcagcccaaccaaaatttctagagcccccgcttctacaccgtggctcaatctattgtatggctctcatggaaacattcatccctagtaagtatttaagaaaactgcacttcaagagaaggattggaccatttccctttcagaacctcaaagggcctcacagagggtgaggaaggtctaccttaatagccaggtcacagtgctcgctggctgtggtgagctgctcaatgtgcttgtccacctcggccacggagaggctgcagctgctcttcttcctgccgcagacaacattctccagccctgtcagcaccctctgcagttctgagttcaggtcactgcagttgtctgtgagtgaatgaagacaaaatgcgttacacagggcaacaaatgctgtctgttttgcttaccatgagggactcattcaggtaatgggatggcaatggagcctgacatttcaaagttcaacaccagccagcctaacctcacaggcactgcctctgagacttggagccaatgcaaagctctttttattaaagagtttcagatgatggtcattttctgaattctcttgtctttcactcaaagcagccacatcttgagtttctttagtaagaacaaagaaatgcccagaagaggctgttggcacttccagagcctctggtcaacctgtctgctgtcattcagacaagcactaactgcagaaagatcccataactttactaaatgtaacaaaaagtctcagaatgagcagagatgctaggtattttgaaaaacagaaactgtgtaagagatagtccttgccctcaatgagcctaaaaccaagaacttttccatgatagaaccaatcaatatgctccactgttgcaatttaatccatgttctttcatcagggggaaaaataaactgttctaacaaattccttattgttctccacataaggcaaccaattctaataatttgattttgacttaaaaacttgggttgctttgaaccgctggacatccagggcctggtcagagaaataaaaaataattataatgtgattcagatatatcttagaagacaattttgttgggaagaaaactccccttaaagtcaaatacaaattttgtaacctgctgttttggattctgtctatcgccatgccattcaattattgttgcagggcagatgctgactgattatatgtaatctttcagagtacattcttcacctacgtccagcctaaccctgcatgaaaattgctcagtgtcttccattttcttcttctctcctgcatgcttctcaccacaggttccatgtactaaaatggttaactgcttttgggacttacctttggaagacttcaagaaaactcttggcacaacaggaacaggacttctcagaatgttttagtcaacctcatctggttgcctctatttgtaaattacctaaatctagagagatcagcctaaggctttcactccaaccaatacacacaactagtctacctacttctcaaacctgttcctccccgatctctcccatctccatgaatggcacccctatccacccagttactcaggtgagctctgaggcaaccttctatgcctttgtctgacatactaaatccaattcatcttgtgaccacaacctccaaaacttatcctcaaactgacctcttattaccatctctactgacaccatcctgctctaaaccatcatcatctctcaactggaccactgtaacaatctcctgcctctactctccacgcggtcaccaaagtgggcctcctaaaagcgcaaatcagaacaagttattttcctagttcaaactgtctaatggcttcccatcaacattcatataaagtcccaactccttaccagagcctgtaaaactctgcatgatcaagactgatgtgctcagttcaggctgcaccatgtccctggggagcttttataaactacggatgcccaggccccaccccagaccaattaaatcacaatctctgggggttgggcttgcacaatggcaactttaggttcctcaggtaattctaacgtgcagtcagagtgagaaccactgatctgatcttgcctcacccatccaccttcccctgttcactatgccccattcacactccttcccctcattcactatgccccattcacactccttcccctcattcactatgccccattcacactccttcccctcattcactatgccccattcacactccttcccctcattcactatgccccattcacactccttcccctcattcactatgccccattcacactccttcccctcattcactatgccccattcacactccttcccctcattcactatgccccattcacactccttcccctcattcactatgccccattcacactccttcccctcattcactatgctccattcacactcctggccttcttttttccccctggaatatgccaaactcctgtctgctccacaggttcctttcctttgctgtttcctttgtctaggctgattttttaaaattttaattaaaaaaaaaatacaacctttttagagacagggtcttgctctgttgcataggctggagtacaatcctgtggagtacaggcaggggtacaatcctagctcactaaagctttaaactcttgggttcaacctatcgtcccacctcagcctcccaagatgctgggactacaggtacacatgaccacaatcagctcatatttttatttttgtgtagacacagggtctatgttgcctgtctcaaacttttggccataagcaatcctcctgccacaggcttccaaagtcctgagataattgacatgagccaccatgcctggccaaccaaatttctacatattgttcagctctcagctcaaatgctatctccccaacaagctcttccctatctaaagcatggagtttcacctcctcccttacccattccctatcttcttatcctatttttttcatggcaattatcactatctgatctgacttacatgtttgttttctctcctctactaaacgtaagttccaggaaagaagggactttgatcttcctcatcatttgtatctccaacagagaatagggtaggcggtcaaatattattttttaaataggcaaagagaaacaccacatcatcatttatttaatagacaggaaggctataaacagactcaatagtagcatgtttttcttttttttttttcttttttttttttttgagatggagtctcgctctgtctcccaggctggagtgcagtggtgcagtctcagctcactgcaacctccacctcccgggttcaagtgattctcctatctcagcctcccgagtagcttggattacaggcgtgtgccaccacacctagctaatttttatatttttagtggagacggggtttcaccatgttggccaggctagtctcgaactcctgacctcagtgcttttgttccttgttgtggacctcgacctgagctgctaagaactaggatgctcatcactgcagaggccctttggagatggaggcaggtggacaccaactggaggcaaaggacccaagtgaggagaagaacaactcagagaccacaccaaccagcctctgaatgaccacgtaccctctggtgcaggtctcctggtatccagagctggtgtgaatccgctgtcctgagttatgtgcattaagtgctcatgagtgagatattcatgaaatattcagacattctgtgctgacttccctagcgcaggtccacctgatgcaataatgacaatggacatgtctgctgaggggctctcacagcagagccggagtggtggcaacaggctgcttcctgagggtgctgggttacagggagcaggaagaggggctaggcatgtgactagtatttccttctcatacttaaattgggcagttgccgagccctgactcaggccagagcagagtgcaaagatgaataagagactgaccttaactgtgagagacccccagaagtacaaggccactgccccacctctctgctgcccaccactactgtaaggaaagtaaccatagaggccaggcgcagtggctcactcctgtaatcacagcactttgggaggccgaggtgggtggatcacctgagatcaggagttcaagactggcctggccaatattgtgaaaccctgtctctactaaaaatataaaaattagccaggtgtggtggcgcacacctgtaatggaggctgaggcaggagaatcacttgaacccaggaggtggaggttgcaatgagctgagattgcactccagtctaggcaacagagcaagacgcaacactctatcttaaaaaaaaaaaaaaaaaaaaaaaaaaaaaagaaaggaaagtggccaggtgtggtggctcatgcctataatcccagcactttgggaggctgaggcgggcagatcacgaggtcaggagtttgagaccagcctgaccaacatagtgaaaccctgtctctactaaaaatacaaacattagcagggcatagtggtgcgggcctgtaatcccagctactcaggaggctgaggcaggagaatcgcttgaatccggcaggtggaggttgcagggagctgagatcgagccattgcactccagcctgggcaagagagcgagactccatttcaaaaaaaaaaaaaaaaaagggaagtaaccatagataacacagtgcagacacaaggcagagagctggcaagatgtgaggtcatttacactgatgcacagactctgaagaatatctacccttcaaaccaatgagggctacacatactttctttggtcataggaagctgaatgtataaaaacacaggtgaggtgatgaaccccacaaactccagtttgtgctgcagaactctgcactgtggcttcacacaggcccatcagtgaccagttggcacttgactgtccattgctatttttccctgtttggagcctcacaggaggacgaggagactgggccgcctggagcaggtattctgtgtcccctctcaaggtactacgtcaaggtaccaagcacttatcaccactcaccgccagcatccacatggctccagacagaactgtctttcagagtctgtggcataaggtgccacagtaggtcctaagtataggagtagagttgctggatcatatggtaattctatgtttaacaaaaacaatgaaaagcagtgactcaaataattgtaccccgatgttcatagcagcattattcacagtagccaaaaggtggaagtagcccaggggtatactgacagatgaaggaacaaaatgtggtctctgaatacaatgtaatgttattcagccttaaaaaagaaataaaattcttttacatgctacaacatgaaccctgaaaacattatactaattagaataaatcagacacaacatgacaaatatttccactaatacaaggtatctagaagacgcaaatgcagagacaggagataaagtttaccggggtgggggtgatgcgagaatagggagttattgcttaacgggtacagagtttatgttggcatgaaaatgtcctggaaatgggtggtggtgatggtcacactaactctgtgaatgccactgaactgtacacttagaaatgattaccatggtaaatttcatgtttgttaccacaataaatataataaatgtatatcagtgagtaaaatgaggagatataagcaaataggctgatatgaaacagaaaacggtaaccttcaagaatggcagcacattcagaaaggatttgaagtattgtaatttaattaaaaaaaattttcccctgtgggttggagagcaagagaaggaagaaagagatatgggaagtctaaggacaagggggagtaatgtactctttagaaaaaccctggcccccactgccatgcaactccatgaagggcagctgaggcaggcccactggctttctccctcagcctctgctgtactttatttttttattttaaaaatcttttttttttctccagagacaggatctcattacattgcccaggctaggaacgaactcctgggctcaatcaatccgcccacctcagctccccaagtagctggggttacaggcgtgagctacctgtgctgtgctttatgcatcaaaggaaactgttctacatccaggagacagagaggaggcctttggtagcaaatacacattcctttaagtttatctgtactgtgcccctttctaaagaagaatttgaggttgcttatcacaagcagccacaaataaggggaaaacacggtgactggatcagggaaaggctgggagcaaacggaggctgacacagcagagggctgactcctccagctagccttgagcatcctggcatcctcagcaaatatgaattatctcctgacagaaaggaggaagcattccggtttcacaagggagacaaggtgtttttggcaacagacgctagaaggatttaggtacacggtacttcatacgtggtgtgaagtgatgtgatgccagtctcctcagccagtttcacacatatgtggatttcatatggtttcttcttatgttaaccttcagttaaaattaaagttgtagaccatttaaagcacaaggtaaagggaactctggggagtgctaagttcacgtaatcttggcactcagtcttcaaagctgtctgataagactgaacaggacccagaagactggatggaatggacctctccctttggccagcagatgcaaaccagccacctgcagccaaagatgtgcttgcatatgggatagggctatggtgtctggcatggccttttttttatttttaaaacagtttttgagttaactgtcaacattttaaaaattgttaaaatttatggctatccttgtaaaatgagaagatctggcaatgcggggcccagcttctcaaccacagccatgtgcagaggggccagccgcagaccccaggactcagcacgcccaacccacagtgctcctctgctctgcccgcctccacccaagtccatggctcctcctgcccttttcctcttttctaaatgcaattttcctcagttggcctcctgataagagctcaataatacacagctcaggttatatttttctaaggagaaccagagccttaggtttttatgttgctgtttggggaaagatccacatatggcaggtcctcaaataacattttgttcaacatcgtctcattataacatagacgaggagggaaacaggtattcccagctggggccactgtctgtgtggagtttgtacattgtcccctccccatggctgtgtggtttatctttgggtattccagtttcccctacaccccaaagctcagcacgttaggttcattggtgtatctaaacagtcccagtcagagagagacagagacagagacaatgaatgtgtgtgccctgcgatgggatggcacctggccggggtgggttcccatccagcaccctgagctcctgggataggcctcagctacctgcgacactgacctggaataaggggttaaataattatctcccttatttttattaatctgccttaaatgtacatatagttcaagtttattcccacatttaatattagaagtgctttgggtctctatttagaaattcactaacgtttcagtgaccacaaatacactacaggaacttaactcttcattatatcaattaaccataaaactggtatcgttacacgtcatttcatttaaagttgcattttccaggaacctatcaacgacgttgaggacttactatactttggaaatctggaaaggaggtaagaggacattcatggctgtgaaaactaagaatcctaatgagccttctggcttagttaaacacacaccagtggacaaagctggttttcttctttcttactcaggatcagctatgcctatgcccagagctgacaccattaactacggcagagttggttcattttgaatcaggtgttaaaagttgcttttttaaacaaacaagccctgtaaaaatcctaactcaaataaagggcagctccaacaggtgagatgttacaaacatctcccctggtccacctgattccaaccaagcagtcccctctttaccagaatgactttgctccaaagtatggtcccagcttccaaaagcacgtgttcctggggatcggtacttgcttcacactagtggttaggtatttgcctagtttggaagccttccatgctgggtctttattaagctttgcctttgatagggcttgggtttgtgtccctacccaaaaaccatcctgaattgtaatcgccaatgttggaggaggggcttgttgggaggtgactggatcatgggggcagacttctcccatgttgttctcatgatagtgagttctcatgagacctggttgtttaaaagtgtgtagcacctcccctttctctctttttcctccttctctggccatgtaagatgtgcttgcttccccttcaccttctgccgtaattgtaagtttcctgaggcctccccagtcatgcttccggtacagcctgtggaactgtgaatcaattaaacctcttttttaaataaattacccaatctcaggtagttctttatagcagtgtgaaaacggactaatacagccttgaaatctcattttccaggaagccttcccagccctttggcactcagccctaaaagttgatgatttcattcattcaacagtgtgtttccagagactcacagtgctgggcatgtcccagagacttacagtgctgggcatggaacatgtgctctacaaacactggatgagattaacatgtaaaataaatggaagactttttataagccaactttttaaagtcccaagtttttgttaatttacttgttaatccagtgtcaaatttaaaacctatcaaatgacattatcacagcctgctaatagggcagaaagctttcaattaagattcccaaggtagaaagctgtcagtgaagttagagacataagtcacagagaattttagccaggctaagaaacagaagcagctgtaggcctgctacgatgtgggctatagcaggactggccattcaccatatccctgccaccttctgagggccagcgcacaccacccacccttcttttctgactgggcacacaccatgcctggtaaagcaattcaaagtgggagaaagacctacagattctttcagcctcaacacagactttctgtaaaggcaagatgttatatcccagggatgtaatagttcagatctcgttgtagctctacggctgaaaccaggagggctgttgctttcttttgagcattcctctgtactctgcatacagcaaggccctctttaattccatcgaggaacaaacacaaaccgaacaaagtaacatagaaaattagaaaacagaatagtcaacttttagggttgaacaccaaagagaagactgaagggtctgggaggaagggagaaagagtatccacagaggttaccccttgctttgtgtcccatgttgcctctgtctacctaagacaagaggacttatgagaacaatgttgtggtagtttaaaaactcctcagtatcacctataatggacaaactgacattaggaacctcccgctgcaacatggtaatgaggaccataacccacatatgttcttgcaaaaaaaaaaaaaaaaaaagctaacctcaagtcttgtaagaaaacaatcagatcatcagattgagggacattctatgataccactaacctgataacactaacctgacgtcctcaaaatggcaatgtcacaagagacaaaacagcaggagggaggatctgttctagattaaaggagagtcaaaagacatgaaaactaaatataatgtgtgagccttgactggatctgggactaaacaaaagcaaccaaagacattaataggacaattggggaaatttgaatatggattgtggactgtcaatgcttcatcagtggtaaaattctcaggtgtgatgaaggtactgtgtttattataggagaaggttccttcttaaaaggtttacacatatgcctttagggggtgaagcatcatggcatctgcaacttttaaatggcttagaaaaaaacgtatacacaaacacaaatgggagcaagagagagaaaaaaatcaaaatgtggcgaaatgttaacaattggttgattaagatgagtggtttatggaggtttgttttaccttttctgtaagtttgaagatttttaaaataaaaagttgagaaaacacatacttcaacattctaggcaagaaggtctcacaaggtctggatatgctgcagtggagatttaacacggagagcgcaagatgactgattctcagtgcagccaccagaactggagagctctcctgtaagtgtgtcttccacatccaaatgatcaccaagtacacaggcacaagttgacagggacaggaggcagagaaattctaggcagaaaagggcaaggtccctggcgaagccccaccctgaagcctataaccatggcccaaagtgagaacatgcaaccttttttccccactgaaatgctgccttttcaaaaatcacccatggcctaccccgccccccatcctatacccataaaaactctgaccccactggcagagagcagagaagggaagaagaggagaagcagctggatgtcagaaactgtggtttgatgtcagagagcagcagcttgacttcagagcgatggcttgacaccgttgcttcggagaggagtctggctggggacagccagaatccaggggaagattaccttcccgttccatcccccttctagctccccttcctgctgagagccacttttattggcaataaaatcctctgtattcaccacccttcaattcttcatacgacctgatttttcctggatgccaaacaagagtttgggtgccatgggcgcagatgctaaagggtgccacactgaccctctgccttcagtggtggagagcaactgcctcacatgaaaaggcagagggcccactgagctgcttaacacttaagctgtccacgaacagcaaagcaaaaagagcactgtaacacatgccctctggggctttgggggtcacagatcctcccccctgagacgctactgtggggccatcacggagttttgctcctgctggtgctcaaaagcacttgttccggcccctgcacacactcacctgtgtgctcctcctcccttgaggggttgagagctgcagcctgagtaagcgaggcacccctgtcacgaggcctgagaaggggtcaagaaaaatttcctatttcaaagtcagggtgggtgacctgagaagcgaaagacgccaccccaccacattctgactatagatctctgtttcttttctcaaagcaatcgaggctgcattttcaggacttctattttagtaaaatcttaccagctggggatttgttttcattttcactgttgtcactttagatttctgacacaatttgtttctgtgaaacaacaaacttggtcataaatatgaagggataaggaagataacctaacatcaactccagggagctgtcctccaggactgcgagcctctactgaccttggtgcccatctaggatcccctgctctgctctgttacgcacccccacataactcctagtcatccacctccagcctcggtggcagaaaagttccgtcagtggtttctgccagaacttttctgccagaaaagttctgtttcacacatatgtgaaaagaagttcaaatctacgtataatcattttacttatttgactattgatcacctgaattggcacagctttaaaataagaatgatacccagttttgaagaggatgagaggaaatctttggggtagagaagggacagcaactgacaatatacaagaaaagacttaatcattcaatacctttgagaagtaatcttgaagaaatagttacaagtatgtttagaggataaattccaaccccttcactgtgcctccatggctctctgtcatcactgaccacagcccagctctcaggcctcacttctgcccactctcccccaggctcactaacctccagtccaaatggccctttcttagtgcctgggtcacctgcggcagctccagatcccctttagataggctgtctcctgcccttgacagcaaacagtggatcctccattagcactcatcccaggccctgtgaccctcatgctaacaggagtgagaggatttccacgccaccaggaggagggggaagatgtggttctggcatccatatgtgatctgcaaaatattttctcatagcagcaatgttcacaatgatggctggggatgcggtaacaacactagcaaggtcccgaagttatttccatgacagattacacaggctttccaaggctggtttcaggagctaacactcctttattataatgctggttttaagaaaaattatgtcatgaatttcaaataaccaaaaccaaatcaaccttaaaagacatggtctatttagaaaataaagactgtttatgctattaatagaagagaagttcatgaatcccaagaattgtgggagctcattttgagtaaatgctgtagattaatgcctttccatttccatcttataccccaagtctcttttggggactgaaaagttatggaacagcagaatttggggaaaatattccaaagtaacacaaactgaagtagaacaataacctttcctgctctcaaccctggttactctaaggaagattctggaatgacttcagggggttctcctcagtcacttagctctgctaccatttgcagacaggtcttatttgaccaggctcagatccctaggagaaaacacacagtcaccccagagagtgctccagtgaatcaatgttcaaactgttaactggttctcagggatgatccctattgtgaccctctccagagaaattaagttgcccacataaagaaaagaaaaaggtaacaaagggcttggcctgttacatgaactagttagagtacaactttcagtccggtctaaccctttcagtctgtggactagaggatcactgactatctagccacctcattcctagcaaaaagtgagtattctccagacagcttgccttacctgtgtaaacacatttctccaggtctgcaaaaactgtttttggcagaggcagggctgcctttccctgccccgaccctctctcctcactctgagtggctgcttgacacttgtaaacattttttcctgaagccattaagcctcatcagccagtaagccaggagaatctggctttagcatcaaacatatttcacagtcacaaccgcaccaaaaaaccaggtttcatgtggaaattcttccttggttgtcctccaaaacctattcacacagaggaaaaatctaagtgatcacaccagaaagcaaggtattctatgcataggacaccttgcgggtataagagtagatttcaaccctaagggtataaacctcaaccctcagggtataatggtttgatatttcaaccttgagggtataatagtttgatattgctaaattccagaaaaataaaaatttctcacccaaaatcagaagagatctcaaaataacagaatgcttcactggctgtgcaaaggcccataccatcagggattttgtttgttttggaaacagttgctccagaaaagcactgctgttgcgttaacagaggtggggaaaatggtccacaggaaaggacagcaaacatgctgtaacatgcaggatgcaatgagtctgtgtgcacacatctgtgctctgctctattgcaatacccagaatcattgggtccaagagtgttgtttctattttaatatgaagggccgcaaaatctgattgcaaatgcttcactattaagccaggtgcttgtgatcacacagctgctccctaattcccccatcagccctagagacctcaaaggactgcagtaagcaaatgacatcaaccactggcatgtcttcctgtttaaaccgaggagtatcaaaggaaagccatctatagaaacacaggcggcaacaacaaaaacaacttcttggctgtgtggccttggacaagtgacttaccctctccaaacttcattatcctgattttacagatgaagagacctccagggcatccttccaggttggggattaaacatgagggatgcatgtaaatgcttgacacagggtaagtgagcaaagcatgttagttggtatacccaccctctcttttaacggcgagcctttgccagatggaggacataaaaattctaagcaataactcctaccttggctttgtccacttaattacctttattttctgaacaatgtgtgacgaggtttgataagaggtaatttttttaaaaaaaacatgcagtgtgacagaggctggcacctttctcctttatttgactgcttagtaagtcaaagcactttttaattggatcgtttattcctccaggcttggaagacagtgtccaggaaccagcctactgaaggggcagctggactctgatgggtggttatgaaaacaaaagaaaagtgctttttgatgaagctgataggctggacttagtcctgttatctttggagatcggcaaatacactgcagcaaattctgcagctcaagaaaacctctgggttgctaatgcaggtttgcaaatatagcaactataatgaaatggctacttttaaatgatttcctataatggtgcttacatatggaagcttttttcctgttgaaaaaatttaattggaaaatggcgaaggaataagaagagggagacagccagttccgatgaacaaacacactgacggcactgtgtgagcagctttaatgaactcctccttgttgtgcccaagtgtttgtcctcctgggggatctggcagagctgcccctgcccggtgcaccctcctcctcatgggctccgaccccactcagttcccagattcctgctcggctgtgacctctggcaagcattcttccatgctcctccccgaggttatcaccagggccactgcaggcctgctatggagtcctaactgcactgtgaggtcttccctgtggacctgtctgcatcctccaaacaactgtgagctttgggatggggttctttcactgctgctcaagtatttgagtatctcctacgtgcaggaactgctatgctggtaaattaggcaggtgaagtccctgcccgcgtggagcctgcactctggcatgacagccagataaagcttgataacacacaaggaaatgagcacaaacacaatccatcctcagggagtgctccatgttatgaaagaaaatgaagcagggaaagggaagcaagtggctgcctgagagtgagggatgaggcatgactctagaggggagggcggggggccttggtggagacagctgccgaggaaggagggctccaggcggaaggaacagccagcacagagccccgggcaggagaagcagctcaggctggaggaacagcaagccaggaggccagagtggctgcagctggaagaaaaacaggacaaatggccaaggaggcggccagaagcagggaccgccctgttggctgcgtgctgaggaagctagaagtcactctaggcttgaaggatttgagggtgggagcacaatgacctgacagcagattctgtctttcatccccagtacctagcacagccccaagtgagtttgctgactaaatgaaaaaaaaaaagcttctatgtgtgggcagagaacatgtgtcaacactgggcagggaaggtcactcccctccaggaactcagtcttctcaggaaagaggctaccaccagttataattaacccatgtatttttaaatgagggacggaatgaaaagaatggtttgggaaaatgaggatgccccatggcgcagataggtggacactgccttctgtgtgaggaccagtgcaacagacgccacctcaagtcaggaggtccaagaagccccacaggaaagacatccatgtaaatgtgtttatccttgcacttcccaaacttatttaattatggaactttgttggagtacaggtcatttattaattccataaaatacaatttgagagaagtgaatggcgggatcagtatagggctcacattctacaatgataagcaatttctaggctgtttaaatctgtctggctaaggcagaagacagagtcctgaagcttggggctgccagggttagagatttatgatgcccttatgaacttagcatgttggtatgaacttagcatgctggtatgaacttggcatatgcatggtctggttgcagggagttgtgtgtattgtaacataaagcccggggactgggttcagtttagttgggggaagtgtcttcactcctcaacataattctgcctggcttaagctgtaccaacatacagctctcaatggctttgatgtattttatttggccttagatgcaatccagactactgatcgctccttccttattagagcctcctctgccccactggcttccagaataccactctcctcattttattccttcatctttggctggctgactggtggattggtttattacctcattcattcattcccactactatctttaaacacatgttatgtgccaggccctgtgataatctctgaagatatactaggagatgaaacaaacatgcttccgcctagtggaatttagtgggagaatcagtcaagcaaataaatactattacataatttaaaatgtcaacgtgatagtaagatacaaatggggcaatgacagagtcaacagttatcatctgcaaacaccctgatgtctcccagctgcttttcttcagcccaggtctctcctcttggtgttttatctgaatgcctactgccttctgaagcacctccgctcaaatacttcaagacactataaacccatgggcaaacaaaacacgatctccacctatcatatagttcctgccccaagcaaaacaaaactcaaagcaaaaccacctggtcctacttcctatgtgccctattggcgaatggccctgttatccatctgttgtacaaacaaactcttatggggcatacacaccccccaccttcaatcggtttccaatccttcagcaaatcttgccaattttacatctttattaaatctcagctgccaccaccctaatctgagcaacaattttgcccatctagagttctgcaatagtttccaagctagcctccccaactcattcttcatctatggattctttctccacactacagtgattgattcaaaatgcaaatctgattatctcattctcttcccccactattaaaaaatctttcagtagcttcttgtggatctttgggtaaaggccaaacatggtctctgtcatggcctgtaagactctgcatggcctagttcctgcctacctctccagtccccctctcacacctctgtgtcctccatccatgaggatcttcagtcacctccttaaatgcattcctctccctcactggatgctattctcttccttgacctgcttaattcctactgatcctccagctctgaggtcaaacgccttcctagaggaagccttcttgtaaccctagactgaatcaaatttctttggatacactctcatagtactgtgttccataatgttgtagcacttataggattttaattaaacccaaatatgtaatatttgattaaaatccctctccccaacaaaattttaacttccaagaaaaactcattataaaactcaagaaaactgactatatgcaactcttctttctcctggttcttcttccatctctcccatacatgtaaacatgtctgtcctaagatatgctgctcctccctcttttgactccacacccttcaaccacagggatcaccttagctcagataacttcaaagcctcttccctcaacctcgatctctttccaaatatccaggtaggcaagaccagtagttttgtaacattttgactgcaacccagttagaacattcatttggcaacttactgcctacaaggatgcaagaaacaaatttcatgaaacaatactgtcacttgctttcctattagccttcatttaaaaatactttttcatgtaatttcaagacccaacagtaggtcacaccctgcagtttaaaatacatcataccagatatttacacatggatatttctctacaacctcaaacataatatgactatttcccaactcacttctcaacacaacttcctaaggaatatatgatcattctcttagtcacttaggaacaacacattggagtcattttggattcctccttcttgcccaatccaagtagttgttaaaacctattgggattcttccactgcaatgtgttggcccccatcccatcccttcccttcccaccatcatagttcagatattactgtaatttggaatactgcaatagccttttaaactggttccctacttccagaattttcaaatagaagtgacttatgtttgaatcacaattgtatcagagcagaaagcttcagttccattttgaccaacaaagtaatgtgtaagggactgaaatacatgtgacttcatccactcagcaaaccccttgaaaaattaaattttaattcaggctgcctcacatttctaaaatttctattacaatccagaaaccaaactctggcttggtggcaagggcaggcagactcacccatgtcagcagtaaccatggtagactggttttcggggatagagacagaggtctggtcttggtccatgcttcgagagtcctcgttgacctcgtgttggctctggctgagttctgatcgcagttctgagtactcatcttcctccctgagaaaaaaggagaattggcaaccactaacagaggatataagacaaccccctagagaatatgtcttttaaggacaagaaaaagacattgagagagaaaacagatttctcccccaggccacagggaccaggatttctcccaggcgaaatagatagtcacatctatgctcagtgagtgaagctgaaaggttgcctctgtgtccacaaaacatacccatgtaccaaacgagattcatctatcagcctgcagaaactcttcccctttaaagattcctgaagaaactagatttcttcgcctcctcaaattccgaggagaataagaactaaggctactagcactgaggctgctgtgaaccaaataactaagagtctagcgcacagcaacagcatgccctacaatctggaggggcccacaggggcttccttcttgaaggaggctggaggttggagatggggttagagctattgggaaaccagcacctcatctgtgcagatcaaactagacttttttgaaaggtatatggatcagcatgtataagaaagactaggctaacttcccaaagaaagtaggtagaactagggggtaggaagagaggatgcaatgaggagaaaacagaacactgaatgagagaacaccattcaatggtctatttcctttaatttacacttgctaacaggaagacaacatttaaaccccactgtgttttatttgtatacacacatctacctcttctcagcccttcagaggtccctcaacctctggtctcttcactgtactattagcaagctgagaaacttagaattgcagtgtgtatttcagagcacgtgtactgtccccttcccacaccaccaccatcaccacacatacactggacacaggtatggagacagcaaaatgaaccgtctttgaaggatctattttgcaagtgaaccagtagggggaactgtcaggggatttaactgggagtggaatgcccacttgggtctgctcagcttcaagggcaggttgtctgtgaagaaagctaggaatcagagaaatctcagcctggcattcattttaagttgtcaacaaccagaggagaagaaagtctacagtgttggattctgggtggaccaaaatgatgagtggcgatcattagggtttagggaggcaagcgggagacacatctataaatcagagaaatgtgaagaacagaaatcttggttctcttaagatatcaaatttctcccaggaaagggattcagctgagcccgtgctttataaggtattgttaataaaacctacccagaaaactgggaaagctttatgtagatataaagccccatgacatggaaaatatgaattagagagtggtgaagacaaaaaatacaggctaatgttctatgaataagttaattattagacatctgcaaaagtcaacaataattaggtttaggaaagaaaatgattaaaaagcactcttaagtgcctttttggtctacaggatgattgtgcactgatagatacattagctctcctttcagtcagcacttaaaattctgattttagttaagggagattttgtgtatgatgaataaattacctttgttgcatggccaacgtaatcagctttggctcagccgagacttttttgcagccaagaaagcaagtgataaatgctgctgctgtttctttggtataaatggcatttgtaaaatctttaatagccaccttaaacctggcttggcagattcgaaaacatatatttcctgccaaatctcctgctttgtacaaaattacttctagagattactaggatgaactttataaagcagtgaattgggaaagtatgggaaagggaagctgttattgcagaaacattccctactgaggtcagagcacagtctgaaggagaaccataccacattaagcagtaggttttctgtgtcacaaaatgcaaactaaaaattcccattcaatgtatttgagcaccaaaacaaagataggaacacaaagactgcacagattctgtcttcaaggagacaaagatgttcacaagaaggatgctgtgggtgaacactggtggaatatctggggctgccagtggggagtgaccaaagaagacctcctgggtggagcagcgctcaagatcagttaggacctaatttcagttacgtcacaagtgtggaatagcacaggcaaaggctcagaggagctgggaacgtgcagaacttggaggggagcaagtggttcactatgactgaaaccaaaatatggcacaggatggaaacatgaggctggagaggcactcatactacttgttgactaggcagtgtgagcaaaaggaaaatatattgcaccggaggatgcaaataatcagggttagatggaagaaataaaaatacaatgtggaaagtctaggaattcagaggaaggagtaaatgttgccaagatcttgtgtggaaacagataaaatgagaagaagagaaatgcattccagctatggtaatcattataagtattctagaacaaaaacgacacatggcaacaaagtaaatagtcatcagaggtggaaagctaccttgcgagaacagggaagattttgtgccacaaagagtgaggtataaaaatgttaaactgagcttaaatattagaaagttcatgcaccctgttgtgtctcccactgactttggtaaaaaaatcatggagctgcatatccttatctctcattggcatcattcctgaaagggggctggaacctgggaccgggaaatgacaaaagcaattctcagagggtcctctgtaaactaactcgatttatgattgcagtatgcgtggcagactgcatcaggagtattgttccatcaagagctatggagtaagtaaaaaacaccaagagtccctggcagttttataaagacaagattttgagttgtgcttctgcagtggctctgcacagcctagaggatgcctggtgaggctaatgacacagcacaacagcatctcaagatgacttctgtttgttgtatatacaggcattcttctcaagcaataacttatttctttggggaaaaaatgcctcccaaaaaaacaccaactgctattgctggtgatgaagaagaggaaaatgtaaaaacatggaaaaaaagtgtccatttaaaaccagaaaaatagcacctctgataaactgataaatgttgaaagtgacactctgtagtggtaggtttataataatggaatgacaaagttctcaggtgtttctccttggaacataaagggtcaactcacaggattccaaatgcatattctttcattcatgtagaagcatctgcgaagtgcttccaagttgctttaagagatgcaaccattaatgtttgctcctagcttaaacaacaacataacaaatgttcctcaggagacaggcattagattgtacacttgcctatgtaatgaccagcagtggcagaaaaatcacaggctggcagactggaagggattttaaagactgttttagccaggaccactacctttattttacaaacaagataaatggggcttcgagaggcaacttacctaagattatgcaaccactagcacagcctaattcctaaatttcataccaatgagacaatatgtacttgacctttgaacaacatgtatttgagctgcatgaatccatttatatgcaaattttctttccataaatatatttgacaattttctggaaatttgtgacaacttgaaaaaaactcagatgaatcgtatagcctagaaatacaaaaacaaactttttttaaggtatgtcataaatgcatgaaatatatacattaggttgatgcaaaagtaattgcagttttgcttttgaaagtaatggaaaaaaccgcaactgctttcacacaacctaatagatactagtctatgtgttaattgactgcttatgttatccgtaaggcttcaagtcaacagtagactattagtagttaagtttttggtgagtcatgagctatgtgtggatttttaactgcacagtgtaggggttggtgccactatccctcatattgttggggttttttaaactcttattttaggttcatgagtacatgtgagggtttgttacgcaggtaaactcgtgtcttggggggtttgttgtacagattatttcatcacccagcccaatacccaatggttatattttctgttcctctccctcctcccaccatccacccgcaagtaggccccaatgtctgttgttcccctctttgtgtccatttgttatcatttagctcccacacacagtattcagttttctactcctgcattagtttgctaaggttaatagcctctggctccatccatcttcccacaagacatgagcttgtattttttatggctgcatagtattccatggtatatacgtaccacattttctttatctaatctgtcactgatgggcatttaggttgattccatgtctttgctattgtgaacagtgctgcaatgaacgtttgcatgcatgtgtctttatagtagaatgctttatgttcctcttggtatatacccagtaatgtgattgccgggctgaatgctagttctgcttttagctctttgaggaattgccatactgtttcccacaatgactgaactcatttacactcccaccaacagtgtgtaagtattcccttttctctgcaacctcaccagcatctgttattttttgactttttaatagtagccattctgactggtgtgagatggtgtgtcactgtggttttgatttccatttctctaatgagcagcaatattgagctttttttcatatgcttgttggctgcatgtatatcttttgaaaaatgtctgttcatgtcctttgcccgccttttaatggggttgtttttctcttgtaaatttgtttaagttccttatagatgctggaaagacctttgtttgatgcatagtttgcaaatattttctcccattgtgtaagttgtctgtttactctgttgatagtttcttttgctatgcagaagctcttaagcttcattagaacccatttgtcaatttttgctttgttgctattgcttttggtgtctttgtcatgaaatccttgcccttgcctccatgcagaatgaaattgcctaggttgtctcccataatcctcacattgtttgagggtcaactgtaatgtcatgactgaaggaaaagatatttcattgtttattaaagattccttctcattattggttaggggtaaaataatttaatcagaagagggaaaagtcaatggaagtataattcttactatgctatctagacttcaagctgaaagtactatggagtcaacagcatttgatagactgtcatgtcactaactatccacattatctatctcattttgggtgcacattcatgccttccattggattggaatgatttgtggagaagagccagatggtcatctgcctgctttgacagctgtcaagctgtcagtcagctgtggccaactaatccaccctacttgacctggtgttttttgggcgaactgcattctttcttaaattaagagtagacttgcctttaaatggctggctttcttttaaagaacaaagttttttgttttttgttttaaagctattggaaggaaatgtattccttttagttctctgaaagaatctattacatacaggaaataagtgatgaataaagtcctcgttctttcttcaatactatctcctcttattttttcagatagcatagagaagatcagactcatctatgaatcttttggtgaataattgaacaaatgggattttgaaatgctctcctatgaatataacaatccatttttgtcttaacaagagctcatataagatccatattcaagaacttccaaatattaaaaaagagattgatacagaccacacaggaaaacagggagagagaaacactcttctttctgggttttatttttatttcattgcattatactttttagactgtaaattaatcagaacaacatgttttgctggcagacaaggaggttttggttacagtttttgaaatgcaacaacatgaagatgaacagatgcctgtgtgttttgttggctgcatgtataccaagatgtacgtgataccaacaacacacaggtaactgtgtgcccaaagatcaggagaaacatcaagctcctagtgcaggcctgaaatcttagtggtcagattatattacagtagatagagactctgggatgttttctctctctgtcctcaaatgagggggcattttgtagcagacccagtaagcagaagggttgagtgccaatcctgagatcacagagataggaggggtctgtgccttggggctgctgctgtatgaggttaaaggtgtgagagagagagtttaggataggagcccaggctgaggacaaacttggtggagggaagagaagatcaactgtctgcagggtcctagaggtttaagaagagtgccgtcaggaaggaaagagggcctagggtcaaatgccatagaaagagaccaatgacaaaaaaagtcactggatttttcatttaagaaatcattggtgattttcaagaaaggtgtttcagtcagctcaggctgccatgaaaagataccatagacagggtggcttaaacaacagaaatttattttctcacagttctggagcctagatcctccaagatcaaggtccagcatggctgctttctggtgagggctcttcctggcttccagatggctgacttttccctgtgtccccatatggctgggaggaagagaatatacatgcaagccgtcttatgtctcttcttaaaaggcaatacaccaaaaaacaaccccatcaaaaagtgggcaaaggatatgaacagacacttttcaaaagaagacatttatgcagccaacaaacatttgaaagaaagctcatcatcactggtcattaaagaaatgcaaatcaaaaacacaacaagatactatctcacaccagttagaatggcgatcattaaaaaggcaggaaacaacagatgctggagaggatgtggagaaataggaacacttttacactgttggtgggagtctaaattacttcaaccattgtggaagacagtgtgccaattcctcaaggatctagaaccagaaataccatttgacccagcaatcccattactgggtatatacccaaaggattataaatcattctgctataaagacacatgcacatgtatgtttattgtggcactattcagaatagcaaacacttagaaccaacccaaatgcccatcaaggatagactggataaaaaaaatgtggcacatatataccatggaatactatgcatccataaaaaagaattgagttcatgtcctttgcagggacatggatgaagctggaaaccatcattctcagcaaactaatacaggaacagaaaaccaagcaccacatgttctcacttataagtggaagttaaacaatgagaacatatgggcacagggaggggaacatcacacactggggcctgtctggggatgggggcaaggtgaaagacagcattaggagaaatacctaatgtagataatgggtccagcaaaccaccatggcacatgtatacctatgtaacaaacctgcacgttctgcagatgtatcccagaacttaggtataattaaaaaaaatgaaaaaaaggcaatataccttcttgagagcctgctatggtttgaatgattgtcccctccaactctcatgtagaaatttcacccccaatattggagatggagtctagtgggaggtgtctgggtcatgggagtggatccctcaagagattattgcccttccttgtgggtgagtgagttctcactctattagttccttggagagcgagttgttgaaagagcctggcacatcatccctctcaggccatgtgatctctgcacagccggctccccttccccttctgccatgagtagaagcagcctgaagccctcaccagaagcagatgccagtgccatgcttcttgtacagcctgcagaactgtgagccaaataaacctcttctatttataaattacccagcctcagattcctttctagtaacacaaagggactaagacagggccccactcttctgacttcatctaaccctgattctctcccaaaggcctcatctccaaataccatcacaataggggctagggcttcaatatatgaatttgggtagggggaaccacagttcagttcatagcaagagggttttggtaaactgttggagtcagatgccacacagcagcagtgagctaacgagcaaaggggagatgaagcagagaacatgaacaactcatgagacttggtagtgagaggctgatgttatgagagtagcttatagaaaagaaaataacctccttgggaaagaaaagatctcatgtttaatttgcttagaaatccttttttattttcttttcacatccagtgagctactgatatatttttccatttcccccatcccactatataatctccccaagtcaggtgaacatttaaaaaaagccacccataacagttaagagaaagagcacatattacaaaacagtgcgtgttatatgatcagatttgtttaaaatattcatgaatacaatttttcagaaggccttatgtataaagtgtttagtgtttaatcctaggagataggatttaggatacattaggcagggttcagttaggaaaacaaactgcactgcatgtttcaagtagaaaggatttaacttagttccatgcctgcaaaattgctgaaagggctgcagaaaagagaggtgagtaaaggccaccaagagctgtcagatttgccatcgtggctgtgatcccctcagagatcaggaactgctactgactttgcaccaccacagcctgagggagaaaggttcccacctccctctgccttccaaacccatgtgagtgcatttcatcggcagagttaaaactctatccagaacccagctggtaagagaatctgagaggtagttcccaggccctctttgattctggggagaatagaggggtgggaatggtatcaagtgccagacaacagctatcatagtctccaccctctttagctactcagtgaccaaccatatgcaccctcttatccataccacaatttctaaatcgcaatagcaatgatactaaccttctctgtagtcattccttgattcaatttaaataggttcaacttttgaaaatgagagatccaaagtaccatgatttatagtgtgggatataagcgtttttttaaataacgattaattttttattttctaatttataatttttttcttttgagttttctattaactggaactttacaaggattcaatttccttaaaattttaaacattattcctaacaatagtattgtaaagtgatcttcattcttccagttcaatgacaaacccacctagatatcatgtaacctacctattaaattatgagtttcaccagtaccaactcaccctatatgaaataataggagaaaataagaggaaaaagaaaagtgcatatgtgtgtgtgtgtgtatatatatacatacatatatatatacatacatacatatatatatacacacatacatatatatatatatatacacacacacacacacacacacacacacacacacatacatatatatatacaagcaagaaaatatgcacagcctagccatcttttctgcaactggtcatgaggctatagctgatatttataacttccctccactgggaaatccatattttatttgtttggctagcatctcagctggttagaattagttctttacttaatgaagtaatccaaaatctttattcctcaagggcctagcccttagtggactgacttgtatttggcctgacttgtattgggttgttctaatctgctaacttttaccactggataattactggaaggtatcctagggattcccatgtgtttcagacatagtactcagtgtcccaatttcctcttgatagttactccagccagtagagtaactcccttctttgcttgttggctcagtggcatggggtgtcccaaagggctaaacaggtggcagtcaatggaatcatttttgtattctctgatggagaactccctaagatttcaaactagcagagctcaaagttgcaaaaataagaatctataactttcttttttttttgtttttactgataccggatagatacgtattttcagggtacctgtgacattttcatacatttataatgtgtaataatcaagtcaggataactgggatatccatcaccttcaacatgtatcttttctttatgctgggaacattcaaattattctctagtagctactttgaattataaaatattatagtcactctattgaattatcaaacactaggtcttacttcttctatctacctatatttttgtacccattattcaacctctcttcatccccctctcctccctacccttcccagcctctaataaccaccaaaatactctctatcttcatgagatccacttccttagctcccacatgagtaagaacatgcgatatttgtctttttgtgctttctggcttttttcatgtaacatagcaacctccagttccattcatgttgctgtgacaggatttcattctttttttttttatagctgataatattctattgtgtgtatcttcatctattcatctgttgataggcactgatattgatttcaaattttggccattgtgaagtgctgcaataaacaagagaatgcaggtatctcttcaatatattgatgtcttttcttttggatatatacccagtaagggaattactggatcatatggtagttctattttgagttttttgaggaattttcatactgtcttacatagcagttgtagtaatttacatttctgccaagagtgtatgagacttcctctttcttacatatccttgccagcatccattattccctatgctttggtagaagccattttaactggggagagagaatatctcattgtgattttgaatactttttcatttacctgttggccatttgtacgtcttcttttgagcaatgtctattcagatctttcgctaatcttttgctaaaaaaaatcagatttgttttttgtgctactgagttccttatattccttgccaatggacagtgtgcaaatattgtctcccattctgtagtttgtcttttcactttcattatttccattgctgtgtggaagctttttagtttgatgtaatcccatttgtatagttttgctatcattgcctatgcttttgaggtcttactaaaaattctttgcccagactcaatgtcctagtgcatttccttaatgttttctctgagtagtttgatagttcaggtcttatgtctaggttttaatctgctctgatttttgtatatggcgagagattggtgtctggtttcattcttctgcatatggatatccacttttcccagcaccatttattgaagagactgttctttcccccattgtatgttcttggtacctctgtcaaaaatgagatgactgtagatgagtagatttatttctggattctctattatgtttcattgctctatgtgtctgcttttgtgccagtactatgctgttttggttgccacagctttgtagcataatttgaactcaagtagtgtgatccctccagctttgttctttttgctcaggattggctttggctatttgggctttttttttttttttttttttttgtagttctataaacattgtaggattttttttttcttctatttctgtgaagcatgacattggtattttgatagggattacattgactctatagatcactttgggtagtattaacattttaacccatttgtgctggagcctgaaatttttttgtgtgtgaaaaatcagacgttggtgatgaccttgagcagtaggatataaataactcccacaagcttagcgttccagtaatggaacactaggcataaatagattaacaatattaattcttccaatccataagcatggggatctttccacttgtttgcatcctctccagtttctttagagagaattttgtaattttccttgtagagaacttttacttcttttttttttttttttaaacagagtctcgctctgtctcccagcctggagtgcagtggcccgatctcagctcactacaacctccgcctcccgggttcaagcaattctcctgcctcagcctcctgagtagctgactacaggcgtctgccaccacacctggctaatttttgtatttttagtggagacggggtttcaccatattgcccaggctggtcttgaactcctgaccttatgatccgcccacctcggcctcccaagttgctgggattacaggcgtgagccactgtgcccagtcggtcttttacttctttggttaaatttattcttaggggccgggcacagtggctcacacctgtaatcccagcactttgggaggccgaggcgggtggatcacaaggtcaggagatcgagaccagcctggctaacgtggtgaaacaccgtctctactaaaaatacaaaaaaaaaaattagccgggtgtggtggtgggagcctgtagtcccagctactcgggaggctgaggcaggagaatggcgtgaacctgggaggtggagcttgaagtgaaccgagatcgtgccactgcactccagcctgggtgacagagtgagactctgtctcaaaaaaaaaaaaaaaaaaaattattcttaggtattttataatttttgtagctattgtaaataggattgctttcttgattttgtgttcagattcttcactgttggcatatataaatgctattaaaacccacctagatacgtaacctacctactaaattatgagtttcaccaataccaactcatcctatataaaatgataggagaggctggacgtggtggctcacacctgtaatcccagcactttgggaggccaaggtgagcagatcacctgaggccaggagttcgagaacatcctggccaatatggtgaaaccccatctctactaaaaacacaaaaaagtaggcgggcatggtggtgcatacctgtaatcctagctactcaggagggggaggcacgagaatcacttgaactcaggaggcagaggttgcagtgagcccagattgcgccactgcactccagcccaggcaacaaagcaacactctgtctcaaaaataaataaataaataaaaattaagtaggagaaagtaagaggaaaaagggacatgcatatatacataaaagcaagaatatatgcatagcgtagccattgcttctgattacaggctatagctggttacaggctacagttgatatttactccttccttctcctactaggaaatccttattttctttagctagcatctcagctggttagaattctttatttaatgaagtaatcaacaatctctactcctgaagaagtctgcttttagacctagtgatgtaaacagagatctgaaataagaaaatataaataaaaatagacctactgatggtacagctcatgggtgcaagacatcttctgataagattcatacatgcattgatattcctataggtagaattacttggttgaggactttgagtaatcgtagctctcctggtttaggagctgctgtaagaattatataagaatcaaaatttatttatttatttattttttacctgctaggagtgcaagcaaggaatcaaaatttaaacctttttagatctaaaatttagatttttgtagctattgtaaatggaattgacttatttgattctctgattgttattggtgcatagagatgctaaaatgattttaacgtgttgattttgtatcctgtaactttactgaatgtatcagttctagaagttttttgttggagtatttaggggtttctatatataagatcatatcatctgtgaacaggataattctgcgaacaaggtgaatttgacttcttcctttccaatttggatgccctttatttctttctttcctaattgctctagccaggacttcctgttttacgttgggtaacagtgatgaaagtgggcatccctgtcttattccagtctttagaggaaaggccttcagtttttcccccttcactatgatattagccatgggtttgtcataggttgcctttattttgagatatgtgtattagtctgttctcacactgctataaagaacttccctgagactgggtaacttataaaggaaagaggtttaattgattcacagttcagcatggctggagaggcctcagaaaacttataatcatggtggaaggggaagcaggcaccttctcaaggcagcaggatagagtgtaagcatgtgcaggaggaactgtcaaccacatagaaaaccatcagatcttgtcagaattcgttcttatgctatcataagaatagaatggaagaaaccagtcacctccctccctcaatatgtgggtattacaattcaagatgagatttgggtgggacacagagccaaaccatatcaatatgttccttttgtatccattttagggtttttatcataaagggatggttatcaaatgcttttctgtcatctactgaaatcatcatgttttttccttgattctgttaatgtggtatattgtgtttatttatttgcatatgttgaatggtatttgcatccctatggtgaatcccactcgatcatggtgaatgacctttttattgtgctgttgcatttggtttgctagtattttgttgaggatttttacctctattttcattagtgatattagcctgaaactggtgcttttgttgttgttgttgttatgcccctgtctgcgtttggtatcagggtaacagaagcaacaactttttaagtggatttttaggtgtattcataagaagggccacttccattctctcaatccacaaaacacagcaccatatactgttgctagttcggagcatttaccacatctctagggcattgaaaaaggttacctctcagatggtgccatcactaggtccactatgatttggattgagtccataatgcgacttaccacctgactttcagcaacctgcattgtctgattcttggctacattaccctgtagctataagggatgggagagtcttctagggtagtcacagaaggtcccaggcactaaattgcgtcccaaaattctttttttttttttctctgttacccaggctggagtgcagtggtgcgaccttggctcactgcaacctccacctcctgggttcaagtgattctcctgcctcagcctcccaagtagttgggactataggcacgcaccaccacgcccagctaacttttgtattttttggtagagaggggtgtgttggctaggctgatctcaaactcctgtcctcaagtgatctgcctgcctcagcctcccaaagtgctgggattataggcatgagccaccacgcctggcccacgccaaaattcttatgttgaagccttaacatccaatgtgatggtgtttggagacagggcctttgggaggtaattaggtttagatgaggtcatgagggtggggtcctcatgatgggactggtgccctcatatgaagatacagcagagagcttgcttcctctttctctcttccctccatgtgaggacacagtgagaaggtggccatctgcaagccaggaacagagcctcaatggggaaataattagcttgtgtcttaatcttagacttcccagcccccagaactgtgagaaatacatttctgttgtgtgagccaccttgtctatgatattgtgttatggcagcccaagctgactgatatgccttcctaagtccctgctctgacttgtgaaccacaaatattttgaagctccatgggttatcatcagtttagattcaatgtctagtaatctacctaagaatatggttctctcttttccccactgcacactctcccttataagtacctgccattctctttgaaggggtaaaaggaaagtttactgtactcacttgtggcatgattgatacatcttccccttcatccaggggactctggttctataactggcctgttatccaggtaagggaattggatgaggccatgattattcattgtgatgacaagtaaagtctctgttcaccagaccagagtttgactataatgatctagtaaaactttagtaggctgcccatttatatcagttctagagatctcaagcttagccactacaactatccctagcaggtcaaacttttttgattactattgtgcccttgttgaccaatatagtaaccaagcccacttcgactctgtttgttcagtggtaccaaggaccccattttaaggacattatctcccagtcaacatcgctgattcctcaggcttctaaactttttctagattatactagcaaagttctggcatttcaacataatttaatgcagagtcctttgttgagcctagttttcagttattcaaactggtgaatactagtttgattagtataacatagtaacatactcaatccagaatctcttacaggaaaagtcctatcaataaagtcgtcatcggtccaactgagttcctccctccctggtctagaacccttagttcctaatctcacacatgaattaatatgaacatatgaaaaaaagctcatcatcactggtcattagagaaatgcaaatcaaaaacacaacaaaataccatctcacaccagttagaatggcgatcattaaaaagtcaggaaacaacagatgctggagaggatgtggagaaacagtaatgcttttacactgttggtgggagtgtaaattagttcaaccattgtggaagacagtgtggtgattcctcaaagatctagaactagacataccatttgacctagcaatcccattactgggtatatacccaaaggattataaatcattctactataaagacacatgcaaccttcacctcccaggttcaagcgattctcctgcctcagcctcctgagtagttgggactataggtgtgcaccaccatacaaagacaccaaaagcaacagcaaaaaagcaaaaattgacaagtgggatctaatgaagcttaagagcttctgcatagcaaaagaaactatcaacagagtaaacagacaacttacagaatgggagaaaatatttgcaaactatgcatcaaaggtctatccagcatctctaaggaacatacaataaaacttccccgagttttattaaatgtaaattaatggaatcttacaaatcttctggtgctttacttgtatctttccaagttggattttctacttatctctttgggacatgatgatatttgaccacttttaggcctaaagataaagatgaatgaagtaggaatgggacatgattatatttgccacctcctacctgggatgaaatagttacagagtctccaagcaaaataggacttgctttattagatgaggagggagaattgtttctgtaggagggagagctcagtggaatttgtagtttccaggtatttgaatttatttgaatctacccaaatgtccctgttcaaattctcacgatttcaccttttcctaccaatgcttaatcttcacttaagagatctgacgtggccatgaattcaactcacattagcatctgcaacctgcagtatctgatttttggctacattagcactgtgactgtaagggatgggagtcttttagggcagtcacagaaggtgcctggtgctttgattgtgacctgagatagaaaactatgagattgtcattttctttccttaagcaattcaggatagcttaagtgtggatatatcatagcttatataaactatgcccttaataatgatttttagcttctccaataaattcttaactgaggccagatttaagtgacaccaaagtctacaatggtaccaccactgtgtctgtccagtatgacaagcaattctgtagaccgtgggtatgctagggcagttagagttcatccacggtgcctagttcctactgcatttggcccatcacagcatattaagagctgagactgtgatggttaattttaggtgtcaacttgactggattaaggaatatctgagagaaatgttaaagcgttgtttctagatgtgtgtgtgagggcgcttccagaggagactggtgtgtgagttgttggactcggggaagatccacccttagtgtgtgtgggcaccatccaactggctaggggtctggatagaacaaaaaaggaagagaaaagacaaattcactctccctcttcctggaggtagaatacttttctcctgcccgtggacatcagaactcttcctgcccttggacatcagaactcctggctccgtagcctttggactccaggacctgcacttgcattcccccaggttttcaagcctttggcttggactgagatttacaccatcagcttctctgttctgagcttttcaaacttggactgagtcatgctgccagcatcccaggatctcaagcttgcagtcagcctgttgtgaaacttctcagactccataatcacatgagccaatcttcctaataaatcccctttcatatctttacagatgtctatctgtctctacgttctattggtttctgtctctctggagaaccctgaataattcagaggccaaaccaatttgctggagtgctgagggctggggagatgcctaagcctcaggagctcagaggacaaggagagcctttgtctcattggtctacacgtctaagtgccttccagccttgcagggaatcccctcgaggaggggccagctcatttacataacaaaaactggcagaatttaatatgacatctccacagatgtagtcttcctttaaattaaaggcaccaataaatgtttgtagtcaagaagctcactgcatttcaaagtgaagcagtttggtcattacattcaatttaaacatcttgaaattgagatttctaggtgatgtgtattttttcatattttgtatttttcacaacttactgagcccatttgctttcactttctcaagtgtttaaaagtgcataaaaatcacaaatttgccagtgtcctatgccaggctcctttacatctgctataatcattcttttgggctaaaaattcttctctgctcatgtacttctaacctacaatcactgtgaagaccaatatacaatttaaaagccttgaggttctaaattagaatatgcagtttattgtgtggctccagctcagtgcaaacttttccacaattttgcccagaaaacagatgcccattagtagcctcatcaagaagccccgccattactgtgactcttggtgttggaacaaaatgcatccaaagtttcctctgacttctagaaggagagtttaaagtagctgcctctgaaactgttttaaaattgtggcttgtgtaagcatttggtgaacaaagtgctctttctccaaaaaggtaggtgccagccacttgctgtcctcaggctgttcccggagcatcgccaggaacatgaaaatgctctcatccacggcttagtgtcatttaaagcaaacctctcctctgaggaacagggcagatacaaccaactaatcactgtggcaggagacttagaggccaagtgattaataagtaaggaaggcagaatccctaccagttattgttatgaaaagaaaattcagtaaaagcagagatattctgggttctgacccacctctatcctctcctaattttaactacaaggcagtcactctctttaagctccagctttttcaccagtaaaatgatgggtcaaatctttccccctgccttatgagtccagtaagaggataaatccatgttggtagagcaatttgaggtaagctcaaaatataatcagattatctggaagcctacataatgcttagttataagctacattcataaatctctcaaaatctccaagggagggacacagtttgcatatttagtatcaacccagtgaatcaaagcagcagcagggatgctcgtctctaagatggaaggggctccatttagaactcatgactaaagcatttcactcaacttctgatttcatacccttatcaacaaactgaggaccacaacctccaccttgtctactttccagggctactgtaaggacccaaatcagaacagaataagggaggtaaaagcacatgattaacaaagcaaagagaaatatacacttcaaaagccttagatacaaagaaaacatcattataatctagtttataatctacaaactagaacttcggtcttggagttaaaatagttggggctacttcagctccaagatggagggtttagcagaaggggcagagtaaaagccgaatggagccgcgtacctgatggtggtgccttgcagacggtctatcttcttgttgagctccgcaatgacgctgtggagctctgtgatgcgttcctcatagcgaagtgtcgttcgctcctggacatcctcatgctctctcatgaggtgggactgctcgcactgggaataagggaaaaggacagaagtgctgatgaattcatgcacctacaggtggatgattccaagctttgtggccttaaaccattacaactgccaacactgagtatgccccaaataaaatgtatgtcagctcatcggctggcaatcccaggaaacatatcaatggctaaattttataattcccccagtggatactggagtctttgcctttctagcactccatctctctttgggaaacagtccctttgccattgcacactgtccaagtggggctattcaagtcccccactttcccgtagccaagaaacaggcaagtggtccaagctagatccatcagataccttctgcaggggatttcaatcttgagccaatggatgtaaggttgcatggagttgattcagaaagccttgaagagcatctctcttagttcctgctacctacagctcccttcccaagttcctttatggctgttcagtttccctttttaccaattcacccctcctttgctgaagtttgtcagggtttgtttcagctatttttcaaccaaataatcctaaatggtataataccacttcttatctggatggattatctgcaaatttaatgctttccaatatcattatctcccagactacaagctcctggaaggcaaggactaggtttctcattatttagcctagcaccggcaaatggcctggtttactgtgggtgatctaggagtgttatggaatgaatggatgacgatatatcatcgtcatgaaaactgcttagcagaaatagtgataaaagaggcagaggagcttcccttgctcagcatttgatggactaagaggcagcagagttatagaaacatttctgtagccagagtttaaatcctgaggaacctgttcacctctcacttctctccactgctctcaatcccttccagtcactgtgcatttaatctcatttacataataataaaatactcctcagtgatggaacaagtagcctagcttgcgtccttgtctactacactcggcttcgattaatttcctgtcagcagaggaactttaatttcatcttcaacaaggttttcttagtgccaagagccatatgtgctttccagcgttgcaggttggcatctccagtgagagtaggacttctcacccgctacctcccctgtccctccctaaatcagctaagcttccaatggcataacccagggcagggacaaaaggctttcaacgataaactgaacattatactaagcctaactccatactgaaacagaagtactcaacaaagaagtctgacaaataatctggtatcaatcatggtagggcctgcacctcaacaacagctggatcagtatttatgtaacttcctgggggttaccttggagctccagaaacaagattggaggcaacaaggttgttgaatgctttatcacagccttagagggatactttcaggaaaatactcatgtgaactactactcttagtgacaacctgaaacatcaaataacctccactccaggtcaagcacacaaaaaataagcgggaacaaaggcaaggatcaaggttgaatgaggggcacatctagtggaagctttcctaaacaaagatgctgtaaccagccacagacactctttccatgaagttaggcctttctcatccatgatcctacatacttaaggaaaaggagaagtccacaaaaattacaggatctcaaaggcatttctatcaataaatgaaagagcttcatatttctctggaacaaaccaagaacagaacactgttcctctcagacctgcagcacatctacaaactcttgctgttagcctctgttcccaacctcagagtgtgtgcgtgtgttcatgttgtatgaacatgtacagatgtagtggacactctcatgcaggtcaccagttccagatcttagtgtgactgtaggataaaattctgtctctgacctggatctcatcaatgctgtgactcctatgttcccatgttgcttgttcctcctcttttgttttccatattccgtctagggctacaaattactgtgaaacatttccacttacacactcaatgagctctcactttcccttatttctctactccttcttttttctttgatgtccttacaggtcaacaggccactaccaccacctgggctgacaagaaactacaaagtccaatgaacaatgaagatgttcaagggtttatatagagaaaggcacaccatcaataaaaaccaccaaaagaccacccttcagcatccctactgactgatatcaactgcctaaaagatgtaatcctggccaaccagcagccctcgctgctgctctgcctatggagtggccattcttttgtttctctaataaacttgcttacacacacacacacacacacacacacacacacacacacacacacacaaacacacacacacacacacacaaaagaccctgtggggctgcccaggataccagatggagagggagagcttgctctctggtattgcaccatccttcccctgcctctaactgagaagcctgcctggaggatacctgcatgaacaagaggcaacatgaagcctggtgattcagtcagatggaatagggcttgtagctaaaggaaaaaaagactcaatgtatatttgaagctcaagcactgatttaggagaagtaacaagaatatattagaggaaaaaaacctcctttaactaagggcaaaggtatttagtttacattcctatatttttccgtaagttttaaaaaaatagcatacaatgtagtactataatgtaatacttcctctacacagatcagacatttcttaaatgagactgtgctgggtgctacaggggaggtgattacaacacattttgaaggtaactgtggtcacagcttccagtggactgaaagaatcccagacttctcttctggagaacaaatacccctctgattcctgtttttgccatcaaggcactgaagctgttgcagctgcaatcttctctcctctatgtcttcctcccccagctccctgacctgagtttatatcctcttcaccatttacctaaaaatcttggctggtgccttggtctcagaccctgaaacgcctctgtgaactctagggagcatgaatgttaggccttatgataccaaagagagctaggaaagcccaaagagctctctcttcaacccccagagaggataaaaacagaaaaagagacacaagggggtgtaaaacagggaattcaaagtctctctagcttccaacaagccagctttagcttccaaagtcaattattcagtgataatttacttagcggcctctgggaccaaaggcagtttcttctactacaacttgtaagttagagactattttcttctctctactggacagagacaccccatacaatttcagctgaacaaaataaaaattggtctcaaataatatgctactgcttttttttctgtcattacaggtaattgcatccagggttcttcctcctcccagcccatattcaatttttgactgaaggtacagtaccacaaagccagaaagcctgtggttgcagtgtcttgcctgccataaatttctggaggccattatcattaggagtctagatttgtctcacaactacagactttcagtttgaaaggaaaagaaaaaaatgattgacattggatatgacgaaattttgtttttcccaaatttcatctggtgctaaatacatacccggagtttcttcttgagatctcagctttcctatcatgatgatgaagcaaattaaacatgcatataaatacttgtgtctagccacataaattggtgaaattgcctatatgcaaaaatgtgtaataaaaacaagcaacatcgtcatttcaaccactgagaataaaatcctttaggctcatccctgctatggtgcaatccagggataaagccctgagtcagccttgagacagtctggcctgagaacttgagcccctgttggaaaaaccctgtgcaatgtggtgatgctaagcagctttatggttttgttaatgttcttcaccgggttttatcttactccaccgaggccactgatctttaatcatcgcattagtgtcagctgtcaaacctaagagcattatgaactaggttcttggaaaatgcaatgccatcattaatttgttaaccctctcaaccatcccgtgaagggggttagtaccactctcttttaaaatatgctaacaagagatgttaccctctcaaggtcacacaggatttgtcacaactaacactattcggggtatttccaccctcactctaagttcttgcccaggttcgctcgctaaggggaaagtggaccagctaaacaaagaggcaccagcacaaaaggaaatgccattaaggagcaaaggagctagaggagtttaccaaagagaagcataaacgaataggagaggaatggaatgaggcgaccctaacaaaaatacatgccgactacatctcagaaaagttatctcagaaaacaagagaaaaagaaaaaactctttccatttcacttaaggaaaactgtgtgtgttctcttcctgaatgccaagaggtagaaaattcaggagacttgttttccaaagataaggagcttacgaagtattccacattactgctcacctattttaaaggggttcataagcttgtttgacatatctccttctgaagtacttaaaaatgcagttaatttaaaataattgttggtactaaataaatagcaaatatgctgaaagcatcaaatcaggactatatctgatcttagccagtttcccacaggctcagttcccactgggctgtagaatgttgatgcatgtctgtgcccgtattcaatttgggaagataggagtgtgctgttttcagccagtaagtttatggcaatttattatacagcaatagaaaattaatacagaagcactttgtcttccccatcacattggtattgggctcttcccttcatatcactattttcaaaactctacctacaggtggatgtcatgagcataaataagacaccttcttttattcaaccagttccagtgtcaccattaataattattcaacagatgttgcagctctcttggtaatgtctgttgaacataaccaccatttacattttacattttaatcatggcactataatatttagagagctggtaaaacttaatagagccacacagcgtaagtttacacatgaatttgctcttctacaatctggtaaagcctcaaacatgaatcttttaccaaggcatataacaccaaaagtgcagcacagtcatttcattgttcttatatttttcttgcataaatttcatgtttttaaagatataagtctgacttttttttcatgttctctttcctaggttccagtatatgaactgggaagaaaactccagtgagaagagcagagagtaatttttaaatctattttacataagaatgcaaataagagagtcaataaatggttctatgatgtgaccattatcatcaagggtaaaatcagtcatcaaaagctattacatgaggatggcttgaccacaggtaagtaaaaaaagagctgaatcaatccttgacttagagaaaaaattttccattatcctcttaccatcctctgtaaaagctgtctttgtaggcttaaattttaataaataccttcctggtcactttttaaaatccaagactactgtacatgccagcttccaattaaatgcattcacaattttcttttttaaaacaaattctcatcaataagaattgctaatgatggctggctttgggtgggtataaattagaaaacatagtcaccaccattttgttgttgtttttaaatataaaaataactattttctcttaaaaaaaaaacactgtaaaacaaaaaaagcactgaaaaagtttcagtttggagaccaccactgaaacattctaatgctttccagttttttctatcactattttattacttttataatcagaaggaaaatattttaagtaacattttcatctaagtaaaaactgaaaatttttttatttcagtatgaaataaatactatgaaaatagtattaacatcctatagtgggaaaaggcactggtggccttgctgagctactcatttatctttgggtaatcaagttaatcttcagatgcccgtcaaatgtgaaagtggatgatcttaaatacagagaatcctttccctctactcaagcagtctttgattatgagacatgaaagtttccaaaaattttccataggtcattctggaaagatggctatagcagccatctttccagatattaatttaataccagcctggtattaaaatttctctgaattcccacataaaaataaacaaagcacttacacagtaaagcccaaagcttggagacaaggtgtgccattgaacaacaaaatacaagcaggtaagaacaaaccaacatcatccataagatctgagtggcatcagcttggggagaatcagaggaaaacaaggctgatgtatctgagaactggaaaacccctaaaaaaccaaaaggaattcacaggaaagtaaggatgcccaattggagaatagtagctaaaactaggaggggttttgcctgaccaaagagtcagtgcaaggggcccacaggaagatttgaagaggctaacctaggctagtccctgtgaactttggagactgccctcaggactgccttccaggaagagaaactgctgggagtggaaacaaaattgaacaggatgggaataatagagacaaaggaaagaaaaggtccagataaaagcaggtaaaaggaacagagccagacagtgacagaaagcaggctgccatttttgacaagaaaacaacagaaggctaggttctaaacactttagaaagccattttaaaccctgcctcctgaaagttcaaggaaattatttttcacatgaaaatgaaaaacagaaaaatactgacgtcaaatcccatacaaagttatacaaaacaagggcagaacatccttataaaccataaaagcatgccacaacacagaacaaaaacaaaatcccccaaacaaaaacactccagataatagcctactatttcaaaataaactaaaagacatgagacagaaaagaacgttaggaattagaaaaattcagaagtgagaagagttagaaataaaatgaaaatgcatttcagtaatgatgactacactggaaggcaaaaaagaaaggctaaaaacaacacataataccccaagagaaaaggaaaagaaaaaattaaattaaaaaagatttaaaatatttaagatagtaacagataaagataggcaaagatgatgtaacatacaaatgatagaagtccttgaaaaatcaaagcaaaggaagaaaattaatattaacaagataattaaaaggccaggcacaagggctcatgcctgtaatcccagcactttagaaggccaaggcaagaggatcacttgagctcaggagttcaagatcagcctggacaacatggcgaaaccccatctctacagaaaatacaaaaatttaactggtagtcccagctacttgggaggctgcggtgtgaggaatgcttgagcctgggaagttgaggctgcagtgagtcatgatcgtgccaccgcactccagcttgggtgacagagcaagactctgcctcaagaaaaacaaaaaggtagccattcggaaggaatccctcggtaggcaccttggacttcgtagcttctggaactgtgagaaataagtgttgtttaagccacaaatctatggcatttgttacagcagccagagcagaccaagacagagtatttgctgataaagctgtaatttgttttgtgggaatttctgtactcatgttttatcttaagattaaatatttaaaacaaaaaacaaaagcaaactaaaaacctttccagatcccttacctgtgccttggccaatttcttttccagaaggtcccgttccctctctgtttgctggagacgtttattaagttccactatatctccctttagtgatgccagggctgctgaatggagctgtggtgacagaaaggaggagattagagtattgtagcagagatgtatttccttcccttcattcccgcaactagtataaccaaataaaaagcctatcatccaaaaagcaacacttttgagaatgaaggtaagtgttatgagttttggggacaacaggcataagtcaggtgtgctaccagcaaactgggttatatggtcaccctaaatattatgtgtgggacatgggacctaattttgcatggtataatcaggccagagaacaaaacttctctttccaatggctttccccaagctactcagtgaggatgagcctgacagctgaagtggagctgcctgattctaatcatgagagtcaagaaaatcagaaccatattaattttcaccttcggaaaatatgaaagctgaatagggcaatttggatttctggaatccagtcatctaaattgctgcatatgtgacaggcagacaggcactgagcattaaggggaaaaaagcagcagagctcattttttagatggtctccttgtacagttgacccatttattttcttgttgggtcttccctcctctttgcctccccacttcccccgaaaggctgtactggccagacagatgcttatgtgctagcaggccctctttcaggagcagcaccagaactctgacaaatgacgctgtgaaaagacaaaccaaggatcaactgaggtatctttctgcagccatttctctgggttaactggagttagaaagaatgttcttcaaaagattaacaggaggccccacgtacatccagaatctccatctgttcaacttccaagttctaaagactggactttggctgcacacacacctaccacacatgtgccttctgtgattttcaggccgacggatggaactatttttaagacccgttcaacacactggtcccaaagcaacaccctgaaacgtcctttgaaaccttgaaactttccattccaggtggagctcagaccatcccctcactgaattccatactacatttgggtgaacaactggaattagaacaaaccaacccctggctttataggctttttgtagtctttgccaagaaggatttcaagtaagaagtgagcaaatacatttgatctttaaagatggacacaggacgatggtacgtaactcaactttgaagattctcatttgaggcttagaaaaatgtgcttttctgcaacctgccctccacacacagcatgttggctggcaggcttcagggtgagggtggggtgggtgttgagtgagggagaagcagatataaggcagagtgtggggtttcaaagcagttgtttttgttagactctaatagcagtaaatgtgacttcacttaatcgcatcggagcagcaaaccaacagatcaatagccgatttgaaatcaggaatgcttaaaattaaaaaaagaaaatgtcaggcaatctggcagtatttgtcttctgatgtagggctagggtggcttggaaaaggtcactgtgggtttcagatacaacgttttgtgtgacgacttctcagtacaaataccacagtgttcccgttgtatagtcttgttgagattgttttgtttggtggaaggggaacgaattcactccctttgatggttggttgccccctcagcctttgaactgtcagtctgaggatttttcttcagcatctgacactgtggcatgttacgctattataccaactcttgagaaaggatttgccacctcacctccggcgaaaaggataaaatacgtgagagctgacatgttcttgaagaaattgaggagtggggataaggatcccagctctgttagcctagacttgcttccttcctcattatatctcccctcctacttctgggggaaagggctgcttgaaggggttgggggaggcctggagggaaaagctgagagaatgctgcatgctcccccacagactccatgaactgggccagatggagacacacacagagtacttacttccatcacagacttggaagaggggtccaggatgggtcactatcatgggggagagcaccgggcttagagtgataataccttctggcctaccagctctccagatttccaggaagagctgtcagatgcccaagggggcaggtcccttcacttctctggatggaaggtgcctatgtatgaggtgagaacagattccttgagaatctcatgaatgcaatggacccttctactagggcagagatgagtttgggatgcatgcatattttccacccaattatggtgatgacacactctggaatctatctatgggcccctcaataagaaacatctggacttgatgtcagctctgtgaccccacatcagtttcagagactgtctcatgtgtcatcatcacagatgtctgagtggggaaaagaactttggtactgatgtccccgactccataactgcaggttaggatctggaatccagagactgacttgcttactcaaggtctcacagtcagctgagcaccagggccaaggccacagcactcttttctggctctctggtattgtacatgacagagttttcagtttgttacttggatgaaaattttacttaacatatcttctctgattataaaagtaataaaattgcaacagaaaaataaaccagaaagagcattctcatgttttagtgatgggctttgggtggttttaagctgtttttttgtttgggtactttttgtttaatgagcattttttcctgagttatttctgtattaaagacacaataaaataaagtgactgttttctgcatatgcaggctatagcataaatattgtacagggttattttgcttccttgctgcagtctgtccaccaactcttctgacagaaggaaaacctgtaacaatgaggtagaataaaatatgtctcttactgttactgacaattactccgcagaggctacaactagagagagcagaagttggagtgggggaagccaccaaccagccataagccacactgcctagaattggctgacagaccactccttgacctcctggacggagtaggtgaggagaggagtggacttcccaccacaagtttgagtgctggacactcaatctctgtgcgtttgagttcagtggcactccctgtcccactgcatcatcaactcaagtcatcaaaagctgacataacctcccctcttttggggtttcaccagtctctggcttattggtggcattcctgcaaattcaaaagctagagtgtttgtgagcgatgctacatgaaggaatttgtgtagttgtgtgttggcaagcatgaaaaaattagtttagaggtccctctaggcagttaaaacttttttactgaaatataatatttatacatatttatggggtacatgtgatattttgatgcatgcatacaatgtgtaatgatcaaatcaggatatttaaaataaccatcatcacaaacatttttcatttctttgtgctaggaacatttcaaatctcttctagctattctgaaatatacattattgccagctatagtaaccctactgtgctacagtaggagttatttcttctaactgcatgtttttacccattaaccaacctctctcttcatccctcccccactatcctcacattcttccccacctctggtatctatcattctattctctatctctgtgagatcaacttttttagctcccagtatgagtaagatcatgtgatatttgtctttatgtgcatggcttacttcacttaacataatgacctccagttctgtccacactgctgcaaatgacaggatttcactctttattatggctgaataatattccactgtgcatatgtaccacactctgtatatccattcatctgctgatgcacacttaggtcgattccgtatcttggctattgtaaacagtgctgcgataaacatggggatacaggtgttcctgtaataagccgattttctttgctttgaacaaatacccaagtagtgggattggatcatatggtagttctattttaagggtttttttaggaacctccacactgttttccataatggttgtcctaatttacattcccaccaacagtgtataagagtgcctccgggtgattttttaaaggactaccagtgggtttaaatcttggaaagataaatgtactaaagcaaccaaaattgtcaagtatgtataaatgggaaattatatttatgccaatttttgggatccctttaatcatattctggtttctgaaatggcctctaacttgagagattcagacatatgaactatgaagtatgatgaaaagaaaatgttccatgaaccaaagagaaagaaaatacatgctgtttagagtctgtgctagtgtcttcctcaacacatatttctcttcatactcaggagtcagatgctgatttttagctggtcatatttctgctcagcgaaaatattccagttcccatccttcagtgtagtttgcgctaggtatagccatgtgacaaagttctggccagtgcgatgtaagcagaaatactgtgtgagaggtatgggaaaatctttttgagagggcacatcctttttcctttcatccatccttgctgtttggtatcttatgtgatggatggagctctagcagccatcttgtgctacaaagctgagactctagggagcagaaaggtgcctcagtccctagcaactttgtggagccaccccaccagttttggaccacctaaccccagacttctgttacagaactgcaagaaataaacctctgttatacaaagcgctatgaagttgagagtttctggcaaatgaagctgatctaatcctaattcacagaatcagataaagctgggttcaaatcttatctatgccacttgttggtggactgtctttgcacaatttaatcccttttgttgtagggctgtgtcaagacaaatgatggcatccagaaagtgactagcagggtggctggaaccaggtaagcactcaacaaacgggtttgtttgaagtcaacaaccttctcaggcagaccaagccccatcagaggtgctagggacactcagactaggaaaacagtcctgtcctggagaagcgttatcacctggtagatagcacaggactaagaagccaatagctgcgttgccagattctgctgaaatcctaaggcttaaggagctgacagccagggctcttagttctctgtgaaattttaacatgaggcctaaacgaggttggatagaaccctgacactttgtatacaaatctggatctagtgcatgaaggatatagatccacacattcctcacatttctggagataaaaggccctaattccctaggctgttttgagccctgcttcacattcattttacagtgtgtatccaaacgaaactaaaccacctggacatttggctgcaagctaactgtcaaaatggttatttttggataaaacataacttgagtaaaataatttcactgttcaactgactctaaggacaagccctcttagcctctgagaggaaaggtgtccagcccccctgagcccaggtaagaagtgagcagtgccctcatgacagactctcccaggggtatctcctttgctaagtgaatagatgtctattccgttacatatctgctgtgtgacaaaaggcttcacacttcataaggtgcccttgaactctgcagtccaatgactctgatgagagcccctccaggagtgtcactgcgtatttctggttattaggtgcttctgcattttgctaaccctggcaataaacacagcagacatgcctacactacccagtgcacacaccactctccaggcaccatctcctctgaccttcatcacgccaggactctgtggcctaagggcaagctatgcttcccgatttgctgagggacaactatttttcccatgaaacacagttggtaaaaaggaatacgatttgaataaaatggtggagaacctagattcatctttgtgggacttcagtctgtgctttgaacagcacagtcttcaaagggcccaaaggcacctgcagccacaggtgaggcagaggaatgagttcatccccacaggccctatctagatacatgcacctcatgctgctgaggcacctcatggtgctgagggctgggccagtcttcccggctttgttgggaagtgagttcatctggggtaaactgtgcttgttctctttctccttaacttggtctggctacttgaagtgctagtttaacactcactgccagcgtgcatctattgccttcccactgagtaatgacaggagttacagtggtctcccccttaatggagggaggtctgctccaacacctgcagtggacgcctgaaacctcagttggtactgaactctatatacactgttttttcctatacatacaaagctatgataaagtttaattcatagtcagagattcaaaataattaatagaacagaccaattattaacaatatgccagcactgctactcttatgcttcgggccattatgatgtaaaataaggatgacgtgaacacaagcactgtgatgccatggcatttgatgtgataacccagctggctaatgggtggggagcacagacagtgcagatatgctggacaaaggaaggagcccttccccaggtcggacaaagcagcccagcacgcaaatgcatcagcctactcaaaacagcttgcaatttcaaacctgccaattgtttatttttggaattttccacttaacattttcagactgcagttgactgcaagtaaatgacactatgggtaaggggggactactgtactattctgtctttctagctgagccacttgctttccagatacaaagtatgcacaatttttgcttatgttttagtgatgacaatgggtagtgccaacttctctcatccagtgacaatgggtagtgccaacttctctcattaaaggacacttaatttcactgaacttaatttcattgaatacatatttttggcaggttccgcactgcatgcttcatacactttacctgttccatcagctgcagaggaaaggcagtgtcaaatcccaatgccaaaatctgcgaatattcttgagaattccaggtcaccaggcagtaataatgaaagtaataatattaatagttaccgtttgctgaatatttattggtatcaggggcttgggctaggcacattacatgccatatcttatttaaccatcaccacaatgctgtgagatatatgttattacctccttctggcaaacgaggaaaccaaggcacagaagaggggtagaaaatcagccgaagtgaagaaaactaataaatattaggttggtgcaaaagtaattgcaatggcaaaaactgcaattactttttccaacctaacagtaccggagataataacacacaaggaccctatgctcaaatcttctccactatgtgcatcactggcacctccaactcaacataccacggctctcccttgcccgagggatgcgtaaacctgcttgtgtccatgtatgtgtgtgtggaggggtggatgtggggcgggggtgaggtgtgtgcacaggcagggctgaagacatgggagaagcagggtcagggttttcgtgatggcagcacccatgtgattttgggtgggagcgagaagggtggcagggcaagtcctccaatgctgtgatgaagcgtggggctcagcttggtataaatgtgggtgattctctttgtcctttctgtgcttttttgtcctctgtagaagggtttgtatcggattacctctaagattcttctggttttaaacttgtaacatgcttgcctggcatgttcacctgtccaggcacctgagttctgcactatgggctttgcatactttatttgtccactggtcccagaaaaatctgctgaagctcaaatatttaaggaagcttcactctatacagaactgttcacccaagatcttttccctaaaaatggaatgagttttcagaatcacacatcgtcttaccactggcaagggaatttgagaacatctagtccaattccttcattgtagagaaatgaaactgagactcagagaggttcaaggttcatcaaattcagatttcctggttccctgtccagaggctacctctctcccaatggcaatccaagagctcgtgggtagtcaataaaatatgtatgtcccagctatccttggagacagcaagaaacatctgcacatgaaaaagcctcattcagcttcccatccaagactccacacccaggtgttctaattcagatacatacagaacaaaatgcctggcaaaagggtagtgttccctgctagatggataccatcaggcctgttcagtgacttctaggactggaacattcctctttactaccggaattccagctaggggcacctgctatgtagtatttcaagaaatgctgctcatagtcttgaaagttaaaactcattaaatataatctaaattataaattaaagatgtctcactgcatggaaatcacttttgtgtgccctagatcaactcagaaagcagcagcttttcatctttccttttacctgataatttcattgagaggtcagtggcccctgaattatttcttaaacctcagctgaaattcagttgctcaaaacagcattcaaaggctccttcaacaccgcagcagtgggacaccatttatacaagaaagattaaccctacccaaggatggctgatatagggaacagtgccagatcacaaagcaggcccaggtactcactgtgaaagctgtcatactggtccctaggacccacttaaagccacacctccccttcttcaaataaatggttaggaaatggctcccaagggggagaggtgtctgagactgacaatcagctttaaagatgacccacaatcccatcccatctgtaaacatatgctcccctgaaaatatgtcccatcgtaatttttactggctaacacaactgcttgctatgtgctagattgctatactcagcatataacatgcatttttctcaactattcttcacatagctttatgagatgggtagtgctgttatctccaatttaaagaggtaggaattgagacttagaggttaagtaacttgtcaagctagtaagtaacagagccagaatgaaagcccaggtctgtctaaccccagggtcttgttcataactaccaagtcccctgctttgcaacagaatatcatagcacttctgagatccttgcaaatacccacgaaactgttgagaagaaagatctcagagggttattctgttaagagaagaaagcagaattagcacaattagcatgggggatagacaggtattcattctttaaaactttaaacattttgagaaatagaagaccattcagctggtatcagacccaggaaggaatccgtgaaaaattaatctccagctattcctacattctatgtgggaaagttaaagaggacaaaattgtagtataggtaaaacaagcccttacaaacacctaactttgctgcttaaagactacagaaaaggaaaggttattaccttcaactgatgtgatctttaaaaattaaaaatctaaacagaagaatattttatatattttgtaaaaatttcctatacaaatattgtaagacaatagtagctattaaaaataagttattattttccactaaaaaatcctaacttgtagtaatatttattttcaagggaaacgaaaattatgtggttatacaagggtttttggaaagaaacacagacaaaataaagacactgcactaagctggctgcaccaacttaaatttcaagggggctgcatcctaatgacacatcatggaggagatgaagatgtaacaattaaatccagctaatcaggggacatgaatatttcagtgcacgctaaatactgatgtgattccccaggcggaaactcccacagagaattctatgaacatgaataaaagggttctctgacaaggtctgaattgttcataaatttttatattgatccaatttagcaggtattgaattccccattctagagaaaccaagtacctttagtggtgaaacagtcaataaactccacagatcaggaaaggccaaagtatttttacagcaatggttgaagtgctttgaagagaccctagattttaatggattaaggacaatactttttgtttgggaaagcaaatggaggtttagatttatgtgtgtgtgtgtgtgtgtgtgtgtgtgtgtgtgtgtgtgtgtgtgtgtgtctacacatacccatacacacagacatgcaattaccaacatatacacatacagagtatatataaaactcaaggcacatgcttccagacttctaattaaagtgtaagagttatccaagatgtcagctatttagatattcaatacaatcatttttaaatgcattcccatcttttaaaagatactttaatatgcattatttcatttaaagaaaatcagttttaaaatgcttgatgccacggcatgctccgtttcagggaaggcccaggcaggccctggcttgtcttgcctcaccacagggctgctgacggatgggccatttaccgtttgctggtacatctaatccaaagcaccaggagaggaggagacacatttcaaatctgcttcgtgttccctctctgatggggccctgctgactgcttcagagaacagtgtgtttagatagaaagaaggaatggcttttaggtctgaatcttctttcctttccaatcactctaacccagccaacaatagtcccaactcggatcactttgttcccagaaaatgaagagaatgggaaagagattaggtagaaagaaaacaacatgaaaaaacagtttcatggttaaggacataggctttgtcaaaatgcaaaaacaaaataccctggacttgagtattagttcagctttgggtaactcgtttaacttttctaagcctcagtctactcatctttaaaatgggaacaacacccactcattctagttgagaagattagatgaaatatttcaggcaaatcacttaaccacaacatcagctggcagactgttagccacaagggtcgttgcaatcttcttttttttttccctgagacatggtctcactctgtcacccaggttagaatgcagtggcaagaacacaactcactgcagcctcgaaatcccaggctcaagtcatcttcccacctcagcctctccagtggttgggaccacagtcaggcaccaccacgtccaactaattttgttgttgttgttgtagagatggggtatcaccatgttgcccaggctggtctcaaactcctgggctcaagtgattctcccaccttagcctctcaaagtgctgggattacaagctagagccactgtgccttggtccactgccaccttactgaccacaattatcatatgccaccccttctgcctgctaaaaagtgtcaaaataaaatcaggctttgaaaacagtggtacgttactatcctatctcattttcacaagtcctgattaagcaatcagaatgattcaacacattggagcctagatcacattaatcagagtaatctagagtctgcctttcaacacgtgtaattgaatcagctgctccctgcacccaggctgggccagcaggtaagcaggcaaacacattcatcctaaacagcctggaaactggagtagcctcatgcccgctttgcaccctctgcctcatgggtcctcatatcattcaggtaagagacagtcaagaaccaagcgggacatacataatgaccccaaaatcaatttccataaaaacgcatctcaatagtacaaaagagaggaccaaggaagttattgtaagcaaggacacacacaaaggtcatctattcatgatagaaaaataatcaaaaataataagtttttgaataaattgtgtggcaggaatagaataatcctaagttgtcaccaaaacagagaaatatataattaacttagcaatcattatttcccacatgtatgactcatttcctaagttctttcatgttggtttccaattgtcccccacagatcacctattctcccccatccactttctctttcctccttttttcctgtaacccttagtatgacctgacatcatatcctaacatttttttttgttgactcactgcccccataaaattatgagttccaagaaggcagggatgtcaagaggctggggaaatagctcatgaacaagaagaactgtacctggcacatggtagaatttcacgcagtatttgttgaacgggtaaagttagcaaattagaaaatacagataaaggaacattatccttacctcttcccaccaccactatgagatgatatcacctgcaaatatctgtcagacatttctgtaagtgtaactacacttaagatagtttatgcaaaacaatttttaatatagtattatttttagccaaaatatctaactagaaagaagtccaaaaatacatgtaccaaaatgttaacaacatccccaggtaatctctgtgtagtgtgattacagatgattttctttctcaggtttattgtattttttctataataaacatatattagtattatacaatttttaagtgttttcttgaccctatttacaaagtcttatgaagaatacaaataaataggtaatccttgctctcaacaagctcccagtgtattcagagagataaaccaaggattttccaaatctaggagttggaaagatcattaactgtcctcttatccaacagtccagccagtgccagaatcctgtctacagtgctgcctgcaggtggtcactatgtctatgtgctaaaaagctcggcaactcctcagacagccaagcctgctcactgttggatagctactggcatttgcaaattttaccttacatagcaactctgaaattgcctccttgcaacttgtcccattggtctagttccacaagtaggataaaattagctctcttttatactccaaactctccaagtaactcactctatcagtaagatccttcctaaatcatcaaacctccagaacaatccttgatcgcccaggggcccctaggatgtcaatgttccttttggtaaatggtagccaggaccaagcacagtactccagatgaattctgcctagctcattcttacgtgtcgatcactttacaagagttttcatagaattctcacagtaaaccgagataggtgctacaatgaactcatttcacagataaggaaactgaggcacagtcagttttctagtacttgaaaccacaaacttccaagctgacctgtcacatttaccacgggtatccagggtcacacattttgagatcccatatctggtgtgggctaagggagagagcctgaggactcaagactgcagacttggatggtgctcagcaccagatggtttatagcagtgctgctcaaattggaaaggccattggtaccagagggagtttcagtgggatccccatgcttgctctgacagtgcctggcaccagaggtaagaagctcccctgtataggtaaagggcagc[450 bp omitted]gccagttctcttacaaactgacttattccttttttgtccccttaatttcatgggctaattctgaaattaataaagtatggcaggggtagtggcattactcgctgcagatgggatagctaaggacaatgcaaggtctcctacatcggcactcacctctacccttctgccgttacagggactctgtgacacccttgaaagagaaagcagcaggaagaataaagaggaggccaccatgatgggctgataaaagaaacgtttccttggggtttacgtttattggttgtttctgactttctctaaatggcaggagcacccgacccaatggcaccgtcttccaacctgtaaccacccaaaaaatccatattaggttccagacctaatggtaatagaaacagcttcattgctgagggaggtggggagcttttgggtaatcacaaatagcacacagcttcccagaagtaagacttctttcatcatatatttttgggaatgacacggctttctgcccccaaaacatacattcatttgcaagctaaatttctcctgtgcttattaagaggggtgggagggggcagggaatgaaggctgcatattttcccaagctcatgaagcccagcctaatcattacttcaaacatgccacagcaaaagaagtgacatctaatcctgattttcttgtcatgtctaccattcccccatctccttgtagacatagcactaggatgcaaacagaaaaattccctaaagctgccttattttgtttcctgaaagcagaaaggcagtgagcaaagaaactatgaaagactcctaggctgtttaggaatgatacatttccaacctagataaaaatatcaaaagaaaatctaagtctggcagtgactagaaatactgacatttttacaatacaaaaactaaaatttacccaaactcttaaagttaagccccactactaaagaagtttacactgaccatcattaggcatgggaccaagtacagcggtagaaaaaatgttgagtaagcttttgcctgatatccagatggagtgtcctaagagtcctgcatgagctaccctgtgaggtcaacattctgaaatgctaatcttggaacagcgtgggtgataatacagtttaaatgcaaacatcactctgagatggataaacaggactataagatccgaagactctgagtcttcgtaatagagtttaaatgcaaacatcacttgagatggataaacaggactataagatcccaagactctgtgagtcttcccattaccctcaatacagggcatcatttatttaaaaaaaaaaaaaaaaacaaccaaaaaaccaaaaaaacaaagcttagttttgggctctcagaaaaatatcacaaatttgaaatgggatgattttgctcagaggtaaggagaacagaggcaaattagcactagctgccaagcatatgatgaactcttagactgcagggactcaccagggtatgcagcaagagataatgggtttacatttcagcatgagggattcaggcttgctctaaatgtctttcctgacagtgaagcttggtatgtcttacaaggtacagcgatggctgtggaattactctcccggaaaacctttccagtcggggcgagtctcatctctctgggataatgtgggtgcagccctgcctgggagtttggtcggcagcctctcaagattcattccagtctgatgattctctcactttacaccaatagatgcgctgtggcaaaaaaggtgagtcaacacacacagaacaattatggagggcatttcttttcatgtggcaaagaaaaacagtggttattccaaaggaagcacaggaacctcaaagctagctttttgttttattttcttaaatcctggcaattgtgactcataacacagagcaacatttacagaagtgtgaaatttgcgcacttcattccctgatgtgcttcagcctgggagctatggcatttacacacctgcagggctgagggctacccggaaaagtgacttaaatagaactggaaatttatttaaagtgattgatacataaaggaacagcttcctcatccccaaaataacaggctagagtgaaaaagggaaagagaatcaccactttaaattttaacttcaacagactgaaactctctagacttttaaaacaatttttttctggggcagagaaacatgacctacaaccaccaccttcccctttcaataaccatttttattttatttttgagacagggtctctctgtcacccacgctggagtgcagtggcatcatcaaggctcactgcagccttgaccttataggctcaagcaattctctcacctcagcttcccaagtagcagggactacaggtgtgtgccaccatgcccgactaatttttaaatttttgcagagttaaggtcttgttatgttgcccagactggtcctgaactcctaggcttaagcaatcctcctaccacagcctctcaaagtgctgggattacaggtgtgacccactgcacccagtcaataccatccttaaaagaaaccaaaattattcaaaaattgcctgcagtctcaggattttaaacattaacaattgaacctatctcatttcagatatcacatttttgggaggcaacagttgtatgtccgtgaagaaaaagtgcaaacatggcaaatcatttcctagggaaacacacaggctttgagtatccttataaagcaacaaagttatgctggattttcttatatacctagtgcgatactaaaccaagggcatgccacaacaagcctatttggagctttatatacactgtacatgcttgtggaaacaaggcaactagagagccataaagaattcataacttacatatggaatattaaaattttgatgaaaatgtgcccttttccagataaatgccagatgttaagagtactttcatatccattcagacaagtgctttaacatgattcagttctttgaaactttctgaagaaatatacttgcacttctttcccccattacatttatggagaaagattttcacatactttttattaaaaacttgactaagaaaagatgagctgtgctacataagttaaatgatttccatagaaatacattattagagtatacaaaaggataaatctatgccatgaaagaataatacaaagcaggctctttctatggtgagttcaaattccagaatataccacaggcacaaaacccttgtggtttacagaattctgaatctcgtagtttgaataatgggtgcaggccaaagcaactgtgcttttttgccatgtctgtttttttaattaagccctcctagtgggtggtgttggggggaaaacaggggcaacagatctgagacaggcagcagagaacggggcaggggcaacagactagtccacaaggctaattctatattacccctaaagtctataaagcacaaagactctaaattcaggcttgactagtagcaagcaatagcttaggcaggcatcagcccccatgatatccaccaactctcttgcaggcatccaacagacataatcggtggatgtaaagattgtgttagctaagcaaacggctttaagacaagccctctgtgcctccccatcaccaatccccagccccagagcaccctgaatgcctcccttaaagaaatcttgaaactcccaccgtcccagactccctgccctctgtcctaggaagacagaaagaagggacactgatttgcattgctcttgctgttttataggtaagatgggaggagaaaaaggggaaaagaatccaaagagtagggggaagagggaaatagaatggataggctgtatacatggagataaccattaattctaaaggaagccaagaaacccagaaggagaaaggaaaataataataagcaaattaacattataggtctttttaaaagtctttttgaaagactttcctctgcaggaccattcctgcacccaaatgtgtcaaagccttaatcttgcatagtctcctgtaatgccaccccacaccctataaccagcatggaccagcaaggccaagcacaccaaggaatgctgatgtttagataattgggtggagatgaggtgtgcactgagaaacaagtaaaggttgttcttgaaaaaatgttctctcattaagacccagtcaaactgctcaggtgtggtgccaagggggttaatgtacaaattcagaagctctatatggggtcacattctggccatggggagacacaagggtaggtttcttaaaatgcattgacttgacctcttccccaagagcagtcaccttttgaactgctgtgggatgacctgggaaaaaaacagaaagctctgcaatcaggcactctgtgtgagtgtttgtagtcaacaatcagagggctgtctagaaaacaaaatgcctcatttctttaatagtagctattcaggcagcaagaggcaatttaaagactggccagcaaagtgcactgtttgggagatcggcataaatgataacatttctattctactccagcttttatgcattgctcaacttcacattgcttaaataaagtacttccttctggggatggcaagtacatgatacctcagctacagctactatggtagaattagatggatataccccacacatctaagctccaatacaaaattcttagggatttttagtaagatgcacaaatgagtatttttaagcacaaagtcatgggcaggtctggtcttcatagaaagaagcttgaccattgatggtagtgtcttaatctaaatttcttttttcttctttacagcacctacttcttttaaacaaggacagatggagccatagggtgctaactggtccctttactcctttcacttttttgtccttttcttcaatggactttacttctaatccatggcagaatcatcctctccttgtagaattgggcaatataccatattcctacctccttaggcaagaagggacatttccaaaattttctgataaaccacaactgcatgaatggtgagaagcttggatgctttttatttctgtggcgtcattaaagtcccacagtacccagcctttgctatgcacacccacccatgtccctatctgcttgtgggaagctaatatttactctacccacttcctagggataccggggtctcggggcattcctataagtgttgtttgttaaaagcactacaaaaatgttacagttcaaggtagtatttactgacttttatatataactctccttactggtgttcttaaaattcatctctaacatactttattatgtttgcctctgtttacaaaatttgacaagaagttatagacttttcgtgatgtggtcagtagttacagtataagcaagcaactcatatgttttgctcccagaaaagagcccttgggaatacttatctctaagggcaagacttgaaatctgagagtcagatccaaatattgccagatggctggcaatacctttaagctgaagagtgggtgtttggctcccacactgggcgttctgcatccagaactgagactctgtggaagcaccgagtacatgcgtccctaaagctttggcttcagtggctctcctgaaccatttctgtttgtcaaaggcatgtgaccatgtcctggcagttcactcagatatctgccctccacacaaaaatttgatcacaactgcctacatccacaagaaagctcctgagtcaagtttagcagagtgctatcacagcatggtgcaagataatttcccatcagacaggcagccattctcttgaacctaaagacaaaaggaggaagcatagaaaatagagctgtttcatcacttgggtacttatgagtttacatctctgccccaaaatgtattaagcttcagtcgggcaattacctaacaagggcaaaaatgcacagagacaagcagaaggcggaaacctcttattttttaatttttgagacagagtgtcactctgttgcctaggctagagtgtagtgccacgactcggctaactgcgaactctgtctcctgggttcaagctattctggtgcctcagcctcctgagtagctaggactacaggcatgcactattacacctggctcatttttgtatttttaatagagacagggtttcaccatgttgcccaggctggtcttgaactcctggcctcaagtgatcagcccatcttggccttctgaaatgctgagattaggggcatgagccaccgcgcctggccctggaaagtggaaacctctttaacccagaacatctaattggtggctctgtggcctgtatcatttcacaggtggttaccgggcagcctccaagaacggaagcagctgtggcaagggaattctccagaatctgtgaggtttctagctacgaagagcttcagtgatatctgcttgtcaccagcaagtcctggaactcatcagtaactgaccctactacatgagcccctacataaggaaggctctcccttctcaccctcatgatccatctcccatggttcttagcaaaccatcagtgccatgttttgaccaagaaaaagtaaaatggaaagctatccaaatgttgactgacttcaggtactatgggagcactgagggggaaaagaactgttatgtaggggaaggattctatatgagaacaggtaggacccttttctccaaatgtagcagtggaagagaaaagagacacataccaatggacagttcatacccaatagacacagttcagctcacacaatccaggcacctgacttaatattgatcaagtctcactggatcacttaagacaggattcagaggtgacagcaatgtttttgtctgtctgaacacaaaacaactcaaaaaagggtctcaggcatcaaactctcacctctttaaggttatttaacagcctaggcaaaattttggaggttagaacaactattcagctgctttagcacttcatttgcatagagaacaagcttcattttcccttctcactgtacttggtcagcctcaagttgctatttcctatagctttacagctgaaaactctactctgccatgcacatcctcttcttttaagtaacctcgtttgactaaaaaggctttggggaggcaaatgtgaaatgttctttccccacctcttacacactttgacataacacagaacaaatcaggtgacgagaaagactccacccatggccatctgtccatcttaacacaattacctatgtgctgggcgtaccataacttagccaacagccaattatagaatgtgtaaccaattttccttgttgtatattgctacaatgaagaaccttagaacaaattcgtggaaatagagttaattatctggccaaggcttctgactgtgaaattgccttctaccgaaagctattgcaatatatatttctcccagctgtatctatttcactttactcctaacatgtgtagatatatcacatattttttttttgccaatttgattccaaaatagtcttcattttcttgattatttcaggataaactttttgtcgtaaatctactggacacatgaatttgttttttaattgcctgtttatgttctttgcctgttttgataggatgattttttagagtttgatgtatataacagatattaacttttcaccagatacactgcaaatactctttcccagtgaactgttcgtcttttaatttatatagcattttatcacatctgtatgtttcatatttttatgtagcttccataaaccttttccttaacagatcctctctctgatttttgtttagaaagacatcctccaccccactcagattccatagctaccaacattttcttcagtgtggttttcttttatgtggtcattttttaaaccttttattcatctggaatttcatggcatacatgaattagaaatcaactttgtacttttcatttattgtttgtcctattactactgaataattatagctacatctttatgttactctaaatgacaatattatgtttaatgttgcatagtgtaatatctccccctttgttttattaaaaataatattttagctatttgtttattcttcctgataaatataaggtcactgtaaagatttgttttgaaatcccatgaggctctggatcacaacaccactaaacttctattctcccccaatcagtgtaatcatgtgcatgactgaatcccatctaataacatgagcactccatttatcaaattgtatttttctttgcagaggctctctttaacctagacataaattccttgaggacaaactttatttctgttttctcagtatattctattcctagtagctagtacagtgtactagaatgaatgaaatcaaagtgacctagaacatttgtctttaacatcttatttagtatttcaaaccccaattagctaaaacagcaccataaccctgaatgcacttggtgtgtgtaactcagcaaaggtctaagtgcagggatttacagcccaccacaccactctaacagcataaccaattccaaagacagagacctttctacattactgcaacagcaacacaaaggggaaatgaacatggagggtaacactgggtagattaagatgaaccaaaatcaacagaactggaactcatgcttgagaactacagaaatgtgtctagaatgaggtatatcactgccatggtgaagtaaagaagtcagaacactgctttaaaaagtcctagacccaatgctaagagagatttaggacattgagatagcaaagatccaaggtaggggtgggtagacacagaaatatcctaggtaaaaaagacctgaatcaatgttcccaacctgtcttcttcctggctccttggtaaagggactcagctaacaaaaaccaattcactggtggaggctggatggagtcattgtgaatcgtacctacactgctggtatggatcacctgcactgtttggcacctaaggagcacctcttttgatctaatgatttactagttttaagatatatttacaaagatatttattatagcagtataataacaaaaactaaacgaacacattaatgcccatctacaggagagtaaataaatacactgacatatccatactttgcagctgtaaaaaagaatggtatattgaagaccttggagaaaaaacccacgacatatagttaaaaaatattttttttcttaagactttttttttttttgagggtgtttctctgtcatccaggttagagtccaatggtccaatcacagctcactgcagcttcaaactcccaggctcaagcaatactaactcaacctcccaagcaagcatctgggactacaggtgtgagttttgtagtttttgtagagatgagggtctccctatgttgtccaggctggtctcaaactcctgggctcagacgatcctcctgccttgtcctcccaaagtgctgggattacaggagtgagccaatatgcccagatgacagattttttttttaaatgttaagaagagaattaacatagtgtgatctcatttttatgagaaaatgttcaccacatttataaatacttgtgtattttatatgagcttagatgggtattgaagaataaacaccaaattgttaatgctggttaaggaggaagacagaaatttaagaggagaaggggcctgagttagctcttccgtgatatacttctgtgttgtttgacttgttctggtggccatgtgtagcttttgtgctttgaaaggagaggctaataagttactattcttgaaaataaatagacatgtcaataaattttgaaaaatggatattaacaatgcaaatgtaaaagtatctcagatgtagaacaaacaaaataatgaaccccattagaacatacttgagatggtcaaactttgatgacttaaagctggaaagaggtactacaattagttttcctttgatttcagggacgtatttattctgcttatcttaagacagaacagaccaaatggttttgaaaggtcctagatggttctcaacatttgggtatattccaggaagactaagttaatttagctattcacagagtggcacatttgacagggaaaatgcaaatttgatcactgtagttagtgttcaattagccactcaaactggacggggagtagtgacagataaatagatatgatgctagggatactgcaatgtatttcacttttgaaagccttgtttgactttctcaggaacctatctaggaggtcgtatgaaatttgtattagattgtaaatattgttttggtgtacccccaggggattaaatagcaaccacataatattccttataatctactctaaaatacattcaattttaaggaagagatatagtcatccccaatcatccctagagtacttttcatgaatatttttcaacatgtgggtcatgatccataaatgagtctggagacaaatttagtgtgttgtgatcagcatagatctagattaaaaaaaaaaagtttgaaaactactgccttaaatattcccttcttttctgcatcctaccccctatgtactgtaccaaccagcagggaaaaaacactttctctcaagtctggataggcatatcctaggctgattttcaaggagctgattttgtcattaagaaaaatgttaagtttaagtatacatttgaaaattcaggagctaattctattttctctacttcccagcaaggcatttgttataatgggtaaatggctttgccttaggatttcttgctgagaaatagctcctaaatgcccatttcttgtactgtatattaaaacatgacataagaacaagggggatcacaacaataaggtcataaagctgcaatcaggccaggcccctaaggactgtattaacagcccagcactagcagtggatgtacagagaggagctgtgtgcaccctgagtacaacagctagtaaacgtttaattgaaaagttatctcttgcagctgtgctgccaacactcagacatctgaagacaactgtcaacagaattctcaggaaaagacatctactattgaagctctagcatgttcctcaacacacagagcaagacactgttctcaaagtccaacagctaagggtgacggctcccttgtgctccaggcttgtaccaccagctgctgaccacactgctgcacccagaggatgacacttgatgtggcccaaactcaacttcccttctttccctgcaaactaacccaccccgtacatccagcttgctaggcaattgaactgtcacccagttcaattaaatgaacaaatatgggccatgagccaagttctacaggcccatttacccaaaccagagacttgggtatcctttttgaattcttcctccacgtccctcttatcgatttctgttgatcttgcctcacaaatctttctggaaaccatccactcctccccatgccagcatcaccattctagctcagggtccactgcttgtctagattgcaggaacagtgtcttcactggttccctacatctagccttctctctaaactgttctccaaaggaagcgtagacactctgaggtgcatgtctgatgacatcatttctcttgctaaaagagaaatataaacaataacaactcttcagtggctgcccttcgccctcaggtaggtccaaattcttttaaatggacctacctgctcccacccccacaccatcttcaggtggcctctggaaagacttcttgagtcctagtggacccctctcctatgtagcctcctagttcccataaagcttctaacacactctttcggtggccttgtttctttggtctcctctagtagtctgtaaactccttgaggactagcattttgtctgactggtttccaacagctagcactgtgcctggcacaaaggaggcactgaataaccacatgttaaagactaacattgactagttcctctaacatgggaactatgataaaagctaaaccaggcgttggaggtcattgtgtgccttgtgcaatgacacaatgtggactttcagcaatggttaggaaaccatcccaacaaatctctcaggtacataaccatggaaaatctagggctagacagtccaatgacttcagtcacacaatctgaaaacaaaaaggagcactgaaatcaatgatataagtctgcttatgatgataaacaatgttaacattaagtacattttgccattaaagccatttcacataaagacattataccaaaaaacaaaattgttatagcaattagatttcttcatgatcctttccattttttaaaatccatgtttgcatttttctttaaaaagctgtaatcctaacatacatatatggcgaattttgtgttattttctataggttttctcaagtgggtacacagtcttcatatttgtagttttaatgcctgagtaaatgccatcaagttaatgtatcatacttaatcatatttaggtagtttctaatctttactaatttaaaataatgctgtaacaaacataaaatgatttccttcttttcgaattacgaaagaattttttctccttatcttagaagactatttcactatgttaaacctgcaagaacacatacttggaacaccatctgcaaaacaatacccaaaacagtgggtaatgtaagaatggaccaaaacagggcttgcaaatcagaacacatgcaggaaagtggggtatgagtggcagcggaagggaagagaagctgcagaaatggtatttagaatgcgttcctgaatgacacgggaggagcatttctggagtcactcttgtcacttagacagttaacaaagacactacctgcagcagtccctgttatggaaccagataaggcagtggcgagtggaccatctcagtagctctgagcatgcagcagctttcctagcaaggtggctaggggtcagatttagacataaagtgtagatggcattagtgcagcaaaggattctggcctgtttccagtagttgaggtactagaaaacaagagaaagagcaaacaagggtagatgggggattgccagggcagaagatttatttatgagggatatattgggaagggttagccagagaaataatagaatcccaacccactctgcctatgacaagtggccactcaaccacatttcctcctcacccccaagtctggcccttgcagagatagctaaacttctgccaacaaccggattcctttctataattaaatttaattcagcactcatgtaaatattatttctcacactactgtcttctatcactgttgcgttaacctcaacaattttaccattccacttccactgtcaaagaataataaaatcctcaaaaatacccactcttaattaacatgttctattttcttttcctcctatcctaccctcctgccttctaccagaaggcaaaggggatctaaagtcttcctgcaaacacagagctgtggtctcttgtgattacagtcccatttctatctctctcatttatcttatcaaaaaaaatcttataatatttacacatactctaagaagccaggtaactgttaagacttaaattcagcagagcttaaacaaaagaagagcaaaaatgatccagaagtcataatttactgttaaaatgctactatctcatgtaccatcccccataccacactcttccatgtctcattcaataccttacagagaccctttaagaacacaggctgtgctttcaggaataactgacatccctgtaaatccatgtaatgttcagaatataaagccagtgctctctgctgtccatatagcaccattaatcttatgaacagtaccacagaacaccctcccccagccccctccatctgctttaagtagggcaagtgttttactcatgttaatggttctgacagatgaggatcaacactgctttaatccatttgcagcctagcacagggaacatttgtcttctcaaatgctgttaggggcaagtacactggctgttagtaacaggagaagtacttcaggcagtgctcagtactctgaagtgactggctctgctttcctcatagagggaatgcaaaggaaattcttcccaaaatgggttcaagatgttctggctgccattgtggttgtgtgttgatcctttaaaaacagcagatagtagaattttattaaactaagacacactgaatcaatttctattgatttcttttaaaatgccagtgtatcttctcatttaccaattaataacatgcaagttctagaaaagacaaaaatgaatgcagttgaatttttcaaaaggattttgctgtaaaatgcaacagcccaattaggaaccacacacattttgcaatgatatacctagcaccaatttataacacacacagggaacattagagccaaggcctgccgtgtttacaagagcatgggccttagatacaggcacacacctgtgtccaaatttcagcttcaccatcttttgtcttctcaaccagctgctatgggtattgcaggaatccctggtcaagagacatacatacctaaacatatacatacctacatcttggttctgaattacctgaagatgtagcttcagacgatgtgctaaatatgccctagagatttctattctcaccccagaagtacaaagaggatttccatggagaatgaatacagtggcccgacagcctcctcccccgattttaggaaggggtcgcctgcctggtctccatgagaagtacttctttatcagcatctggacttcacgggcccatctctactacttatcgtcacgtgtttttttatttgccatgttctcatttctactccctttgttttattgctatttcttcttcaattccaccctgtctcccgtgcttccaatttataataataatcttatacatttcaagacttcagtacagtgcttccagctcagaaatctaatgaagaaaaacaaatatggcatgactcagatttatggaatatattgtatagagaacccaccagaaaaacccacttgttaccccttataggcaggattactgatttcttccttctgcccctcctaggctttcaatgctgttcagggtgcctcgatgagatgagaatagatggacaggagactattcttctagtttgggggctctttcttcttcaacttctgggtaaaagcatggcccaagattgaccacttaacaaaaatgcttactgacatgagagaagtttatgttataatgccagccattttctggtaagccatttttgcccaagaagagtatacatttatgtatatgttagatctcagcagtataaaagagatcaatttttcctctatacaacagagaatattaaaacattaatggcatgtctatctggatgtgggatttaaggtaatttttattttaatatttttctgactttctacattttatataatagttaacaattacattttaatcagaaaaacaaaataattacgtaaagttacttacgtccttctaactccattcagcaccctactttgaaagtcatcatttatgtctttacagtttaatctaaaatcatccaaaagtcaactctaattttgaagaatcaaaagattccaacctcccaacttgattaaattagatcaatgttgcaatgccctaaaaacctatattcttatattgagaccaacacatctctatgtgaacgatgacacttattaaagataacctagtctaaactcccagaaacaggcaatttagactattcctaaacatgaattttgatgggaagctttgattttcaaaaaggagttttcctcattctgctgcttacagaaagcctggatgtgcacaggcctctttaagaccattatcaggcaaattttagaccaccactatcggtcagaacaccattaccagccttgaaatgtactgattagaatttagaaaaggattctgaagagattcacttttactgggactcaaagaaatttggctaggctgttttattgtttataatcatagaggtaaatatttaggaaaatagaagacaacatgttatgaactccaaagagttatctaaatgagtaggatccaacaaaagtaccttgccatctataactgtagaatactatacaaaggagagataatgcacaataatcttagctaccttctgactgtgcacctgctgtcagaaaagtggggtcaaatctgactctgcttctctgggtttgttttctcagctacaggatgaggtaactagtccccagagaggaataagcgagatgtgtaagaacaaatgaaaatataacaaaaggcaaacctcaaaccaaaatgaagatcatctgcctggagagttcccttcttcacatataaaactcacaattacaaaaccaaaaatagaaaaaaagaaagaaaacaagctctcagacactgtgctgaagtatgagtgagtctccttacctgtgactgcagctcactgtaaattctgaggcccaggggggttttaacagttgccacgcagatatgttgctctccaaggaccccattccctatcaggtgcattatctgctcatcagcatcacttgttccttcccacagctgagccaggccctgatgtgctaacatggaggagaggtgtcatgctccctctgtcagctcggtgggtttagctggaagcatcctgtgtgtaaggtaaagccacaactctcttcttcaccagagttgttccttacctgtcaattttgtttctatttaagggtgatttcacccccaccaatgaaatgcttttaagggggtttttatagtagagaagggactgaactgcatttacacacattatacagattctcttcattcagttagtatttaccggatggcctctgcagcttggtatctgttcttccatcactacagtcaagccagacccagtgttctaatgtggttaagtgggcacataccctttttcctcagaccacactaacaagatggtaagtgactcactcaaaacacacatattgggtatctactatgcaccaggcattctgttaggtatgggagtaaaagattaagatattctcctaacttcaaaaggcaagactttcaggaggctgaggtaggagaatagcttgaacctgggaggcggaggttgcactgagccaatatcgtaccactgcactctagcctgacaacagagccatcctctatctcaaagaaaaaaaaaagagcaagccttcaaaagctacatgaagatactcacagggaaatattaatgcacttgatacttcctttcacatacaacatatgtcacagtgagttttgcatttacatgccagtcttcatacctgttggtgaacttctatatttatctacttccggtgcctcgcacaaggcctggcacacaggggcactcaatgcatgcgcatccaatgaggaactgacaatccagatggcgggaaggtataaacacccaatagccacgctgtcacaggaggcttgtgacgaggccatagtgaaggtctcagtaatgtgccacagacagcacaggagagttcagtgcagttcccatttgagataattcaggaagattttcttggagagaaggcatttgagctaagtttgggagaaggatttcaacagggaggaagaatgagagctggggagggtgtccaggtgggcagagcaccttaaatggaaacatgataggatttataccaggtccgtggctgccagatgatacgcctcacgcagtgggggctccagatctctcagcggccccatctgctcctcagtgtaattgatttaaaaggtcagctcccttatactcctaagacaagagctctgattcacaccagagaggtctggaaaatctaagctgtgtgtgcgtgtgtgtttgtgtgtggaggggaaggagacagagaaatgtcttttaataagcttctctaaattttagctttttcaatatgtgcaacttaattcaaatctatcttttcttccttcaggtaccaggtcagagaaaatttgtcagactcctcttaaaaacattctttcttgtctcagaagaaaggagtgtggattggtattatggcctctaatggaaacatggtgacaaagtcagctacctccctcccccaaacatccccctcccaagggttttggttccaaataagcctggaaggggacattcattggctgcatcaaattacaatcccccctcagctgcattaattggaatactgtatctagcacacagcaggatgagagtctcatacgcagagagagttgggcatctggagaagtgtgcagacccaaacagcccatctcaagagcaccaggggcaaatgggaccagtccagagggatgggaactagctggaaaacatgactagcaggggcaaatggtcagaattctctaggttctgtctgaagcaagacttgtggggagaaagggggccaaaggaatagagggctgacacccattagccctttccacatgactgctgctctcctccctcctctgcccgcccccacccatcttcacaattccccatgcaatttttcggttgtgcaaactgaagcccaaagagcttagaggatccaaaatcacaatgctggtaagtaaaatgaaatgtctgatgccaaaatcaatttttattcccctctaaagctcattaggggagacagctggcatttaatttttaaagtgatctcaaaagaactgtaatctcttaacattagaatttgctcttataagattgttttcccacttattagcaccatgcatttgttgagacggatttggataatatcgatattctgacagaacataatgggataactcaggtccttaacccaaagctctgtttctatttaagatagtctaaaagagctacatcagcatctgattctttgccacctaccctccctgaaactcaactggttttccatatgctaagcataacttattttttctggtttggatgggttagaaagatgctggaagaaaaattagaccaacttgtaaaactttactttgctgatctatggaatagcacacttttcccacatagcaatttagtttctttcttcgttttttgttttttttttttttttttggagacagagtcttgttctggtgctcagtgctgagatcatggctcactgcagtctcctgggatcaagcaatcctcctgcctcagcctctcaaagtgctaggattataggtgtgcacaaccacgcccagcttatagcagtttggtttctataaccctataggaacagaggtcaacaaggattatttttattaaaaatatcaaaagaagagatggacaggtataagtaaagtggttaagtctgaaactgtagaacatagaacttctgggtaaaatccttagagtccactgatggaggtatgttagaaggctaacagcttcaacttcgcatctccaattctataattaccaactgaaatagatgggcaaaccaccttaactttgtataaagtactcatgacacacactgtgcagtgggagaagtaaagaaaatgttagcctgagagtaactttgtatttgtctacaaacccaaatcttatctcctccaccttttaactgaaagggtcaagagagaaaaggctgcaaaggcaccagggaagctggggaaatcctgaaggataatgaacaaccacaccacgttaggccactccacgtggagacagcctctgcacgatggttcaaacatcaacttaatgaagagagagtgggcataaggggttgaattcatccaactttggatcctgactatctaagctgtctctaacatgaggtcccaattctctagtaatcagaggggttgagagggtgaggaaggagagttgtaaatgggagtggacttactttatgcagtcaaatcttaacaagacacaagccctagaggaaacaactctatggacctgaaaactgcaaacacacacacacacaccatacaaattgttctgaccagcaaagaaggcatgaacacttgacttcctaacaagggtccacaggcagagaccatctatcttgtttgaaattcttaaaatcctggttacatgattctaaaattcctggacacatgatgtcccaaccaacaggagattagaagtagcagattgaaaggctagagaaagctacacagatatcagcaagaactgacagctgacaaaaaggtaagaaagagaatcattattctcaaaagtgagcatattttaaaactcagcagtctaggagcattgagaggaactaacagctttacaaacttcaacctctcttgagtcattgccatccccaggcatgtgaaaaataattacaagtgtaggaaagaaatacagcatagtagcataacatattaaagagatttaggaattctagttcacactaaattcattgagaatgaagcgtgctgtagcatgacactctgcaatcttagggtatagtaacagaggccatataaggaaatgaatgaggaggtcacccctccttcagtaagttgaattctggattccttaatttgagaagaaagagcaattaagtgtatattcagatgagagccaccaagaccctgaggagatctgaaaacaaggactgtatgatttttttttaagtgcaatgacagtggcattgaggggcaacaatgcataaacctagtttgtgggactgactgagagctgctgctgaggcagcatagaggtccctgggatttccggggtattaacatgcctgtgcggcaatggatccttgcaactactacaggtgatctgaccatatctacacagtatccctggctcagtctttcagccctgcttctcacacagggaaatccagagcgtgggtggcaggggacgtgccagcaggaacttgaaaacacagtaagtgcagctccaggggctatagacacattttgtttgatttgcagtctcccttacaccccctcatttgggcctgttttaaatatgaatgggtttgatataaaaatgtgtttctgaatttcccaaggcccgcagcagccatggcgacaatgaactagaaatgcggtcagcctccctgtttggctactgccttccaaaattaacaccacttatttttcaacaaaaacaaatcaaacctcctagtctacttcatctatttaacctgccctgcctggcacttgagtgtgtaaagcctgccctacagcagcacttgatgtaaatgcaacttaaaatatttttatatttaagatcaacacatatattagagaataaagcaaaacacatactagagaaaacatctacctattagccctgggatgtcgaaaaagcttcaagcctatgtaccttttcaagggtcaccatgggcactttgcttactgaggggtagaagtttcctatcttgctttatttcagagcagtggttctcaaccacatgcaagtttgttcccaaaggacatttgggaacaatgtctgcagacatttctggttttcacaaccgggggaggatagggggagctactagcatctactgggtagagcccagggatactgctaaacatcctacaataaacaggacagcccccacaacaataattatctggcagaaatcctactttagcagaaatcctactttaggaaagttttcaggaagtgctggcctataagatacaggatactttgaggctcctcaacatctgccccaaccaaaccattccaaactcatttaaactttcacctcctatagtttatcctccactcctcatatgccccatcactactagcagtttttttcaactttcacctcccaggttcaagcaagttcaagcaattcttgtgccccagcctcctgagcagttgggattacaagcatgcgccaccatgcccagctcatttttgcatttttcgtagagatcgggttttgccatgttggccaggctcattttgaattcttggcctcaagcaatccgcctgcctcggcttcccaaagtgctgggattacaagtgtgagccacagcacccggcctcctctgtttccttttaagaagatgaggctaaaagcactgtcaactcactgggttgttctgaggatcagaggaacccaggatatttcagggcttagtcaagagttttccatgttctggggctcccaaacttaccctagaaaagaaagctgtaataaaacatactgtgaaaccccgtctctactaaaaatacaaaaaattagccgggcgtggtggtgggtgcctgtagtcccagctacttgggaggctgaggcgagagaatggcgtgaacccaggaggcggagcttgcagtgagcccagatcgcgccactgcactccggcctgggcgactgagtgagactccaactcaaaaaaaaaaaaaaaaagaaagaaagaaaacataccaacaaaagcaaacacatgcacctgtgaccaaaatagaacatcaaagactctctcacatcacaaatgtgagccatactttagacagaacccacgttacaaacaaggtcccttacagttctagtgcatgctcagaacaaattgaggggcaaagacctaacaagaggggcatcaacaaatctggtatgtggccctgctcaagcatgatcctgttatcattctagaaaggggaaagcagaagtaaaccaagccataaatgagcctctctcactcccggggtttttgaaaaggggatgtaaaagaggccatgtattatttacagccgaggaagcaaggacctcagatggtactgaaacaacgaatatagcctatatcaatgccagcttgtccacattacatgcaagccttgtggttgtctctggatgccccattgtctattacaaattcatcacaaccatgattggatactgtcaagcttcacaaaaagacaagagccagctgtcaaactaaattcttctcattgtttaccaaaaggaggcaaaaaagattctaattattctagccccacgaaacaggtaaataagaaacacagagtcacatgttctgccatagaacaactcacagttagaatttattctgcttccaaggacagccacagtgactgcaggggtatggctgcaaagttcatattatttaataagcaaattggatcaagaggctgaaggctttatgttttcatatttattaagtaaagatgtattcaaaacacaaaagcagaaaggggaagggaaaatcatggttgagggcacacatgcttttcagaggagtatggtataaagagaccagcccacatctaacctgaatgtcacctgtgatgtagtatgcacacatcaccctgtttaatcatgatgtaggcctttaaagtagatgctgttgattcttctcatcttacaagtgtgatataactgagtctcagaggaagaataatgtgcccagggccacacagctggtcagtggcagagccaggaattgaggtgtctacctgactccacagtttttaatttagataaactctaagcttatctaactacaaaaacagagcaaagagtattaggaagccagtattagctaacataaatgagaaatggatactaagcaagagaaagtaaatgtgagaaggggaacccttgttactctgtgagacacagctgaccttggtgcagcaagttttctgaatgcaaagcccagagacagcttcaccttggaggagtgaggccgtctaccaagccctgtgaaaaggagcacctgaacagaaccgagacaacctcagacttgcttcaagcccgtgttcacaaaataatccaatgggtgcactgagcccagtgacagcggctgccctcaccttgccctacatgtcctctttggaagagctggcatcttatatcacaactcgacagtcagctgccccttaaacagtgagactctcagttatggctctgggggaaggacttactacagaccatctccatagtttcataggtcagaagaaagcacctttgaagtgttagcccaattttacagttaaacagaagagaatgctgcttgaaggatcagatgatcaaagcagagattgaccatgctggtctgcaaaagtatgccctttaggtgtaagcccattttacaggtagcaaaactgagtccgagaatttaactggataggccatccaggttcactatgacttgcttaaaagcagtgttggactcaggtgactctaagcctcacagtctatcactaggttgcactatcttacccctttatagtcacacgatacagaataaataaaagtgaatcaactgagcggatcaaaataaaaacagaagtaaatcacttgagcaagcaggaggctggctccaagtgctcagagtctagtggaatcactgtttaacctttgaaaaaggaagtaggttaaatttaaggacatggatggatactaccaaacttaaattaaataggcaagttcactcacttttaattagccacaatcttaattaagcagccacctataaaaagcccagtaaccaccattaccagtgaagctatataacattcctgcaggagaagatccaggcttggctcttggatgtaggttatctagagagcctcattagtccactgagatcccactggctaatggaccactcaggggcctgtgtccgcctgaagtacccagcctcagtctcagcctagccacctgcagcccaacacccctcaacctacagtcttctgttagcatctgattaggtgttaaggtgtctataaggtccccttatttcctgcctgggcagctgctataacagtcttggccaaactgcagttgtaaagtgaactaagtccatagctaataggtcaggtgataagatgtgagagaactagctgtcttttgcttgtgttcacagcctgctctaaactggtagggctctaacaagccacttgatctatttccccaaggaactaaaaggtctaccggaaaggatgataacaacaaataggggtggcaggcaatcgcgcttccctagatccaggctctctggcctacatagcaaaggcaaaatcacatgcggaaggaggggctataaggattctccaagtgttaggaagctttaaatgatgcacaccaaaggaggagcttaaaataccaaggagaaagtctccagattaaaacaaagaaaagccctaattctaagggggaaaacttgttcctgaatcacagctaaagaatgtagagctattcagtattagtgtcccttctgctgaaaaaaccaaacagacaaaacaactacaaaacttagaatggggtggggtgaagagcaggagctagcacaacaatacagagatatccgaatggtttcagaatctgagcatgtcgagctgcaaaaaggtggtgccaggagaacccagggcaggggcaagaggaagtgtatgaaacatcctctgagtggattcccttactgggtgtggggaacaagggattgtctaaatctaagaggcagagaaaaataaatgtctctcaagtttaccatctcttgaacacagccccattaccatgtgcatggccatctgcaggaccaaggcaagtactctgaagtgggcaaggaagatggagtggagggcagagcatggtgcctggcacgaagcaggcatgaccctgatagctggatctcagcagcaggctggaagggcccatcctctctggattatatagatgacttaaaatgaacagaaatcatcaaatccaaaaacgataatcacctccttttagcattctccattacattcaagttctcaagcatcaccgagcagaaggtaggaggctgcttacctgcctttgctcctggtctcttcccatccaatgttagaagtgggaaaggctggtctcccccatctgcctccgcaccagtactccacatttttctgacccttcttcttcttcttgggtttgtgagcctgggctttccttctgtcattctcttcttctatctcttcataggaataagaggaggtcccctcactttttaacatctctccttctggccacagcctaaccaggaacatcgttggtcattgtggggaaactggccctggaggcccatcctaggcatggccctaccgaatccagagggcaggcacctagaagccttcctgctgggccatgttcctttagacaggtggaagccctcagctgagcaaaggggagaaacaggagtgcaagggaactgaagatgataatcatggggctctctgacctcacagtgatgcaggcagaggtttcctcgccacatctccgtacatcagagaacagaaggaagccaggtcatggggctgaggatgggcgacttgatttttaagacagcaggatgcaacagtttcttttttctaggacagttaaaatgacgcaattgattatagaacagcgatgagaaagagcagcccccagtgggccaccactccccatgaaggccaaaggctttaacaccttgatttaggtgtagtgtcaagttgttgtttttctctcttctatgggacaatgttggactttaactgattcaacagaaaattctcaagaatgtctgcatgtgctaagtactgtacaagccctggataagttaggttaccaccatgcacacctacctgctggatgcctagatttctttatgacgtatgcaagacagattcagtcatttgtcaaatatgaccattttttgttttccccccactacagaactagaagatgatgtttatgtcactttttgagcttagatctcattccagtgtgctggggctagtgccacatgccccttccttcaccatggcacccacccaccaggctctaaggaagcacccacacctgagagtaaccaaagacaatacctgaaatgttttggtaaggccaagctattagatcaaggtcaccctttgaaaacacctttgagatgtgcagtctagaaggctttcccttcagaaaagaacattctctggacaaccttgttgtcaacgttgataaactgtgaaacacaaggcactgttctttcactaagaaattttccctcttctcaacatgggattacatattgtctgtaggaaatttgtgagttaaaaaagcatatgcagaaaatagcacctataccccctacctttttataattagcatatgtcttcgtgtgtacttgtatatgtggattaaagacacacatgcatgggctttggatcgggtgtgccagaaagaatcctagctctgaaactaacagtgtgatgtgcaatttaacaagcttcacagttcgcttattattaaaatgggagttacacctccttttccataagtttgtaaggactaagagatgatacatgcaaagcacacaacacagtccaaacaaggaagaacctgctaagcctccttatacctccttctccataggtttatcaactaagagatgacacatgcaaagcatacaacacagttcaaacaaggaagaacctactaagtagtagatgtcagtatgaaagtttttccattaggccttgggattgttttctatggctgctgtaacaaatacatgaacttagtggcttaaaccaacacatgtttattgtctacagctctggaagtcagaagtctaaaaccatttcgttaggcctaaatcaaggtgttatcagggccaggcttccccggaaggctctggggtagaatttatttcctcagctcttcctattctagcttctggtagctgccagcattccttggctcgtggccccttcatattcaaggccagcagcacagaatcttccagtctctctcagactctgactctttgcttccgttatgacatctttttcttctgactctcattttcctccctccctcttatgaagacccttttgattacactgggcctacctggataatacaggataacagcctcatctcaagattcttaatcgcatatgcaaagatccttttaccatgtaaggtaaaatattcagtaattctggggattaggacatggacctcttggggtgggggtgggcaggcattcaacccaacagatgttcttattatattaagctatttgagaatggtaacatggggttgttggaaatattttctcctgtttgtctacattctttccataaaagtaacatgtttgttgtcaaatcctcttatctacacttttgtcatttctcccactaacgttaagcctaggaattctctccgtatcttgtcaggatagtgtttgtgtatgcgtgggtgtgggtgtatgtacttcactcattgttacaaattcaaacgatagagaaatacataaagtaggaataaaatttgttccccacctccaattctgtttctcctaggaaaccgcttcatagcctgggatccactcatccagagtttatgctattcattcacacactgcacttccatttgtttatggggtcaatttgtacacctaagtctatagtccagctgggatttactttagtgaatgctacatatacacctaggaattcctcctctcatttgttttttttctaaggaatgattaactgaagcacaatttgggtaatagttgttatttttctatgaaagtgtattttgtgacctattcctgtttttgtccagtaccacacctggggatcatctacctgccagttctacctcatgtttacaggtaccactattcacatggtggcagctgcacaaactgaagaaacagcacttgggaaaaattacgcaggctccagaggactcctatagatctaagcttataaagtaacataaacatcatcgtctagtcctgtgattggcggaaaacaaaaaatggtcatatctgacaaattactgaatctgtcttggatatgtcataaagaaatccaggcatccagcagggggacatggtgataacctaacttatccagggcttgtacaatacttagtacatgcaaaacactcttgagaaacgtctgttgaatcagttaaagtccaacattgccccatagaagagagaaaaacaacaacttgacactactcaaaaggcctcctggtctgcgtgggggctcactccctgaataccgacaatttaggaggcccaggcaggaggactgccttaagtcaggagttcaatatcagcctgggcaacaaagtaagaatctgtctgtacaaaaaaataaaaactaaccgagcatgcatgtgtgtagtcccagctactcggaaagctgatgcaagaggatcacttgagcccaagagttggaggctgcagcgaaccaagattacatcactgcacttcatcctgggcgacaaaggaagaccctgcctcaaaaaagaaaagaagaaagaggaagaaaaagaagaaaggggaagggaaagggaaaggggaagagaagaggcctcctgattccctatgatgagtgatgaatgctgctccgtagaaagattttggcaatcttgaattccttcatctatatatagtcattcctcgaggactcattgtgaaaatgaatctagatgtagtgtacaaagcaaacgcaataaaccaaggccaaaatagccataaaatcaaaaagagaacatggcccccacagcaggcctcacttctgttgtcagtgacaacatcacagccaggctggtggttccactgttgggagcagtgatgtttaactctgaatagaaccaggctgccccagaagcatccatgcccatttcagatagtgattgtgccctaggctttcccagtgcacagtgtggactaaatataccaaagcgtttgttgaagggaacagtaaaggaagccagctccaagaccacacacagatcacacttggtgtgaagacagcaatggacctcgtgagggggtcgatcaatatccatgctgcaacagcagcattctcaacagtgtgtgctcggaaggggtgaccagtgttccttaatggcacccagcatcgggaatgtagaacctctaccagcacatacaggcagaaagcaaattataacaaccaggacacagtgagtttcactaatagaattagacctacaatttggtctcaaccagatacaaactgtctgcttaggtctggtgtaatttacaacagcctcaaacatgtttctcatctcttcgtatgacaggcaggttaaactttctcagtgtcgccactcccctttaatgcatttccaattgcatgtgaaatttatcacccatctgtgggctctgggcctcctgagatcaccaggactctgcaaactgacacagccatgggcctgagaaagaaaggtaatcttaagcacccttagaagaaatgggctggaagaaaaagccagatggagggtgcagaggacatcctggcaaacaggtcagtaagccatctctggctctgggatgtttgctaacagttgaagatattttcacttctcaaactcctttgaccacaatattccccttctcaaaaatctttggtggcagtgcccttctgcctgtgttccaaataccaccatctggctttcagggtctctcatctggcgcctcctctctctcagctccctctactcttctacatgtgggtcatggtggtcaagtcacagctggcttcttttgcatctgtcaccccctcagggagaaggatgttttctcttccaactactgaaatcctaccatccttaaagagctagtgccaaatgacctcatgcatgaaaccccacaggcagctcaggcagcagtagacttcattcttttcgattgtttacttgtgcctcggttggcacatagtgtctttcactggagtcatgctgggagtcacttctattggtgatatacctatgggtgagataccgtaagtaatgggaaatatcttcattcccatctcccttgcttgtgccaacacctagtgctgggttttagaagcattgctggatggatgaatgaccctctttcctgacatcaggctctcatgacctgggtcacagtcaggtgcccaggaggttagcaggtgagccctgatggaagtgggtgaagtgagcaagagggagcagtagggcccatagcaacctggagaggtcatgtctcatttactaccaggcatctgcttctcaactccagcatttgttgctaggtgggaatatgggccccatgttgctagatactatgattttgtaagaaaatccagaaatagggatttttaagtgaaatattttgatgtataagggctacttaccaatgttaatttaaaaaatactcggtcgggcgcagtggctcacgcctataatcccagcactttgggaggccaaggtgggagataatgaggtcaggagatcgagaccatcctggctaacacggtgaaaccccatctctattaaaaatacaaaaaattagccgagcgtggtggcacatgcctgtaatcccagctactcaggaggctgaggcaggagaatcgcttgaactggggaggcagaggtttcagtgagccaagatcactccagcttgggtgacagaacaagactctatctcaaaaatcaatcaatcaatctgtgggcaaacagaagcacgtctgcaggttctggctgagtttgggccctgtgatctggaacctccactaatggtctttggaacaattaattaagggtgccatcctacatgtaacattgaaataaaagatgcagtgtctgccctcatggagcttaaaacctggttctggaaatgtaagatgtatacatggaaatctgagcaagaaacggtggcatatgttgatattgtggaattaggacttcagactttttggagccagggagctgtggtgggctggggggtccgctccactgtcacgggcttctttcttaaatacgttctgggtcgatggggagatgttggtcaaaggagatataattacaattcaaaagggggaatttttttttcctaaaccagttttcagacccccaatttttttttaagcccaaataggcaaacaaagagagaggagataggtgactgcttgggctaggggagaggataggtaggtagcggggaaagaagtgaagaatggctacctatggttatggggtttcttttttaggcagtgaaaaggctgtttgtggtgatggacacacaactctgaacacactaaaaaccactggattgtacatttgaagagggtgaattgtatgatatgtgaattatatctcaaagctgttgaaatcataaagtaaaataagctccctagcacacaggaagcctgatgacagccaatctctttaattttcacctcccactatttcttgggtcgtgggaggccaaaacaacaactactgatggcatcaaatattgaaaacttactatgtagggggccctatgtattaagcactttattccattcaaacctcacagcaaccccacatgggtgaattactatcctcactttatagttgagaagaaaaggaggcagggcataagtaatctgctcaaggtcacaggggaactgtgaagccaggacttgagcccaaggtggccaactccagagcctgtgctctgtgcaccaggctatgctgcgttccgtaaacccaggcaggagaggcggaggaaagcacagaggtgacactcgtgtcatgtgactacaagagtgaaagtgtgtctgataagcatctcagtccagctaagtgcaagctatggaatggtgcagattagaaagggggtaagaactggtggccagccacgctgtgagcctatataattcagttaacaggaaagctggtgcactgcaggccttctttgtcatactatgtataagtctagcataaagcaagtctcgtgccacatacagaaatggtatcacccatataaggcagttcagcttgttcatgtctttggtggtgtcattatttgagattaaagggttttggtatcttctttctgagctacttgatagcaggggctgtcatttgagtccttcttcccctaccacctcagcacctaacacctagcaggtgttcaagtattttaaagtaaatgagcctgggataacttatgtatttcaagagagaaggcaggaactaaataatatctaaccttttagaaatgtacagatgtggggccaggcatggtggcacacacctgtaatcccagcactttgggaggttgaggcaggagaatggctggagcccaggagttcgagacaagcctgggtaacatagtgagactctgtccctacaaataattaaaaaaaaaaaaaaaatagccgggcatgatggcctgcacctgtggtcccagctactcggcaggttgaggcaggaggatctcttgagcctgggaggttgaggctgtagagagcagtgatcatgggccactgcactccagcctgggtgacacagcaacacccccacctcaaaaaaaaaaaaaaaagaattaacagacagtatagatgtaacaaaactacctctgaggaacacaacaaacagctggcacaagattcaggagagaggctgggctgggttgggaggcgggaccacgtaggctgaggtgcatgcagtgaccttcaagtttctgagttgggggtgggctcacaagggttggatgttatatagaaatgaaatcaataggccaggggcagtggctcaagtctgtaatctcagcactttgggaggccgaggtgggcggatcacctgggtaaaaccccatgtctactaaaaatacaaaaattagccaggcatggtggtgtgcacctgtagtcccagctactctggaggctgaggcaggagaattgcttgaacctgggaggtggaggttgcagtgagccaagattgcaccactgcactccatccagcctaggtgacagagcgagactccgtctccaaagaaaaaaaaagaaagaaatgaaatcaatagaagagcatcctgcaaggacaggtgttaagtgtgaaccaaggaccatgactaatctagtgccgtgttatctgaggtccgagtgtaaataatatataaaaccacaagacacacagaacaggagtaaggccctctttgtgggaccaataatagaaaccacatgtagtaagctaaattgccaaatctaaaaacaatgtgggtagtttatataaggggtcctgaacctggagtccacttactttgaatagacaagatgtgctaatccctgaaactggacacaaaattgtatgagtgtattttttctgggaggaaagtttgctgcttccagattctcaaaaggattatctaaaaagagttaaaattagggttggagagtgaaagaatctgaagcagcagcattgcagcagacactgtgtgccatgggccatagaataaagtctcaggatgctctggtagaatggtgaatggggtgaaggcagttggattgcatcaccacgtgaatgagatcattattccccaatgactgccagcttgctgaagtaaatgaggccaaggagagagaacaatgcaacagaccaccaaggctaataccatcctctcctctccatgcctgactttcacaggaatgagtgacaccactccaaacatcctgaactttctgaagacaaccctgaaacccaagggggatatttttctggcttcttcccggtgaaggctattgattttgaaagataaaagtggccaagcaacacatatgggtatctgaaacagaatttttatttttaggaaccgtgtgtgagacactagaatgatggctcctagctggggagaaagggcatttcatgagcacaggtggaaagagttttgccatggatgaagtgacaaggtaagttttaatgtggaatttggaaagtggaggaagacacgtaaaatttatatcctagctacagtggaagacagtaaatatgacaggttaccacagaaggaagggatttcaaacctaataggaaaaaataaaagggagctggaatctcattataaatgcatggtctgtgagtagtaaacatcatgaatttgaaattataaaggaaaagtgatctcatgcaaatatagcaacaggcaggtacagtttgttcaatgaaagccattcagatggagggctcaggacagcagctctgtgggtcaagatgacttgacagtgaaccacgagttgctgtgaggatacatcactgcctgcctgctgatccccttcctgttagaaagcacaagactatacaagaaacagtggtggtaggggttccttctaacaccaagactatctggttcaacttaaaaaaacattctcccatattgaacttccctgttccacttagttaggctagacctcaggtctgcacagcagactgagctgacacaggaagccccttctccactgagaaacatatggaaatgtcggatacaacttaagttaaaaagcaaacaaagaaaagcctagccaaccttataagcaaaaggatctatccccagaaataaagagaaatttcaaagagcaaatagggggatttgaaaccagatggtgcccaggtggctacctaggtgaggccagcagtgaggcctgaagacacctcatcttgcaggaaactggtgctgtgccagaagcaaggaagggatttcgttaggcaaaaaatctttcaatgcatttggcttttcttgaacactaacttgaccatgtagtagataaagggttaacattctgccataggtgatctgcaggttatttggagtatgatggatggagaccaaacagttaaattcttatatggaaccccttacacagggggaaaaagcctcggatgtatccatctatatgcttggaactggaaataagaaactactggcctggctgggcacaggggctcaggcctgcaatcccagcactttgggaggccgagatgggaggatcacctgaggtcgggaatttgggaccagtctgaccaacacggagaaaccccatctctactaaaaatacaaaattagctaggtgtggtggcacgtgcctgtaaatcccagctactcgggaggctgaagcaggagaattgcttgaacccaggaggcagaggttgcagtgagctgagattacgccattgcactccagcctgggcgacaagagcaaaacgccatctccaaaaaaaaaaaaaaaaaacaaagaagaaactactggcccacagcagtgtggtatcccaccctccataaatctagggccccaagtcagatgaagtcctaatccatggctccttcttggtgactttaaaaacccaagaaccaactagcttttgcttttctccccagctataggttttgcttaacatatttcttgcatttcagagtcaatgcttttgacatcctcattttccaaacttttatgaaaacttgaaagaaatattaaaaatatgctctagattttatgtcaagccttgatttttaggtgctcctataacttcaaagtaatttaattatgcaggaaggttggtttagtaaaggttcattaatgcccaagacaacatgcctttctccttaaaggggaaaagtcttattctgctagagggctagattaaaatcaagcaagtttttacacttaagctaattgagaccaggggagccaggaatgaagtggtttcctgtcccgccatccaagtaacacgctgtcaggcaggctacactcactccagccaataaaggggcaacggcagcaaggaacgaccccacaaccccattttcatcgctcctctttccctcccagtttttactggctgccagcacaacccagtcaacagcaagctttcctttaccacacaggctttcctccttccctgaacctgctcaaccccagcctccattacaaatttccccattaaccgaagccaccaaaatctgctgtctgccttccttgccttagacacttctgaatgaattgtgattaactgattcaatgttcagttttgcaaaagggggaaaaaaaaaaaggaaggatggggaagaagctcaaaacaaataaagcaatcccggggttgtgctggagtgcacacggagcttctataggaaatgactttttactagtcccttaaaaaacttgcttaggccaagcagccactctttatctagatttgccaaaatctgttctccaggactgataacctacactggggtagctccgacactgggtttactttgaaagattttctccagttaccgccagctgcctatctgtttcgacaatacgtacatagttagcctacaggatcatcactgtcattcttttggacatgttcatttattagcagtcattcagatacgccgacagtgtatttgcaggggacacaaaaacacacacgcttatacacacatggtatgttagatgtttaagactgggaaaaaacttaagtcaaacaacacataattagcctctgcttgcagagatgagacagtttatcagactttatgacttctgttcccattccccagctcccccatataccttctactttcccctcagccccaatgcagatgaaagtttgccctttatttaaaaaaaaaaaaaaaaactttttctaggggtatagaagcttcagacttttgaactttatggcgtccgtgttagaagagtgacttgacatattctcaaccctgtttttcatcaacaatgcctgctcactgccaagtttagatgtgactttaaattgcacccaatccggcaaaataatatttcactgctggctaccagtaaagcgcatacaattttccctttcagaacttctgagccaccaagccaggaaatcttttggtgaccactccccttcccatttgtagagagaagccaatactcaggaccaggggctggacttggggaatacaagggttcctgcatttcagccagggctccctcttgccccaccgggaaactacccaggggcctgaacctgcaagaggtagacaggcactgtgagctgggccagttgccccgcttgtgctcctaccttgacatgtgctctggtcctccttgcccaagaggtgtggggatgggtgtggtggaggcacagtccggggttggtctcgcctgccgcacgcctgttcagtagccttttaatgaactcagtgactcagcgctgtccctcccccaccggcctcggatctcattcctctcaatcgcactgatgcccatgtgacagcacgttgtctccaccgagactaatcccttatcaataagagctttcagcacggcccagaccagattactctgtctcacaaccactttgctgacctgcccggggggccaccgaatactccccgagcgcatactatttacagaagagtcaagataagccggatcacttggcgtgattatttcgcttccaaagtttgtggctttaacaaagcaaacccacattcaaccactcaaccaggcgccgtgcaagccaccagaatgaaaaaaaacaacgctggatcttacacacatgcagtaatcaaaatattacaaataaaggctacatgtgaaatgataggttaagatgcgctctagacaccagatgtatggagtttgctattagatttctttgccatagatccagcgcaaggcaacatggcatttcattgtcagattaatgtggacataataatttataagaaggctttaaaaaaagtcaccaagattggtccttaactttgcccattcagattcttaagagcaaaccaaatttgaggagagatgccggacgccaaactgagtacaggctcaatatcccctattttccgtccttccttttccggcaatttttatcccactcatctctatccacagcctttctgggcagctgagatgaataagaggaatgagtataaagcctacaaacacggtcaaggagatgactgggagtaactacatctgtgcctagagaatggtcttgacggtttgcaagaaccgtttcatcagcattatgggcaagaacaagaaggccaaggcatacttaaaatcatcacaaagcctctttctagcactaaatgtgaagtaatgaagccatcacacagcagatgaaggcctttgcacacaaagctctcttcctcagaaaagctctattgattgatcttgaaatacagatttttagttctaaaactgtgtggatagctagttaaaattcactctctttccctccgaaatgcattaaaattctaaaacatgcaccaaattctaaaaattaagaattctaaaattctaaaatatacaccaaataaaatttatttttagtattaaaatacctgatgctcatttcatcaagtctctgttctctcgtctctgttcaacgcagttaggcagatctgagggtgctgcggagagtatctgaggagaaatgccaggcagagagcgagcaggccctgagctgcagagacaatgctccaggcagaaaaccatggctggcaggaaaccaggagaaattgtgcaagcgaagagccattccaaagctgttctctgtcccacggttatgatcacaggggagggtaattgcatctacttctgatcatattaccttttgccatttgtcagatagcagacctcaaattcaaggtggattagtctggaaaactaaacaatcagttttgaagtcttacttttatatccatccactgatcaatgcaaatatgaatagtacagaaaacagtcaaacacctaatgaaaagtggaaccctgcagtaactcccccgtattcaacagatgacagggctaatgcagggagtttggggctatggactggttttatagccaaagccacagataattccatcaccaaagactgcttcctacttttggtgaaggaagcaggtaatttacatgccagtctcagttttttcctcctttctctctccctcaccccctgccttactggtatttttctctatgagttcccttgatgtattttgtgttggaggacccagcctgcagctttcacaggaagggctgatgcagtgagaagagcaggatctaagaatcagaggaggtgggtttgagatctagaataaacagttaaaggcctagaggcaaggagcttcacttttgagccttaatttcctcagctttaatgagaacactacctgccctgcttgcttactaaacaggactgacctggtggtcaggtatggaatgtgggcttgtatcatagagaaggtggacaaaacaggatggagaaaacaaagtctgagcccctgctctgccatgtcccttgtggggcttcccttcctcttctaggctgcatttgtaaaatctgctctgtgtatctaccagggtcaacaggaaacttaagcaatgcatttgaagataaatattacaaaactgacgatgctatcagagggcatgttcttaccagtctgtccaaagactatgttttaaaagcatgaatagctctaaagttgaaagaaagtcttaaagagtatttttatattacactatagaaaaatatcttatttgctttaaataacgggaatctaagtttcaagtcagcagattagaggtgagcgggtagcgaaaccatgaggggtggcatgggtagatagagcattctcccaagtaagatgactgaagccagagctgatggggctaacaatgacgttcagtcaacgcagtgcatagaccagctttggaggccagggcatttctatagaaggctcctgaagccatgccacagagatgggtcctttcctgttgcttcactgcctagcccctttgtgagcatggtgagaagcctgaaggtggcagcaagcactgtgtgctggcatctgcagtgagcagtgacagctacaccactggacaactcaatcctgcaggactgctccaagactgaagttcagaatgacaggtcactacggcttgcagtcattgactcccaacacctcattttacatacaggaaaactgaggcctggcagcaaggtggaggcactttcccaagaaaggcagcatccaagctttactgagtgccctggtcctcggatgccccacccagtgtatactcactaccttgggatgtttccccctaactggaatcctattgttcacccatttgctcatatgtgtaatatataccatagaaccttaaaaattatctttgacaattttctcctcttggctttataaaaatctgtcctttccttatgcaaattattttccaaatatttaaatttttcgggccgggcccagtagctcacgcctataatcccagcactttgggaggctgaggcaggcctcccacttgaggccagaagttcaagaccagcctgggcaacataacaaaaccctatctctactaaaaaaattagccaggcatggtggttcatgcctgtaatcccagctacttgggatgctgaggcacaagaatcccttgaacctgggaggcagagattgcagtgagctaagattgcaccactgcattccagcctgtgcgacagagcgagactgtctcaaaaaaataaataaaaataaaattttcaggcactttgaggaaccctagtcttgaatcatcttgtacttaaaaagtaagtaaattaggtaatttattttgtgaatccttcgtaatatttgtataaccccttacagttttcgtaagctttccctcatttgatcatgacaatagctctgtgatgtaagcaagacaggggtcattacccttaattttggtggtattacagagcgatgaaatgattcatctagcaccagaactaaagtagaacccagttcttcccaacactatcttggtcctccttactccattaattcaaatgagagcctttgtgtagtgggcactgtagttggaaccaagggggcaaagatacgtaaaacagagttcagttttttccaaagagctggcatctaggagacacacatacacacaaaaaggttacacatgaatttgggggttagagactttggaatcagacagattcgtatttgagaccagacctcactgtttactagttatgcaacggtgggcaaatcattctgcccctttaaaccacagtggtcttacctcacaggattgtcaggagaattgaatgagatggcagaggaaagatgtttagcacagagtctggttcatggtaagcatccagtacgtattagctatttttattagcattaatacaaggcaatgacagagacacatgaaggctattaagagagcaaggtctggggacacctatcctccatcgtggagggtggggggtggggtgggcgggggcagtgtatctggaagaactgaatcttagagaatggctttaatgattgttcttacaaaacaatacttatctttgttcttttgttcttttcatctgtccatccacgtagttatccaacgcctacagtgagcccagcactttacaaaatgattctcagcagggctcccttgaataaagggttttcctagggcacttaaaatatgagcacatttacaaaaattatactcacacaccttttcagagttatacctactgagtgaaatgaggtatatcaatggtctattctgatcctagctagaggtaacagcttaagagaaacaaacctataaacagaaccttaacaagatgtcctttggtaacaaagtgaaaagtccttcccctggaggccacgttaaagtggtctgctgaatgagaaccctactctcatcagcagaggtggggcctgagctactggggacttcaatcgtgtctgccttcaccattcacttaaaagagggaaattatccagctaaatgcttactcatatgcaatatctgcttgtcaaaggtagcacagataataatcccatactttccactttgtatgatgattacaacttcctctccattcattctctcaactgacctggtagccaaatgagccaatctggataaagcagagatatagccaaggtgggctggcctgtgaactttcttttgaaaatgggttctgctactgaagatatgtatcttcaatacctaacatagtgacatatcacagtcaccagatatgatactttgtaagctggataattagttcaaatcaatcccttacatggcacactttgtgagaaggaagttggaacctatctgttcccctgatggacaagactgattcctttctacagagtgccttgaactactgcagaagaaaaccaccacccttcaagagcacccagaagctgtgtgcagctggactcctggaaggctctccctgccttgggatgctgccccgtataaaaaaatgtaggaccaggtcctctgggtaatggtatttgtgactttctttctcaaagaactaggttcttcgagatgggattagacttccattactatctgaaatgtgaggtgaagaaactgaaaaaaaagcaagcctttcaatcatgagaaaatgcagttgctatgatgccaaaatagaacactgtgtttttaaggtttctagaaactgaggcaaagaggagtcacagaaaattcagctagcaagagtatcatgaaaaaaacaaacatctttgtttcttaaatgctttagagagacactcttacctgaggaattacagttcctcactgtattactcaaaagcaatatgtccccaacatcatggccacaaaaacatagatgtagatttcttatgctctcaatatattacaattcgctagaaaattcagaggcctaacaccaaggtcagatcctgaagccattctctgaggggctaagggtcgtggtatatattgctatcatatagtagtctaatatcatccaaggattgatcctaaaacacttcaaaaaggaaattgatacaggctatctcttaaattaccttctatgtacatcatctctcacaaccagagtcttaacagaagctgtatgtccaacagagtgagattatattctgtttatcaaaggtctgggttctcccgagaggctcttacattccaagattgatgctctaagcaattcattaattcaagcataaaaaactcatctgattttagggaacagttgacatgtttacctaaagttgtaaaaaccagacttattaaaatgcctcagaagaaggcttcaaaaattatttccattctcaaaatgttattgctcccaattgtcatatatcaatggctccccagtcagtcatgctctgcctaagcaacattacaaaacatcagacggtgccgatggcaattccactgggttcctccaaacccagcccataaagcctacagaggaaatagaaagatgacagaatgcatacactttatttttgacctatcctgatttccggcaggctttggatatgggacgacttttatggctgcaataattttattgtaaagacccagtataggaatttcttctgggaaaatattttatatcaagttgtcaagcaaaaagcaaggtatgtttgttctcactccaagacaccactgaactcagagcaggaacacagctgttttcaaacattagactgcagctcctagtgtcagtgggtcaggagccttccatggccattcctacagggaatcgtgtacttcctgggatgtcatgtttatggtcgggctcccattgcattcatcttatttactctttaaaaagaaaaacaccaagtctgaccagaacaaacaaacaaacaaaagcaaaacaaaaaggggggaaagaaattacttaaatttataaatgatgtgtctagagtgctatttcatttttgcttataaaaatggcattcatgcttaaaaccgtctatcggagtgataagattggtatgatatggtctccacctgacttaaaggacctatgtttgagcgttgttgttctcttctcaccgcagccataatgtgatataccctatgacattcattaggctcttgtagcacacatttgacattagcacagggataaagtagggcagggagtgtggtgacagagctgtgggtgggaagagtgaagctttaaaccctcaacagtacaacttttcccctcccagagaagtgactctaaccaggaattacagggcctctaaatataccttcccataatttgtccatattctctcttccttcccaattctctcttaaatatttattctgtgttaatacaagtgtggtgttctgctgaactgggtggtggtttagaaaatgcatatgaagcccatatcttaaaccttctgttttagtctggaatataagcttaacaacatcttcccccaacacatacataaaaccataatcaatatgggacagctagtgtattagataaatgtgtatccccagactcagtgcaattgggattgagaaagggactgagaatggtcaagtacaggtgtgatgagaaatctaggtcgcatttgcagaggtggaaggaaagaggatgtttgggggaaacatgaacccaggtactcaggcaaacatgacacgaatgaatataggaagaaggagaatccaaggttcatgataccagggaagctccctaaagttagaaagttaatatctagtaaagatagaattacatgaacaataatttactttgaaagagtgttgcataggcaacagtatatggctgtcagttttaacctattttccaggagctaagatcgaccctaaccctaccttaccctacttacgtactccaaagatgttctgctgtcacttgaaagatgcttatcagaaggcatcatcattctagaaacagccacttcaagctcttgaccttccctcaactctaaaggctttgtaaattagctcaatggaggttagaaaagacttctcactggtgtaattagtggtgttagagatatgtggattgcctattaacatgatgctatcaattgactgagtctcttccaaattcatgttaaaatcctcatccccaatgtgatggtttcaaaaggtgggccttaggaaggtgcttaggtcatgatggtagaaccctcacgaatgggattagtgcccttacaaaagagaccccagagagctcgcttgtcccttctactatgtgaggacacagtgagaaggtggctgtctataaaccaggaagcagggccctaccagatgctgaatttgctctcgccttgatcttggacttcccagacttcagaactgtgagaaatgtctattgtttataagccacccagcttatggcatgttgttatagtagaccaaacagactaagacatgtagcattggacacttcatctgttgatgacagagatatgaaagaacctgaaagacccagccttactctgtgtaatggtgcccacagcttgattctaaaacaatcttctacatagccactggcttggggggttcttgttgcctaatgctgacaaaggaatcctgctccatgttaacttttcatgtaaggtactgtcagcatatctaaagatcagaaaacaggctcagtgactgctttttatgtagctgatgtttatataaatagcagaatttggtaaatgtgtacttttgtatgtgggaacacaattgaaggagacctttaactcattatctcaactactggaggttatcctaaaactccccttaattaaaaataaacaaattggcttagaggttagtttttagcacacttgaatgaagacatttattagaaacaaacatgaaaactctaacatttttagaagcatgaaaaattggagtagttatgtgtgacacatgcctaatagcaaacttttaaaacaatgcatttttattaaatcagaacctaaatacacacacagtaaagtacctctaattttcaaacacatggaatacatggcttccctgagagaatatctctaagatgcagtaagatcccagacaattatagaaagattatgtatttgcagcttagtcaagggcattttactaaggtctggcatttaaaaactaatggctgtttgataactaacattccactagttctctcaataataacaaattagtaaataaaattatgttggtacatacatatataaccaatctttatcaattcatatatagacaatacacacctatctaatactcaaaggcaagaaaaagccattcccctttctctacaccaagcagtatgatacacatttcttgctcactaatcttgaatccctagatatttgaacatgggcatttgttgctgacagccaccgccagacaaagctccatgacctggctccactccaggagaggccacagagagggcttcataccattcttggaaagcattcaactaccacatgcagcctcatctcacaccgaaaaaaaaagatctcacgttgcagacagcttcactataatgttaacattcttggttgttacacacacatttgacaaaaaatgcaagcctctagatatagccacgtttattgtacaatgccaatattgtgttcaaacacaaaattctctatcattttaggcaacaccacctgcagttttattctctcacttcccaacctcttaagccaaagaaatgagaaggtgctcttccttctattcactccccaacacctaaatacaacactgggtaagactcagttcctgcccacagggagctcagagggaggcattcctgtactttctaaattgcacaagatgtcactccccctctaactatggctaaaaggacgaaaaacagacaaaaacaaaatccaccttgctccagctctttaagctgccctcctgcctactaatacctttcattctcatccagttctgatgtttctttacctgtcatttactttaattacttcaaacacatgttctttctggttccagcgttccttctttcccaagtgtacttgttttttttgtgtgcgttttaaaattctattctgcaaagcttgctttcccatgaaacccagactgttttctacaggattttgataagccaaagtgttgctgtcacacgcaatgccattgctgctcctatttgcctctttcctagggtctctgcaactttctgcgaaccctctacacacctctctaactttccgctgaaaaagtatgctcatagaactaggaataaacattaaagcaatcagaggcctcgaggaactaagtttagcaggctaataagaaataccacaaggggttaaaatattaagcagaatgtgaacactgccctaagagttacaagtgccatgcaggcttggaagggggagataaagaaatctgttttttagatgccatgtgaaatgcaaggcatggtggtctcacagtgttcatggctttcagtaaaggctcataaccaccatgacccttcaggcagttcacagcaagcagtgtcctaataaaaatatttagtcataaaagagaacaacgacataacctgaagactgcttggacccttaatgatgaaaggctgactggctacactgacaagcggctttgacaacctcacgtcaaagcacgcgggtaagagagaaaaggcaagctcagggctcttttcagtactgagagtggtgggcacagtagctctacttccctgtttctgaagctgcctgcctaaaaagtaaggttggtttctaattcctgacacgtgttctctttcatacccactcacagtgaatgacaacttccctttgttgcctctgtcactcagaattctgtaattcacttacccaaagctactttgtccgaaagaggacagacaaatcagctaatccttaagtccttttcagcactaaagaatttccctgcagggtgcatcatttattttttttctccacttcctaagtcctcctcattcctaatgcaaagaacacaacatgagggacccaatcagccaagtccagaatttgtaggactgatgttttttgcaatagtattattgtctctctcatttccctcctcccacccctgtccccatattccggacttaaaatacaaggtcacgcacaatggtgtgaattaacaaaaatccaaggccacacactgagcagctccaacttcagccatgaaaagcatcctgggctacggccaatgccctcctctcattcccctggtgctgctttcaaagccacaaagaacgacggagctgagaaacagccccactcaaccaccaggccacatcccagtggggagacactaccacatgctcagtcctctgcccagagatcctttctccaccacattcacaaactctgtttaatcaaactccatgaactgagttgccttgcgtgttcattcgctgcgctcctatactgggtgccatggaacaatggtagatccttgagtagcttataggcaaacttgagaatctaagagataaatacttaaaatgtaaagtgatgtgtactagatcataggagggcatgagatcctatagcaggctaggtttgtttcttgactccttctgcttcttcatccaagccccagccttatcagtatcagtgcctaaaggcttctgcagctctacaccactccaactttactcactcagttcaagtcatcagcatcctcctcccagatcacttggatctgctaattgttcttaccacttctaatctcaacaccctccaagccattttccacactgtagccaagcgcaccttctaaagctcaagtttcatgtggtggcctgcccattctccatgtaaaaaatatcagacaatggctcctcattgccatcaggataaagcccacattgcaatgccatttgtaaccccttctaccttccccatgctctactggcacctggttcagccttactggaaaacctgcagtgaggctgaacctccaaatccccatgctcaaccctgcccttggggctttgcacacaaaccatttcccttacttggaacacaatccccatttcccttacctggaacacaatcctcatctctcccaccaccccctttaccctttacttggctggctactgccagccctttaagtttgggctcagctatcacttcctccagaagcctttgctgacaaccctaggcagaggtgaatgcatcctctttaggtctctgctgtcagacttccatgttcaactacactgtattttagttgcttggtataatagcttgtctatttcctctactagacttcagacaacttggtggggggaggaaagggagattagaatggaaccttaagagatgtttcttaatatctgttgaaaaaaggatctcaagtatgacttgtttacctgtgtatctttgtccttagcatagtgctggctatggtttgaatactgcacccttcaaaattgaggtattgaaactcagtggccaatgtgatagtggttaagggtgggggttggtctttgggaagtgattaggttatgagggcttttgccctcatgaatgggattaaggctcttataaaagacggttcatgggctggcgggggagggcggttcggctgacttgcccttctgcctgccatcaagtgaggacacagtgttcttcccctccaatggatgcagcatccaagccctcttagaagcagagatcagaacctcagcagacaataagcctgccggcgcaatgatcttggacgttcccagcttccagaaataataaataactttctgttctttattagttgactagtttctggtatcccattacctctcccttcactacgagagagcctcagttactatctccaggccaagttgaagccattagttagtcattctacaaatatttagtaaatgcctacactcagtaggggctggaatgaccacactctgatctctcaaagaaaccaccaatcgctttgttgttcaatcaaaactgttgtttctcagttatatcttgtttgatggcaagcccttctcctttccctgttccagaggtcaggaaactatggcccatgagcaaaatctgaccttctacctgtttttgtgaataaagttttattggaacataggtatgccccctttatttacatagtgcctatggttgcttttgctgcaaaaatggcagaattaagaaattgcaccagagaccatataccctgcaaaaactgtaatattttctgcctggtccattacagaaaatgtctgccaacccttgccctacctattataacttatgggtttccttcctacctttgtgactgtgactggacaggctcttgttattctgctgcccaatgaaggtataagaagtcctaggaacactagctccccaggattctgtcagtctgctttttaacctgacacgttctttgtctttctaagatggttcccatggcccctgaacatccctccatcagtgacctatagtataaataatctgtaagcatttttgtcttccccaacagacgtggctccttgaggacaaggcccatgtcttacagacataattcagcacagtgacaggcacacagtagccatcaaaaaatgttaactaggtagatgagtgtttacaaggtatttttaaaataactatatttaaaggctcctgacaaaatgactatatttaaaggctcagccatagtcccttggtgagaacacagtcattcaactgatgaaatttctattcttttgtatcagttttgacttgcctatagatgggtgacaaagtagaaaccccgaataggggatttcccactaggataagggttgaaagtctgactcccgttcactagctgtaggatcttagttaaggtgctcactctcagttgcctcctctgcaaaacgaagacaatgaaataattcctctatctcacagggtggctatgaaaccaataatatgtgtaaaatgcccactacctttgtcaagcaattttggtgctcaataagtagaaacaattattactatggacaaagtcttctgccttaaggctccaagtacactgacaatgaacatggctagggtcgtctcagctatgttatagcatcacacttgatcttttcatagcaggagccctgattcaggtggtagtttcatattttaaattatgaaaacaagcagctaggtcttatattaatactaatccttcaagataaaagaccaaactccaaaggaggagcttctctctctctctcccataaagattcattggttaaaaagcactagtggtgatactaaattgaagcatcaacaaactgttctgtaaattgtcttttcctgatagaatttaccataatttgttttttcagctatagcacatagcttggaatgtaatgcacacattttgaagagtagacattttgataatcaaaaggacaatattaagttgattttttatagccttattactgcaaagatattattttctaagctaatgtacatacaaaacttcatctttctttaaaggtaagtacatgggggctagaacagagatacttgagttttgtatgcatcaaaacaaaaacagggagtaataccaacacatttagcaaaaagtaaaaaacagatcccactcgtgtatgaaaatttttggaggagctgggaatcaaggaggaaagtggggctccaagctaatcagggcaaactctgccttccacctgtgcccctaatctgatgctccggttgcatgacatgactatgacggatggccagggtgctgtcgtttatcttttggagtgaaaccggagaactcaggcagagcccagtgagcacttctcatgaaaatgctgtcctatctaatcccaggagacaagagaaacactgagaggtcagaaaggacatgagcacatgagtgtgcacaccacgcctgtatgttcctttcctcttccaacacattttcggggactgaggaagtgtgccgcacatatcccaaacagaatttctcagtattttctgcagtttgatctgtcccatgctgaccagacactgtaaatagtttagtttagaaagaagccagaaatcctaagtgagcatctggctcttaagaagccagaaggatggttgcacgggggtgggggtgaggtgggaaactggggggagtatggagagtgggggggtgggggagccctttacccagcttctcttactcacgagcactggcgacaagcgacattggcttatcgcctcagctaggataaataactctaaatgtgtgctgggtaggagctttcatgccctggccttcaatagttttattctttcacgtctctaacgtctgcagcttcctgagattggctggtatttttgtcactgggctttcgggctgggggctgggcagagctgaatgtcaggcaagggtaaagggcacctgtgatctgctgagtgcctccgctttctcctccttgttcctgacattaccgcccgctcaaccaggagggcagaaggtgggtcagaataatcagttaagtgtattagggttttctcctccttcactacaaatcccacaagtgcaactaatgagacaatgcccagaggtagaaatgaacttcataacaccaaagtacgggtgtatttcaatttatgcgagttaaaaaatgttaaacaagaaaagcaaataagtctcagagctgttttttcacattacaaatggaactcaatacagattttagaatataaatatcctctcaggcatttaaaataatgtgttcacaaggctttgatttgcacatgatgttggcaatatcttttgtgcaagatagacttggggaaaaaaatcctcagttttaaatttttagttactttcaaaataaaagatgtaaattaataactattcttccgaatagaaggggacgcattataagaatagcttttgaaataatgtagaagaatatccacagaaattctcaacatcgtatggataatatgaaatccgtgttttgttttggttttgaatgggagtaaaggtgaagagtctaaaaaaagaaattttttaaattcctgatataacagagaaatgcagtaaaacagcaggtttcaaactgtcctctggctctcgagagtgtttccaggtttctacaaacaataaaatattggctgttaaacccagaataaaacacccgagaagataataacaagttcgctgcttttccttttgggttgttttaaatgttggggtgctgaagatttcatttgaacaaagagttctgttaccaaataagtttggaagctattgtttgggaggtgccgtgcagtctctgtacacaggaaggttaaaggaaacggcccttggcaatgaattctggaggcccttcctggggggccctgaactcctgtgaggacttccaataaaaagtcagtagcattaagaatcagcaattaaaattcaatgatcagctgctatgtttaaccacaaatgtatctaaaaagctggtgttaacatgtttttattttcctaatagcttatttgaaaaaaggtgatgttaaaacaggatctcaaaaatagatgattttgtattacgttagtaatagtatattattgatagtctataatcattgctttaaaatttcaataataggtcccagttggaggaccgtataatgaattcccttataccgattttctctacttttgtatatggctgaaactttccataataaagtgaggtttgttttcttaaagtcccagcaggccagaaactatgttaaaggctaaatttcatgtccctcaaccacagtggacaaggtttagaggagtgctataaagagaatattgattcctcttcatccagtccaacctggccttcagaatgactcccactaatgtttttcctatgccattttctactgtataccacacacccaaccaacttggtacaaataaatgtgactcacaacatcctcccggtcagtgccaaccccttattgaaattagatagtatacatcctccgggttcattctttttctaagttaatttggctaataaaagtcctttacatttccatgttaactttggaatctgcatgtcaatttctttttcttttttttttttgagacggagtcttgctctgtcaccccggctggagtgcagtggcgcaatctcggctcactgcaagctccacctcccgggttcacgccattttcctgccgcagcctcctcagtagctgggattacaggcgcccgccaccacgcccagctaatttttttgtattttttagtagagacagggtttcaccgtgttagccaggatggtctcgatctcctgacctcatgatccacccacctcggcctcctaaagtgctgggatttcaggcgtgagccactgcgcccggccagcatgtcaatttctactgaaatgtctgctgagattttaattgagatctatagatcaattgagagaatttatatcatagcaacattgagttttctgatctatgaatacagcagcttgctccatttatttagatcatttcttttattaatgtttgtattttttagtgcacgatcttgcacatctgttgtcaaatttatctctaagtatttcatatttttgacagattatgatactgttttagaatttcaatttctgattgttcattactagaatacagaaatataatggatttttctgtatttccttggtatcttgtaaccatgtaaaattcacttattagtcctaacaaaacagttttctttgtagataccgtaggattttctacacagacagttatgttatctttgaataaagaaatttttacatttccctcttaagatctggaagccttttattgtttttccttgccttactgcactggctagaacatctagtgcaatgttgaacagacgtggtgaacacttttagttggcacctaatactaaaagaaaagaagcagtgaggccgggcatggtggctcatgcctataatcccagcacttttggagagcaaggcgtgtggattgcttgagcccaggagttcaagaccagcctgggcagcatggcaaaaccatgtctctaccaaaaatacaaaaagttagccaggtatggtggtacatgcctgtggtcccagctactcaggagactgaggtgggagaatcacctgagctggggaagtcaaggctgcagtgagccgtgatcgtgccactgcactccagtctgggtgacacagtgagacgctgtcataaaagaaaataagagaaaagaagtggtgaacacagatgtgcttgcatttatcccagtctgggtgaaaccacgtttgcaaaaattgtaactgagacagtgaaggagacctgaactaaccaactccatctgcttctaaccttcaagctgtctttgtccattcctgggcacaggacaaactaactttgggaggaacttagtttatggtttagctttgaaacgaagatgataacagccctttcccaaaacaattccccttcctgcctggggactggactgcctttgcaggactaacaaattagtcataagattagaaattatggtttaggaggcatgcaactggaggctatgagattttaaacctctccaaattgcttctggcaataatattactattgtaaaacctaagatcagtggttgagatattttgcagaccctgcactccatggatcagctggcaccacccaggtggatacactggctcatctggtcttgtggacctgactgaggaactgactcagtgcaagaggtcagcttcaactccctatgatttcatctctggcttgaacaatcagaactcccgattcactgccccccgcccccaccactaaattatcctttaaaactgtgatcctcgaacatttgggaagactgatttgagtaataatacaactccagtctcccacacagctgactctgcatgaattactctttctctattgcaattcccctgtcttgataaattgtctaggcagcaggcaaagtaagcccgttgggtggttacattaggaagggggagatacttttggtctttgttatgtatattaagatgctggctgtaggttttttcatagctttctggtgtcaggttgagaaagttccctctattcttaaattcctgagagttttgagggttttaattttaaatcatgaatgcatgttacattttgtcaattctttttctatatttattaagattcttgtatcactcttctttagtctgttaatatggtgatttacactgatttttgaatactgaactagctttgcgttgccaggattaacctcactttgtcatgatgtattatcatttttaatatattattgggtttgatttgctaaaattgtctttttttacatccatgttcacaaagatattgtattgctctgtacttttctttcattgtaatacattttctgattttggcattaaggtaatcttggcctcataaagttcctaagtattccctctacttcaatttttttggaaagaatttatgtagagttggtattatttctttcttaaatgaattcaccagtgaatctaggtcctatctttagtaatatccaaagtcacaaagccaactacaactcatttgtcagatattaaatgtattaacaggataaaaatacatttgtaatggaatgtataagaagaagagattaattctcactgggggagaaacgaagagaatattcaaatcacattttgaaatggcacatatttctgttgtttgacttatggggcaatgatacagtgtcaaacactctgctaggagctgggaatgcaaaagtgaccaagatacaacccctatcctcaaggggaccactgcacccagtgcactgtcaggggaaggagatatggtaaaaagaacacacaaccctggggtaggatgtaggagtcttcaaggaaggctctcctgtgggtatgatacctgagccaatcagagattacaaaggcgaagaaggcaaggactattccacccatcattgcaactcagcacctagggctcagatatttttctgcaggtgagctttgccagactactgtgaggaagtcaaaatgtgtatcccaggcagccaggacttcattgacagggacggtgacacacgtataaaaatgggacgcaaacgaagctgtcagggcggcttccagtgtgatacagggagtgcaagaagatgaggctgagaggcaggcaggagatttatcatgcaacgtctcatgtgcctagggcagggcaatgagagcagaagttgctgatggcccataagcatgttctgtttgtgaaatacttgaattaattaccaaagtttaaaactctgggacttcacaaacaaagttgggtttttgccttctcttaagaacatctagccatacaaaatccatgatccctagagttgaaaagtacctgttccccttggagctcttctagttctccaaggtctcaacatattctggccctggggatgcgtttgaatttctgaaactgctattagataacatcactctggtgatactgccaagcctgtaacaggaagactggtggcaaagacagggcaggagatccaacaagtctatattaaggcagtggaagtagggactggaaaggaagagaggctacttgagaattttttttaaagcagggattaaatggtaattcgataaagggaaagggagagggagaagtcaaagttcctagcctagaccacagaatgaccgatctacaaagaagggcagaaactggtaaactggtcagggcaagaggagcacaagggcagagaaaatgatgcctcatttgttcataggtttgtttctgttacctggctagagatttgacatttaaccaacaaataagtacttcattttcagtacatctagcccaaaactggcactccccacaaaccttctgttccacgtactggcattttctccctgcttgcaggccaaggactcctagaccttccccatgtgaatcacaaactccttgctctgctgctacaccaaccagcaacacttcctgggactcaccatttcagatcttttacaaacaataactcaaggaatgctcataccaattcttggaggagtaggtattgttatatagtttttgttttgttttgtttgagacagagtctcactcactcactctgtcacccaggctggagtgcagtggtgtgatttcggctcactgcaacctccgcctcccaggttcaagtgattctcctgcctcagccttccgagtagttgggatcaggcacgcgcgaccacatccggctaatttttgtgtttttagtagagatggggtttcaccatgttggccagactggtctggaactcctggcctcaagtgatcagcccgtctcggcctcccaaagtgctaggattacaggcgtgagccactgcctctggccaagtattgttatatagtttttatagtgaatgcatgccaactatttttctttattcaaagtctgaattggaggggcctgaaacaaaaacgcctgttttcctcacaggaactgccctcgtccttaagcattttctaatggtggcataaccactgaatcttttaacagcactgtgggaagatcagaagactttaaaggctcccagacttggtcaactgtatgttttcctctgtgtaaattccaaaagtatcaccactaatccaaacaacagctcttcaagcaggagttaatagaggaaaaacctcaactgaaaggtcaggaaaaggactttcctgaagtacaaataatggccatgtgtggttgctactaagttcaaatcttttacagatgcaacaagataagtctaagttcacactcctgttcgcaaaaacaatccaaccagggaatacgaaaatgactccttaggaaaagatttgccacatcatcaattacatagggcagacaggctgaaaattgaacagaaggtggtatgtggaccatgatctgagaggtacccagacaggatataagaaatgtaggagtggtgaccctgttcctagttgatcttatactcggttaaaaataaaaagaagctgaagaatgaggccacatccagaagagccaagcgactgacatgtctgtgtaatactttatttatcatccaaagccttatatacattgctttacttggtgacaacctctgagctgagcacttccagattcttacatagagtcaaagatgtcaacatcataacactagttccgatctgacttcacgtatgacacttatgtgttttcctgtatattctgttgaactaattttattgacgaattttcttctaaaattaccctcaacgtattctgacagccaccaacctaaagatctcagttccaatccacccaggcagtcatcacttgaattctgccaccatttagaattgctctacctctaagagctcagtgtcaagattctcttcttcaacaaaaacttctcaaccacccttccactttccccacctcactcttactaaactttctctgggcctcccgagttaccttctggaatttactgaaagctggtgacactgatgacattctcctagtcattccctctgaatactcacaccctcatacagcctgaacttaaagagtacttcatgaatatatgctccatggagtccttcacctccttgatcttctaacacaattacagtaagaggataagaatcactacccaggaaacctataccaggcacctcctctgttcctggttcactgacatgtgctgtatagtcacaaacacaggctcacaggcatcccaggaagcagtgagaacaatggaatgtcagaaccagaaaggatattaggtgattacatctgatgtcttgactttagcgatgaaaaaaccaaggttaaagtgagagagctggcaggtggtagaggtaacacaagaaacgtcttgggccaggcgtggtggctcatgactataatcccagcactttggaaggccaaggcaggcggatcacttgaggccaggggttccagaccagactggccagcatggcaaaaccctgtctctattaaaaatacaaaacaaattagccaggtgcggtggcaggtgcctgtaattccagctacacagggggctgaggctggagaattgcttgaacccgcaaggcgaaggttgcagtgagccacaattgtgccaccatactccagcctgggctctgtctctaaacaaacaaacaaacaaacattttcttcccccaaccccagaaagctaacacaagaaacctttctggagaggaaaaaaagttttattgggataaatttattctattccatggaatggaactgaggggccaggatgggaccaaaaacaatgactcacaagggatgaatgtaactggaaaggcaggagccatgatggagaaaaatgagatgtgctcagattttagtttgcagtcaacaggaaatcaatgaacatatctgcacaggagtgcaacaaggtgaaaagattcctggagaagtgttgtggcacccacgcaaagaacaaaatcaggctttcaaatgacagcttttattttcaaattaaattatgtgtgtgtttaaatgccacaacatctggaagtaactaacaatttagtttgaggggctagggtcattaactaccattttagaagaaaacatgttacaatttaaatgatttccatatgcttttcaggagcttaaattaagctaattgaacactttcataaaccaataaggaacaacatcccttaaaaatgttgaaagtatttatctctaggatacaaaattatgggtaattttagtgtttaaaattctaactttacaatgttttatctgtggtattatttatcactgggtgaagaggccttataagatagtcttgactcaggcctgagttcaaactctgtttctgctattaaccagttgaatgatttcaacttggttattttaattaccttaacagttttgacatctgaaaatagggataactatacctgacttgtatattactgtgaacaattaagaatgtatattttgttatttgctaaggataaggcaatgcagttatgacagggatatttaacagtagcagagacacccaggctcagtttttcttttactttttcgatgtgatatgacaacttatttctaaaagggactaattaagtgactttgtttagcattagagcattacaaagccttaaatggttaacaaaaattgcccataatatttctctagacacatttgagactcttgaagttatctctacctattatcctgtttctagagcaacttctatcaatggtatcccaacaccatcttcaaagaatacgtttcacagtatcttcattgcaccagaaaatataagtctgttcaagtctgccaaataatctggtgttaggcactataagaagtatatagccataccttagataactcaaacacccattttccacatatttcattcctgaagtagaccataatttatagtaactcgaattatttacatggtgccttccagctagagaacatggttctcaaatttgaattcagctcctatcctatagctgtggtgcttattcattcatgtaactaatatttgtactttaatgatttatagaataatatcccttccattttaaaaaatctttaaagaaaatcatatgtttctatagacagtagaacataagcatgtctagaacaaacaatatggggatggcttataaatttttcataagcaagatccaaatcttaaaactactgtataactataatactataaagtaggagatggacgccaaacacattccattcctataataaaagtaaaaagtagtctcttttcccctacaagatctatcattttccattattccgcattttttagacctgccatggaaatcctacagtaaagacaatctgtaaaggaagactgctcatcagctgtcagtctgatctttcattcttggaccaatgcatccttctagttaacggctggtctaatttagtcaaacccaggtattacatagcaacagatgatgctactgtcaacgaaatcacaaggtatatgctttagccccaatgagcctgggctcaattaaacttaatagatcagagaatttgcctacttaagtaggtgttgaatgaacaaatttgcttctaagaccacaggagaaaacccttaaacattctgaataggtacagggcctgctatggcttgaaaatggtttgttcccaccaaaattcgtgttgaggcatggtttctaatgtaatggtgttgagtggtggtgggaactttaagaggtgtttgggtcctgagggacccatgctgtctcgtgagaatgagttcttacacacacacacctaccatacacacacacacaccaccccccgaatggtgctggaggattcaggcagtggagggagtggtaagaagggtattgccagacttacagaaagctccaaacggcctcaatgttaaggtgacatttgagtagacctataggaagtgagcaacaagcctggggaaagtgtggctctgagaagttgttgttgaaatgctagaggaacagcaaggtgaccaatgtatctggggcagcaaaaacaagaaggaaggtggaggtggtggtaggggtagggtatagatcatacagggcccactttcaggacttaagaggcttttatactgagtgcaagagaaaaggggttttgagcagaggaataacatgaattgacttatattttaaaagaatcactcagctgctgtggtgagaacagactgtagagggtaaggatggatgcagagaccagttacaaaaacaagaaacacggagcaaataagccatcaaaaacaggtgacacacacgctcatagcttagctgtgggtttggtgacagattactgtggggtatgaagaagaagaatcaagaaacacgtcaatgtttttggccggaaaaatggaaggattgggttgccatttacatatatgggaaagaatgtggagtccagagtttgattttatcatgtttagttttaaatacctattaaacactgaagaaaagatgaagaggcagctgaatatgagtctggaattatggcctgggctggcagtatggacttagaggtcagtgtttggatggttttttacagccctggcactgggtgagaagaggtggaaggacagggctttaggacatcccaacatggcggatggggaggggctgaagaatcggcagagacgaagaagggatagccagtgatgtgagaaaacagccaagagacagctgtgttctggccacactgttacacctgaactaaatgcctatttaaaatgttcagaatctgaaaaaatactgctgtttctttaaagaagtataaggttaaatatcctgtaagtaaatacttaatgataactaatagcaaccagaaactgcaatcagatgtttttccaaacacctagtactgtgaaatatcagtgatttcaattaacacgcaaatggaggaggttagcttaaaaagaaaagatgaaaagttttcaggtcagcaaaagtgatcctcctgaggattactggcccaaacttttctaatgccctctgcatgggtttaggatacaatcactccggcaagtgtttttagtgatctagagaactattttgcaattacagtcatgtgctgcataacaacattttagtcaaagacaggccacatatacaacggtggtcctgtaagattgtaataccacatttttactataccttttctatgtttagatatgcttagatacgcaaatacttaccactgtgctactattggctacagtactcagtactcagtacagtaacatgctgtacaggtctgtagcataggagcaacaggctacaccatatggcctagatgtgtagtaagtagactgtgccgtctaaatttgtgtaaggacactatgaagtttgaacaactgatcccctaacaacacatttctcaaaatgtatcccagttgttaagggaagcatcactaccatatatgccgcatttctgctccactacaatcttctctctagctaatgtgtagtcaaaggatggaagcaaattgaaatcttcatatgattctcagtccccagtcaagaagatgttaaatagtggattctaaaaatggccattgtagagttaaattgcctaatcctttttcctacaaaattagggcagcagtaagttttgtttttttgttttggttttttacttttactgttactggatgttaacagttgctttcatcatttaaaaatatcttcattaagaattcaatttgaagactctcttaagacagctaacacatcaatgtccttgaaatatgacttttaggtcatacaattttagataacagagggagagggagaacttatatctcatacataaacaacacagaacatcaatgtgttttcagaaactaatcaatgtgatatcacaaatgttaataagagggccctaatcaaattcttatatgcaacattgcccatcttatcattccttctagcataatgagctgaaagctataataccttgacatttcttcctttaacagagagaatttttcacactgacttttcaattcagcaaagctatactgatccaacaagaattaaggatctagtccatctaaagcagtaaaaatatattaacatagtctaatttggaaaaaggtttactcttcctatatttggaggatacaagttaatgtactattttgcagatataaatatgtggtgcaatgaggaaagaatcccagtgtccattttcacctcagttatgtgaacctagctacatgactaccttcacatattgtgatttctctaaaatgaaaactaccattccattgactttctcttcaatcagttgagctgtattactacagaggattgcaaaacagaccattatctcaattcttattatcatgctcctacgtgctccccataccttaaaggaattttctgattctaaagagatgagcccgacaaacactcccccagctacaggaatttcttggattgtagaactgatatactgcagtcaaaaattttaaagacttcattctgaaaagcaaatcctcttctccaaaactctaattccagaaacgtttcctaagggggaaaaaaaatctcaagagcttgaccttaaatcactggtgagaaatgcagagtaagccttttttgttttgttttttactgaggattgaggtactaaaacatttccctatttcagtgcttctcactccctgcgagtctctcccttttaccataagaagagagtttcccagttttagaaatttcttaatgtcacacttccaactctttaatttaggagttcagtttgtattacattctcacacatcaccagtaaatatgcttccatctaaaatctgtcttaggacacaaatccttacaaagtggtgtccttttgtttcagttttgtaaattagatattcttaccaagttacaatgaaagagacctgctatttagccagatcacaactcagaatattcatatgaccacaggacatgggtgatgtttcacccattagtcatggctgtctcccatgttcactttgttcctacaggcaaatatgttaatgagctttctcattaatcctctttcccccatatcatctctaaaatggaatttcctcctaggaagaaaatgtcaacaaattttcttgacagctatgaaagttacaagtcatgtctctaagatagtcgtgattaccaatttgccaatgtgtctgaaagaaatagcaaaaatatgtattgaactttgagacaaatatcatggttttgctgatatccagtgggtttttgcaagctgtcatatttattataaggctatttcacatagtcagtgttgccaatgaacatccaaatcattgtctaccttagtagacttcaactctattaatccccagtaatctctagtttttactatatatctgacaacttactgacactaagttgtacaggacctatataattttgaatctaaacaacctcctggttttataatgtagactcaaactatgaaatacaattgcctaaatagtttatcaccacctcaagcacaaagatactatgttatttgttaactagctttcaccttaaagcaaactctaaaataaaagcaaaaataaaatgtatcacttttaacattgaattttctaaactccaggggaaaaaagaacaagcatgaaagtcacatccatccacagtgaagtaggaaaacaacatatccagaatccttttcagatttgcatttctgcttaatccatttaatgtagtatggttgtattctatcttccaatgctgggatactgggtctcagtggatttcagtgggtgaatgaggagtccagttacataattttggaatcaatcttccagaattggatgcctgaacactagcacataatagcaacaggccatgtgagtcaacatgtccacacccttgcccaagtctatcagctttcaggcatctccaaacactccctttgccttcctattctgaattcgcacgcccaaaaaagctgagatcagagactctgtcagtttacttggtagttttttcacattaactttcagattcagattaatgcataattatacacacatcaatgtaccaacacttcaaaaaacctttaatggaaagtactttgaaaatttattaaagcaagaaaggacccatttgaacacaagaatacagaattgcaaattaagtataattaatataatatttatatgaggcagaactttcatacggatctttagaaaaacccagactcttcaccatgtgcagagtgctttaaggaggcttggagccagatggtctgggcttaaagccaggctctaccagttactatgtgacctggggcaggttccttaaattctgtcttctcaactataaaatggagatgatttaaagtatctacccaggagcagaaccaggattggagaagtctgaagcgtatggagcaggcagttattttcaaagacttataatcttttataagtcttgttacagggctaaatgaaatacctgtaaagcacttagcaaagcagccagcaggcaggcagtgctctataaacctgactatcactaatattagtgaagagaggaaatgagtgttataggcccatccactttatctgaggctatcagaggagaggaaacaagcttctttgaaacaaactgttttggaaccaaatggaatatttatttacatggcaagttatatcggcaaatgtatgtaacacctaccatgaactgcaaaagctgaaaatacccatattaagggcggaaagttgccaaaaggtttgatgttttcctataattatcttagataactaaatgtgcatctcaaatgtctaccccaaatgcctctcaatgtctcagactagaatgcatgaatttaagaaaaggtgaccaaggtattcatactacctgctccaaacacaaatatgaatgcaatgaagtttccttaaaacttgacagattctctgaaaccctgggtatcttaagccctcattccaaggaacaatctaatgattgagaaaaggaataaaatggctatttctttgtgatttatagttttggggtgatactaactggcacatatgtgacttctctctcctctctctcactgtccctttgtctccctccaccccaactccagccagatggcaacagcatgtcagaaacatttagtattaaatcaacatttccttgagaattagattcaaatccatcctgagtcacctaagatatatttggctgccccaaatccctagattacaaataacatttaatcctaacaactatgaaattttgtcagtctaacagatggtctaggatgactctgtcagaagcaactctgttcatctgatcattctctgctcttaaatggaaaagaactcataggatggggagacaatggaggaaaaagaacagggagatacagtgtatatgcaaaagagtaagtcctaccactctctaccgcaaacagtggaagggaatgttctgagccacttgtcattaacacagagtttaaacttaaagctctattctgactagcaaataaaagaatcacaggtgctcaatatttgttgactaactaaatttggtggtgcttattttcatgaactgatagtttgtgaaaatgaaatggcctaatcattactttgatgataaaagacattaaaatatatcaagaaacctatttattatataatacaccatcatgatactgaaaattacctttaaatgctccatggtcactttcaatatttagcatatatgagatggattcttcacattactataagtcttaaatcttatataaaaatatataaattttaataaaatcaagggtcatgatcctagcaagccaaggaaagctctgagagcaacacttcaataagaaaatgcaatcagccttaccacattcttcctttgtggagtgtgactagaagtggcaactctgcatcagatcacagtagaggagcacactgcagcatcttcctatgcttcagcatgccagggaagcccccctagacgggctttttactaaacccaaatccctcaaaagaggtctctatctctacccatagtttccaatttccctttaaaaatacagaaaaacagagaatatctgttgagtgcagatattatatatagaaaacaactagagttaaaacaggactcttcttcctgcccatttcctcaaggaaactcagtgctccacccagccttgtgcataatactatacttcttcacaggccccagatatgcagatgacaaatagaacacaagctactaaaagcagtggcaggttccttgttaaattatgaactcttgggttctagcaattcagtccaaaggtagatgaaagagacaaaaatatcttatgaaaggagataaaaccaaggcttgatccaattaggattcttgagttcgctgccagaaattcaggtggtaacctcagtcttctggcaaacttccaagagcatgcgattaccagtgatgctcctaaaatgttccttgtaagttctgcttttcctaggctgtgcccagcagattttctggaattgtttgagtgagctgattctgttcctaaagctgcccgaggtgaaaggtgccatataaaactttaaactgctccacaataaaaatgggctttttaaaaaatcaattgagagaacaccacaaaactctcctcatcctttttcacttcatattctgggttcttcaaaagtctgacttcaatgcacttgagaaatgaatcaaagaggaatttttctctaaataaaaacactagcctctttgttaacttagattccaattatcaaacacacatacattccatattacttccccaaaggaatctccaaataatttttatatctgattagactatgttagtgcattagtttcttcattccactaaacaagagagaggtaaataatcctcagaggaaaacatcaatttaagtggaatttagcacttgggaatgaaaaagatccaactctatcatgcatacaggaactgagtggggaaacacaaataaaatggtgaatgtggatttaacaatcctgccatttgagggcacagtgcttcgcaactctctcctggcccatgtccctttatgataaaactacacaaggagattcagtacttggaaagtattccttcacttaaggtgtaaagaagatttctggactgggcaccatttctcctgcagagaaaccatttcggttaagagattttcccactttacattcctccaggaaacaaatcattttgagggggtattctttcatttcaatgttatgcccagttctgcagcttcaactctgcagaacacaaagaactggagtctgaacatatatctattctgcctccttgacctgattttggtagccgttaaaattcggtcagagtctgctaaagttttagagagttcagaagattgaggcagctttggtgatgttcccgctaccatttccttggtcttctaacctaggtaggtcggatttcctcatgttcaggttgggccccttgggtgcctttgaagagtaaattctatgacaggtaaaaatgctggctgcaagatcctcttttaaaggctctctgatctgcagaatgagtcacactcccatgacaatatgagatggcagctgagagaggtgaggtatgcttgagcctaggtttgaaataatattgctgcatttgcagcataaaccaatatgcctgagcctaggtttgaaataatattgctgcatttgctgcataaaccaagaaggacaccaataatctggaatgcaaatttcaataaattctagaaatgctggtggcagaaaagctttccgggaccagagaaaggcagtatcgaggataagagcatgggctcttggaaccacactcccatgactaaatctcagttgtattacttactagctatttgactttggacatgttacttaaattttttctgtgtctccacttcctcatctgaaaaatggggataattatgtctagggttgttgaggtagttgaagattcattagattatgaattataaaatacttacaatgagtccaggcatataattgagtgccattataatgtttatcttcactgttagcgttgccaacgattaatattacaatttccaagtgagtcactctgaggtacaataaatgattaagctgaacacctaggttagggcagagcagataaaaagccagaagaatacacagagaggagaactaaggcccctccctccctcctcaaactgatcggatgtttgttcagggggacgggggacaggcggggtggctacacttggtgggtggcttcgctgggaggctggaccaggagagcattcccactcttttcttcctcgactgaatttatcatgaagtcttaaaaacataaagctgcaatgaatatactgaaagaaattagactctgaatgtcagttgttttcactctgtcaagttgaaaaaattgagaaggaaagtggcaacggggctcctgatccactggaagtccttggggaattcattaaatacttgctaattgactgaacttgcctgttcaaaggaaacttggaaatgtatacgccttcagggaataaatcatggcgtatacaatccactaagtatcttgcttctcaggagtaaccacagaatatggtttatatgtaagttaaatatttaattggtataaatatactactgagatcactgaggcaaaaatgtgaacattttacttctactttttaatgactacattttgggccattatgcttaaagctaataccacaaaaatttctgaattttgtagcacaaaaatattttaatatgacttggttattttcattgatatgcggaaataaatgtgttccatgaaaagcaaataccaactgcttccactacccatttaatgttcaaaaatatttttatggaaaaacctaaaaacaaaatggcaagccaggagaattggtgcctctgggattagaaggtcagaaaattacctaatcttatttctgccaagaagggttacttgcattaaaatgacagcagtcaccaaggcactgggaggaaacacgggccaggggaaaacgggccggctgtattttagagaaatcacaagcacacacatgggctacaagagaaattatatttgaaaaataaaatggaacttcctcattgattagtctcagctccgcgataatttctgactgattcagaaacttgcaaggctctcatagaacccagacaagagctttgatgttggctggatgcgacacactgccggtgatttaattttgtctaaggcaagaacactgaaaaacaatcagagtcatctcatgcctgaagtatcagagttgtattattttccagtgacagcagaaaaataatttccatgaatgagtatggtttggggagctggggagggaaaaaactgaagtagggaaacagaggtggaggaagcatgctttgtggattttctctcctttaccaaagagagctcaaaaatttctggctgcaagactgatatcagacagacatcaagaatgcagctatatctggcttccctcatggcataagtagcactcacagcaaaatgcatgcaaccagtcacttaaactcagatgcaaaaattaccaggctttgggggtagaggcaccactgttgaaatagacattaaatcaaactgatgagcttctggcacttttcagaaaggcagtaatatttggaaacattttttcctgttttttttaatcaaagcaattatttcactaaaaactgagaaatgaagggaaaatgccacctaaaaaaatcactatccacaactaatggtagaattttgtatatttcattccagtcttttctcctatttcctatttggcaattatacatgacagatgacccataagaaagcaagtcctgcatttcactctctctcctaaaaagactcttcaataaagcttttaaaacaaactaacaaaaaaatcctggtgctttacgacagacccaattttgcttacagattttccccaaatttaagattttgttattggttgtatacaattcaaaaatgaaggctgttaatgctgagttcatagtataaacaaagagaccagagattagaaaaaaatgtcagcacatttgattagtttcatcctcccacatgccaatgggtatgggatgtggaaagactgcaattccattcttaccatggtttgcctcgactatcaaggtgatccaatatggcaagagaaaaagactaatggtctcaaatttttaacaaaatggcatttccaatttttgtaaaatggttgtttagaacttaaaacatattttccaaagaagcagttacaagaagaggtacatatttccaacttactctgcaacatctatttaattcctgggtttaaacagaggtaacaaaggttttaaaagatgaggtaactatgacaattcatcgaaatgtgaagagaatattcatgcatatgttttttttcaatcttatcctttaacgtctagtttatttctgctttttaggatatataacattaatacagtactaaaggtatttaatttgtaaatatacataaattggacatacaagctgttaaagctctaactttatttaaacagagaagtttggacaccattagttgaaacaataacatcagcattactttcatttgctgccatactgatgacaagatctctttagaaaaacatgttccatgtttcagtggggacggccccaggaataaatctgccatggaaacatccagtatactgtgggtctctttcggagataaattgggtaataggagtttggaatcccaaaagggcagctctgagaggaagcagggtactccctttctccagggggtcctcgcatgcagcagagttctcaaacacctttagtttaggcccctcttaacctggtaagtggagcagaccttgtcctcatacatttttaaagggtttcagtcacacacttgctgaaatccatttgtggatttctgggaccatgatgccagagaagaggatgtgggctcagccataactaagaaggaactccgtagtaatgtccagatggggaagaggactcgagttctgagacttcaaagtgctgcccatttgtggcaaacacttcattgagaaatggcttctgtggatgcagtctaagcctggggtgcttattttaggcaactatggtatatacactcacttttatatacacatttctcatttgtcagatttcccacggtgaactggcaactcctctctgggtgaaatccaaacgtggtggaagacagattcctggttctgggccaggtcctgtcagtttctgatcattacctggttttctatttccaactccatttaggtgactgagtctccacacagagctcaggttgagctttagacacaaatctcatctggtcattcattatatgatttgtatcctccagtggcttctgcctttttgaaaagtccaaattacctactcttttctggtctcctattctgcaaattaaatcttcataagtgattatactttccacatatggaatggagggtggtagaaagctgtcatgtcggtctctcccattccgccactcctctgccttctgtgtgactgcatagggaaggacagtcaggatacccttctccccagcagagtagttggcccggtgttgaaaacttgacccaattaaaagctagtgagagagcaaggcctaaatatacccaggcctcaggatctagccatgggtaagtcactcctggacttatatgagctaatattattattatttaaactaatttgaagtccgtttctaaactttccactgaaataaacctagaactcagaccatattgaactaacctgcttatgataggtgtggaatctgtttataaggctttgaaaataactatgtttacatctttcaactgaacaggacataagtcgatggcatgattcatgatatccactctagcatatgtagcttgactccactgaatccactccccttcctctgatacgtcttctttaatacatcagtggcactatttacagcaaggatggtttcaatggaggttgctttaatattacatttcccttccttcaagagtctaatgccaactgtaacaggatttctcatcttttttcctatactcagagagcaaactgggccatttaaatcacccagttaatgtaccagttgctgttgaggagcagatggaggtctgcattagactccaccagaatctgtgctccagaaggcacagcctcaggaccagaggagctgagaacaccttgaggaccagacccttattcacaaaataaggagctgggtactaggcgaggaagttatttgactcagagcatcacggagtcaggtgaagaagacacctttgccccattccacaacactgctcctccaggacatcatgcagctcccacacaaggaacaacagccagatcctctggatgtcctataaattagttgaatcagaaactgagtaatatcagtgtgtcattataggtcatttagaaatagctttagtttcatagtaataataagctctgagctatatgacatattgctctaaactgtacagaaactcaactaacttgcagtcttttcttaggagtataacgtaggcttctggttaaatgtagcagattgactacacacttctcacctttcctttccaacaatgactaaaatgatagcaaataaaataaaaattaaagaaatagctaagggcaagagactaggagggaagatagcagaggagtgatttcaacaaattttggaaagacagaatagacagaatgatgcccaatttaacttcctcaactctgcgatagcctaaagaacctacggaggagataccaagaaaaataatttactctcatagaaacccagagaggctcaggtttggagagactgtataccacaaaaaacaggagtgagacatgaggctggaaactttagaaactagttgtaagtttatttagagagagattggacctccaggtctctgccttaacccttcacacatacaggactactgtctctcaccttgaccaccttccctaaagaacagagaactctgtgatatgaagaccacagacctcagttactacaggctttgactgaaatcaaaaaaggtattacatgaaagcatgtaatctgagccaggggtctccactgttcctttccttctccaaagtttcattctgccaaatgttggaagccaggccaacatctccaaagtagactagacaagtcttctctggaaaaactgcaaagacattcagattgacaaacacttggctccaaagcccacctgttggctaatccagctattcccatagagcttcaaatcagattttttacattcttttaggaaaaaaacaggtggccatatattcaaggaactaatccagcagaatagagaacgaccaaatcaaacaacagtataaaatgaacaccctccttctcataaaccacactgtttttcattgcttctaactccttactggtgctaacctaatcccacatcataggccatctttggcagtagaccaatactgcaaggtatacccagattcattagaaatattctggacttaagcaagatattaaattctttcagaataccatttgagttcatgtgtgtcaggagagtaatagctaggctgaaagactaaacttggagaaaaagccttcagtgatatgttacaaggcattcattctagtatattcacatcattggtaagtatgtcaatggtataattctcaaacttctggatgacaccactttaggaggaggaacagccaatatagaagctgagagaaccagaaccccatccaaagagaatctgaagagattcagataataaaggacaaaattaactggaaaaaaaattaagtcttacattcacatttaaaaacaactacgcaaaacagagatatgaattagtaagagttaattattagttttttttttaatccctcaagaatctgggtttcctatacattcagtgactcatcaatgaagcagctgcccaaaaaactaatgccttcttagacaacagcaggagaggcagagtgcccagggcattgcacttcaagagggttatgaacaaggaacatgaccacacgggggtaaccagatggacacagttcaagaccatgcaccacagagaaatgtgcttcccatctcgggtacttcagagagccattcccttccatctcaccaaaaggaacaaaaaactgtgtactgtggaaatcgagaaagcaaagccgtgactttaccaaaagtaacaggagtcagtcaggcaagacccggacaagctgggtgataggagccagtggtggtgagagtttcctctcctcagtgagagcgagatcatcaggcaaatgcaattcacaatgagatatcatggagggaaagtctgtttctcttgaactacttactttaaaaagtttaaaccaaaatatccaatgtagtggtctaatgaattctgaaatgaacaactatgctttctgcctattatcttacaatcaacatttttagctttttagcccaggtctaaaaatggctgttaccaagcatgtgtttttgttttttttgttttgttttggtttttaatggaatggtatcatgtactggcatgatctagaagtagctacatcagccctcttctggtaatgaatcatcagcacatataaatggaaggtaaagacaagattattttattaaaagaaacaattactaactcacagggcaacaaagcttcggcagctataggatactacttgtgagtatcctatactcctatactccaggtctctgccttaacccttcacacgtacaggactactgtctctcaccttgaccacattccctaaaagaacagagaactctgtagtatgaataccacagacctcagttactacaggctttgactgaaagaataaaaggtattaaatgaaagcacataatctgagccatgggcctccactgttcctttccttctccaaagtttcattctgccaaatgttggaagccaggccaaaccttggtttctggaaaacaattcaaaggcgctggccatgcctagtgtgtttatccttctttctgtttaaaaccggtcactggctcaattgcctcctgaacgaagttagcaactcccagccaggagctcaggccttgaggacgggctcatggctctgggacacacctctcaggactgccctccgtttgcccaatgctctagccaagcaacaacatggcagttcttagcacacctagcatttccttctctctttccttgcttcagctctgctaacacccttcctctgcttctgccacccatccaacacccggcttgagccagattcaaattttgttcatggagccatgcaatggattggaacatcaatatagttcaatacccaccaacagtaaacagatgacaggatccattctacactgcaggcaaagtcaacacacacaaatctggttaagatgtgtctttggatagcatacatggaaatatcaaaattatctaaatctacataattgattctaatagatctggcttctctaataaatttgtaaatgggaacatgcctctctcacccccaaatagcatatgtaatgtggatgtaattgttggcctcagctaatgatatatttttaacaacacaaggaatgatcatccatatttttatgaaatgtagatctgtaaaataaatacagttaaataatctacaagtaggtttacaacttaaagcctacagggacaaatatattttgatcttccaatagctaacactttgagcaaatggaggaaatactccaaattatgtaatactctatataatctctagagttagaatgagaatgtgtttaacatgtgctctgaagttaagcctatacattatgaaactttagacgttccagctttaaaaataaaaaataacagctttaaataacatttctaaatacaacatttggttactaggagtctctcatgattgaaatttacttagcctgaaagatgaaatgtcaaactccaaatggaaggaaacaaaattagtgcaagtctgtatctactcttccactagaaaaatggtttcactaagtgagtttactgatttccactcttggaggctagaagtaaagatagctaaacaataggaagaggtgcttccctaaagtaattaagaaaacaatgtttcactttactactatcctccaagcaccagatctatatatttgtataagcacagcactacccaaatatatataaaatgaaaatccactataacaaatttgtcaaataaaatctgagcttctccactgttgttcaggcagcaatactgcccacaagtatgagaaacttaatattgattagccattgtgggttaaaaattccacagaagtgccatattaaatcattcgggtagcttttgcttctggaaagcacattccagcactttgggaggctgaggcaggcagatcacctgaggtcaggagtttgagaccagcccgaccaatatgatgaaaccccgtctctgctaaaaataaaattagccgggcgtggtggcatgtgcctgtaatcccagctattcaccaggaggccgaggcaggagaacggcttgaaccagggaggcagaagttgcagtaagccaagatcgcaccactgcattccagcctaggcaacgagagaaactccatctcaaaaaaaaaaaaaaaaaagtaatacttttttcccactaaggttcaacccaaccttgagggacaaaccaaagaaatatcttatgtcctctctcttgtgttctccaagtcatctgtttttttttaacccaatgaaatattttaaatatctccacaagccataaacaacctaactggtcagggaaaaaggtaagcaaagtagaatttagtccttgccacaaccaagccttatgtccttgaagcaaccaaggacataaggccaagaagaggtatgccaccaggataatagcaggtttggaatccactgtgagaaacaaaactcctggtgattaattttgaaactgtgctaccaccctgtaaccttcctagagaatataaggcttctcagtttcagcttctcagtttcagtaataaatgtctgacaaagcctcatacttttattttctccgtttttcatcccttccccacaaatgatggaaaatccaaaggaatcctagccataaagaactcatactgtgacaatttaaaacccattcaatcacagcaactgccactttgaaaggaaaaaagtcaccaggagtaggggccaacaatgtaatcaacatctaatgggatcagaaagtgtatggaagtctgggcttctcatgacactgaggccaaggagaacagtattacttcagaggtttcagaaaaagatcttgttataaaggcttttgagataaggtccctgccaaaaatatttcccgaggggaagatggggaacaaaaaagaataaactcttggtagaaaagagagacatttagatttagttataaaagatggcttactagcagagaatttgataaaccatggaaggacaagagcctgtagccagaatttcaggactccaaaacaagtcacattctagacattttagggttctggaggcagttaaaacatgtttccacttgcttgtggaataatctctaatcagaggttcaatacaatgagatccctacccactgaaatatttactttttaaattgataagctgaaaagttcatcttttttaaagcaatttctcgtgaagtctcatcttgatttagaggaagagggaagtaaaggggaaaagcctaccccacagaaagaggggaagtgacgttacattgtgaaacttaagggaggaatttcagccacggctctagggcgaggggttgtgtaggagagaaggaatggcttaatttttaggaaaacaggaaagccaagtgactactttggtgaatgctggaggaatggaaagcagcagcgaatcctattttggatacagaggctgagagccaagtaaatgaatcccaggcggagatactgtcttttgtctccagctgtcagcttttttcttgaaaactgtctcatcactttctgtgattgtggttaggaaaaaatcctactttatcttgtgaactttttattgtcttcctgaagttatgtgttacttctgtaaagcactctactctccttgtttaatcatcacaacagggaaggggagaggcttgcaatgcagtgtttccaaatccaatcactggagtcattcacataacattaggtttaggacctgagaaatagattctgaggtcacagaccagccccctttatatttaagcaggaggcaaaaactgaagctaggagagatccggagtcttggcaaggctctctgcgacttccagaggctttcttcactcagtccactgttcggtccatttcagagtctgctctttcacctttgtcctcaaatggtttatgacaaaggaaggtgctggacactggaaaggtaacgtcttaagacatgacccctgccctggagtagtttacacatatggaggaaggtagggcgtatacttgaaaacataagtgataatatgattagcaaaaaatcctacaggaatccagaagtgggggtttcatcaaggggcaactgacaaaagctttgtgaaggcaggtgcattcagtggaaagagtagacaactaaggtaaagaccatgttaagaaagggagggagatgggagaactatagcacccccagcacacaaaggtagaccttggaatgatggctcatgatacatttaagtcaacagaaaactaagtgaagagtaaagagaacaaagcaggaaaactacagaatgctttcaatggcaagctaaggaattgagactattttctagatagttactaaagatttctactggtagaaatttcttcacatggaagttttagtagaaataaaagtggtatatacaaggcagcgtcttaaggatcactctggaaatacagtacaaggtggactgaagaagggctggaggcagggaaactgagaggagactcagcagtttaggaatgaggtgatggggaccggtccacagagggacagatggatgtaacaaaggacgtcctaaaggaaaagtaaatgggatttggccatctactggatgtggagcaatcaaggctctcaatcttcaagtagagatgtatgggagaatggtgtcaccataaccagagggagggatgatagacggcagcaggggagtgtatggtcacctatgaagatatatccaacagccatttacaagtcagatgctgaactaaagccctggaaagccatcaggaagcacagtgttgagagtcgcccaaaaccaagagcctaaccttgagggtgaatgagatatccaaggagtcccagatctcagcctggggcacacttcatagttagggggctggaagaagcagaagtcagggaagggggcagagaaggaaaagcctcaaaaggaagctaagaataaagaaagcatatatcctggttactccaggctgacgtgggaggattacttgagcccaagagttccaggttacagtgagctataattgtgccactgcactccagcctgggtgtcaagagtgagaccttgtatctatttaaaaaaaaaaaaaaaaaaaagatcacacataaaagaaaggcaggagggagctttacaactcagtagtacagtattaaatgcccaaggaatcaaagtaacagaacacagaaaaacacactggatggggttattagatcatgggcatcaaagcaggtactatgctcagttttatgttactgtcacttcattgcctcagtaaatataaaaataaattttatatctgagtaaagtcgatacaggatgagcatcccaactttgaaaatccaaatccaaaatccaaaacacctctggccccaggcattttagataaggaattctcaacctgtatatgaagagtatatgaaattggctgcttcccaaatttccctagtgttgaaaccccggttgaccctctaaatgccaagagacatagttcaagtctggttcgtccaacatattcaccaagaagggtcttgaatagcaaagctatttccaccttcctatcccatgttaacggtagggttttgatataagattcccctcagcagaaacaggacagaacaatgttccctggttctcagtgcacatgctgcatgtgctctcattctctctctcttctttttttttttttgagatggagtctcactgtgtcacccaggctagagtgcagcggcatgatctcagctcactgcagcctctgctcattgctgcctccgcctcctgggttcaagtgattttcctgcctcagcctcccgagtagctgggattacaggtgtgcatcaccatgcctggctaatttttgtatttttagtagagatggggtttcaccatgttggtcaggctggtctcgaactcctgacctcgtgatctgcctgcctcggcctcccaaagtgctgggattacaggcgtgagccaccgcacccagctctctctctctctctctctctaaacaattgattggacaccacactgtctgtggatccagaaacagaagggtgagctgatatggaagaaaacagagtccctgttgtttactctataaaaaccattctccttgaaagatgccaatcacaacagtatcaagatctgctcagaaccaaataaaacacagaaagctcagggggtcagcagagggatgaggacagtgagacttaccaactttactgagatgaagtcagaagaaaaacaattccttatatctctgcattgtgcaagctacatgctactcactgttttccttcacagctttctgtggagacaagatttccttttacgtctgccaaacatatgccctgtacctatgttgtgatcccattcattccagcctctgctcagctgctgttccattagttaatattttctcttctgtgcctcttctctcctttcctcttggctcaccccccaaaaataagcaggtaaatctggctgtctctgtatatctgtgtgtttggggtgtataaaactccacctgccactgttgggtttcagggcagagagcagagctagtcagagcagcatgcttcatctccctttcaaacctgctcacccaggaccagggcaggacaaatgtatcagacagacgaagttggccttcaggcccccttatccactgctccttactctggtatcaccctctacccccacgcctttggttttaccatctacttaactaattctctgtgactctaagatttgccatgttaatagcctcttcagactccaatgcacagtttccaagaagccaaaaaagtggcggagggaaataagaaatataatgcagtatttcaggaaccaccaccaaataagaagaaacatctgaaaggaaaaaaaacttccttggcatgctgaaacccaaatggaaaagactgtctccccataaggccagctttgcttcccatagtgtctgaggtgtactgcaaacagcaggagttgaagatggtcagtgaagacccaccaatgacataagtcacacagggcactctgtcattatctcagggaaggggaggccaaccattatgtctgaggacagagtcaccaaggagcatcttccttaggattctcactctgtaaagcaaagataatgagaacaagtgactgctcaaacgtccaacgtgggaaaactggaagattgtttagtccaacctcctcagtttacacaagaagaaaaggagatgtaggaaaaacttgctcaaaggtcacgtaacatgacgcaggcagagctggggttagaacctctgtttcttgagtcatcatcccagtgcagcctgctcccacagcacgctgcctcccaacatctgttccttcacagagacatgtgcctttataaataattgtttttaaaaagttactcaggttaccagaccttttctgtgatcctgtgttcttgttattggaatcctaacatcaatcacaaaattatgtcacacgcttcctgaggagtgcatggaactgtttgtgtaagtggtgtggggaattcagatcaaatattcagggactcaaaactgaagacaaagacggccaatgctggaaaacgcatgtggctttttctaaggggctgagttccaagcatgtgtaattccactccctctacttcctacattctgatgactggaaatcttggggtcagtccaaggtcgacctacacaaagggaactccctaggatagccttagaaaaacacagcccctgcaacaggtaaatttagggtacatcattccaataaactgtcttgcctgacaaggttctctgtaacaggtcacacaaaggatttataccttttccttactgacttaagaggtagagaatttatccagaggggtttcttaaggtcctattttaacaatacaatcaaaagtgttctatttggcctcacttttccacacatcgtaactgttcacaggaaaataaagtcacccagtcttctggcttacaaacctcaggcaaattctacttctcacaccaccacctttgcaaatgccatatgtactaactgtattgtaagaaatatttacatcaatctggccaagccaaaaggtattttcttccataactttaattagcactgtctgcgtttttttaagttggtattgcctacatttgatttcaactgttagaattcatgtttccatttctcccattcatttgtgcttggaaaaggaataccaccataatgtgtactatgataaactttaagatacagacagcttttctgatagttggaaatctcttgcagtgtgatctctatagccagggtgacaaacacgggactaaggggcctggcaggtaactaaatgattcaggagggcagcagtaagttcacatatagatctggactgagggataggggctgtggcctcgtggagaaggtacaacccttcaaagcttctcatacttaccccattaccacagtgaggaagactgttctagttttgccagatcttctgacttctcaaaaaaggcgataaattcagagtttggggaagtctcagtttttaaaaatgttaactcaagttcaaaacaaaacaaaatactgagcccaaacatgcctatgggctgctgtacttggctgctgagtttccagtttgctatctctcctctataggaagtgggaatgatgcatattcaacgacgcctacaaaaattacttcagattgttagtctcagaaacccactggtggcctgaggggacatgcaaaaagaagaggaacaggagcagagatggcaaattattaaggtttcaagaccttaaaagagacaatcaaagtattcagattctcagtaaaattaccagattaaatcaaataaaaccccaccctttttccacaaaaatcaacagagagtcctgctttcttttcaccacaaccctattcctccatttatccctgacgtcctgccaacacctaaccagtggctagatcctgtttacttcttagtggaattatcttgatcaagcatgtcggcccttcattcccatcccattatcttagtgtagagcctccccattgcctagaccacaagggtccccagcccccgggcccacagatctggtacgaggccgcaaagcaggaggtgagtggtgggtgggcgagtgagagaagcttcatctgtatttacagctgctccccatcactcactaactgagctctgccttccatcagatcagtggtggcattgcattagatcttcattagagcatgaactctattgtaaactgagcacgtgagggatctaggttgcaagctccctgtgagaatctaatgccttatgatctgtcgctgtctgccatcacccccagatgggacagtctagttgcaggaaaacaagctcaggattcccattgattctgtattacagtgagttgtgtaattatttcattatatattacaatgtaataataatagaaataaagggcacaataaatgtaatgcacttgaatcatcctgaaacaatcccctacccactccaccacccaggtccatggaaaaattgtcttccaggaaactggtccctggtgccaaaagattagggactgctggtctagaccactgtagttgctatggcacccccagactccagtttctatctcctcccacctcactccaaacctagtccatactataacacaacaaccaaaatgatttttcttaaatgtatatgtcataacctctctgcaaatatgcaggaaactgctaagagcatttgcttcttgcaagggaactggcgaacatggagagtgggttcaagaaagccttattttcccctgcatgcccttctgtacttcttgaatttttattatgtgagaattaatttctcaaaaatgtaattttaaaatatgtaataccccagggcttctagattaagaagcaagacatctccctaccccaacccactggggcacataaatggactaaagattcgtataggtcagatgagagcatactgagaagtaaaccacagcagagcttgggacacatgcaggtggaaggcaagaatggaggtggaagttggcagcatctgagattagacgtacagaaactgaaaggagggtacatctgcaaaactgcctgcaggatggtagcttagcatggcctccttttcaccagcctatcagggtggtggcacggttggcccctagtctgaagtcaaacatctacctactctccaaagggagcaagtgatctgccaggagggacttgcagaccctggtggggatctctcctctggcattgtgggaacctctccccatcctgcttgcttcaccttgacacaccctaaagtgaaacctgctctttgacatactatgccctcaatttcagagctcacaacccatactcctagtgaaagaaaaggccaacaggggcagcagatgagcacaaggaggagggaagctaagtcagctgctacacatccttcaggcatccatatggataggtaagcaaggatgactacatatgaagaaagctggggaaaaaagataaatacggaaaaaatgaaaccgatcccagagaagacagagatcataactcatggagctaaagcagaagagaattttagggggaaaaacatctgagtgtggtcaaagatattagaaaacacaaaatacatatataaaacaaaaacatccatatagaaaagattgcatattgaagttaaaaattcattagaaaggatgaaatgataaaagaatgatgaaatccccagaaaactgggtgagtggaaggaggaaaacaaaaaagtttggtaggacaatttaagagtaaatccaggaagcctaacatcaatctactgaacccaagtcttcagattggaagagcccacaggtgctgagcagaataaaggaaaaaagattctcataaaatgtcacaatatcttgataatgagaaaacagagtctccaaagaaaggtccatcaaaggtacgagggtcagtagcattgattggtagagagaaattctttcaaatgctaagggaagattattttaaactcagaatttcatatccagccaaattaccaattaagcatgaggacggataagcagaggctcaaagtatacttgccatgtactgtttctgaaaacttactttataatatactccaggaaaattaaaaatatgtctaagaaaaaggaaaatagagtccaagaaaagtagaattaagccaagaataaaaggaaaataaatgtcagctgttcagcaagtcctgaaagcagttagttcataacgcattcaaaaagtttgtataatcaagaaaataaattatagttttgagagaatgaagacaaatattacttctgtaaatgagaaaacaggcaattacaaagtccagtaagaacaaggctatataagaacatcacagcccatacgtaaagcaaacaaaagtatgccatgatcctaagccactaaccaaatgtaaagagaatttgacctagatgcccagaacacctctgttcaagtggcctatgcttggttaataacctaggattccatctttatggtgcatttatatttttgataccactttgagggagtggtattggagcctctggatccaaccaacaaaagcaaaccatctccttggattttcccaatctaagagtgtgaaagacactgttagttccctgagtaaacctccatttccaacccttctcccttgcctgcctctaagatgtaccttaaaaacataagagtgggctgggcaatcccagcactttgggaggccgaggtgggtggatcacctgaggtcaggagtttgagaccagcctgaccaacatggtgaaaccccgtctctactaaaaatacaaaaattagctgggcgtggtggcagatgcctgtaatcccagctactcaggaggctgaggcagaaaaatcgattaaacccaggaggtggaggttgcagtgagccgagattgcaccactgcactccaccctaggtgacaagagcaaaactccatctcaaaacaaacaaacaaacaaaaataagagctattattcccccaccccttttgcaatctgatcacagtgagagccgacatgtgagccaaagtcctcgaggaggtttcctttataaataaaaaggccaagtcttgctaagaagaaagttttgcaatttttccttccctgtttttcctatgaaagccacatattaagaatgattggacagaagggtaaaaggtccaaaatgaattccatgagtgcctgtagcagcctttgggatcagaaaactaacccccatatctacttaagacttcggttgcatatttttttgttgttgatggggaacacattccttaactgaaacaaggaattggtttcctattctgaatgaagcccagtttgatttgggtttctgtcatctgcaagtgagaaagatctaactaatatatatctccttctttacactctgctccagaggagaaatattaatagcctgtcaaagaccaaatcttttaccttcagccttaggaggaatatgctgggtaggtttcccacagagctttcacttaaatatttacgtggccccaaccacaggctaatccctgtggttacgtgggacactaggctaaacaagccaccacatttgccctcctggaccccagtaaaacaagggcagagagtttacaaatgcataaaatgctgcttggagtgtaggactacgttatgcaagcacagcaaagggagtaatttagatccatctggtagtatttccaaacctagcaaatcctaaaatccaaaagcgcttatttgatctgattcagccacatcaacatttttatccaccaacaaactcttattcactgaacaatggcacagatgagccaaaataatatttgctttgaatgcatttatattttaaattgggtgtgtcccttgttccgagaattcaccacaccccaaacaaattgaatccaaatggaaggttctaattcagaagaaaccagcacatagtttagctgcaccaaccctatctctttagtagagtgattcctggttctgtttctatccaagaggagaggtaggtaacaccactactctaactgaattgaagcctatcctcatcccagcactgcttatttcattcattgaacaatattaaatgagtatctactatatcagatactctgccaggtgttgtggatatgccagaaaaaagaaaatacctgccctcaaagggcttatgtctactggggccagcaggcataagtagagggttcagacaggaaagagtcaccaagctattacaacatattatactgagttttagaaaaaataaaacatagctggagtggattctctaaacagagggaacagtgtatgcaaaggtctagaagcaagataaaacatggcatattcaagaaacgtcaagttcaataaacttgcctacctatatattaggtagacagctgtagcatttacttgaaatgtgtatgtttgatgaggaatataatgagtccacttctggacatgttgaccttgggaagcctgagagacatccaaacttaagagctatctggccgctgcagacactgctacctacctgccaacctgatacagatacttggcatagcctcaaatctgagaagagtcactgtggccttcaaacctgggttaatgccaatttttgctttatttccacaccatatcagatttttgcttactctgcagaaagtgctagtaaagcaaaacccataaaccattctgagggccagattaaaactctccttgagttctccaaggtgactaatttcaattcttatctttataggaaaagaatctggcaggaggtctggatggttactaatcagttatcacccttccattacatctcgttgcaccaagtggttgtcacaaatttgtctccttttgtgttttcccctctaacttatcagtgaagattagcagaagtttgtggtattgaaatttgtaggcaactgaggatttctggggctaagcgtgttcatttttaaggtccatgggcttttggcatatactccaggtaccacttctggtcatcctggcccagtctggtgtgtgggtccagagttcaggctggtgacagatttgggcatcattactaaggttgtcatgaggctgtgcaaacctctagagagtacaaggaaatcaggagagagaggtcaaagggagaactccaaggaacccaggaataatggggcagacggagcaacaggagacaggaaggaaaaactaagaggacagaaggactccaggcaatgaaagccaaggtgaagaagagggagcaatcattcaacagaatctgatcaggaacagagagtttaagtgagaaagagactgagaagcctattaaataaggggtctttgttgaccttggagagagaagtgggttgagaagggaaagaaaactgaggactcagacaagaggtacagaaaacccttcagaaaggctggcaataaataagctacggataagaggaagaaagcagtagctagggccgcgagtgcacaaatggatatgcatgggggtgtgggtgctgggatgtgggtgtgtgaaagaagagttttaaatacatttaaaggctgttgggaaaacgtcattaaagagggaaagcctggagactatggaggagaagtgataatcaataccacatgttcccgagggaggggaaagcgttctatctagagcacaggtatagaaaccaaacctcttccattacgggagggaggacagatggatagatggtagcagtgcagaaacttgcaggtctggtgacaagctgaggaagccacaactcaatggctctccataaagcaggaggccagagcatctgctaaaattgagagaagtgagcagaattgagagaagttgaatgagggtagagaagataccaaataaacattgtgaatgagagagagcttcccaaggcagtttttcagtgagcacattgcaaggggtcctgaaatcaatactttttaaagaaaggaattaaaaaaccaaagtacaatgcttataggaaagacaaacattgtatataataacattaatataacatgtgcttatgtgtatactgaattgtgatgtaaaaatgttctttctgtgggtggcactcaacatatttgaatgccaacagactagaacaaataaatcacttataacagggggtccccaacccctggtctatggaccagactggtactggtctatggcctgttaggaaccagagcacacagcaggaggtgagctgcagtcagccagcattaacgcctgggctccgcctcctgtcagattaaccacagtattagattctcataggagggggaaccctattgtaaactgcactgcaaggaatctaggttgcatgctccttatgagaatctaatgccagatgatctgaggtagaacagtttcatcccaataccatccgccacccctgccactgtctgtggaaaaattgtcttctgcgaaagcagtccctgccaaaaaggttgggggtcactcacttaggagaactgaggtgagggtggaaatgattttagtttgtggtggcagtaaccatcattatggcttatgctttacacctaccctaagttagaagaggtaattaagtttaaatgctcctgttaaatgctgtgactcaagaagaacacataaaatatataaagtaatatatcttatcacttactttacttaattatgctaattaaatcttttaaagtaattttacagtaaattaacaggctatacaagaacaaggtctgtactactccgaccacataattatgctttttgctatccattaaaattcttacatcaaaagctctttaagtgatctatttaacttgtagatgtgtgtaaaaatgttaaaaggtgttttattttaaacccacccatatttttataatttacaacagcaaaatgcaagacaaaaaacacataaccctattattgttaaatactctctcataactgaaggcaaatcccttctcttagaaaggtacttctccaacttctacaggaaccaaagtgactccattagagaggaatgcatttatttgccattctcagtcatttgtgagatgccccattgttacagatgaatcccaattcaaacagtcaaaaaatgaacattgccatattcctcattttgccaaataccaattattattcagagaccaagataatccctcaaagtcattcagccctaaattctaatcccataaatctgctttatgggttagaagaaagcctttgaaaatacagtaagtcaggtaatagagtctaccacacccctaagtcatttaacagacccattatcatttactaaagaaaaaaaaattaattggaaagtattttgctcttaatgtgcttcagaaattatttgcaaatatagctgtgaagtctactttgtttatttccagtaattaaatttggttgcagcagagtgcggccaggagaagcacgtggccattatttttccctttagggtgattcgaactcctagaacatgttaacccatttatgcctagtgttccattattggaacactaagcttgtgggagttatttatatactactgctcaaggtcatcgccaagatctgatttatcacacacacaaaaaatttgcaacctccagcataaatgggttaattttcatcataacaaaaatgaagctattttatatgtgtcacactgtactaggtaccacagaatgcaatatttttctcaggtaagtgtttatttcttaaaaaaagtcaagtcaaccaaaatgtacaaataagctcaaactacaaaatgactctagaaaagatgaacaaatttgttgattaacaaatattacctttccatgtggcctgcattcattataaattcaagagaatcaatgacattcaactctggaaaaaaaaaactccttaaacgcagaagttcatctaactcagcagtattcaactttttgttttcaggatccgtttacacccttaaattaccaaggaccctaaagagttcttgttatgtgggttatatccactgttatttatcatattcaaaattaacaaatttttaaaatacttttaaaaataatctttaaaaccacatattaacctagatactttttatgtatttttccaaaagaaaatttactaagaatggtattgatttgcgcttttgcaaatctcttcaatgtcctgcttaatggaaaatagtagagcttcatgcctgcttctgcatgcaatttgttgcaatacggtgtttaggttgaagtacataaagaaaaatctggcctcatacagataaacagttggaaaatgaagggtgtcttgcaatcatcttttgagatagctgtgggtattctttcgtactttccccaaattgaacaaatggtgctttttagtagttaattacaatatggaatatgaaatctgacaaactttctgtgctctgttccattaaaatccagtggtctatttgcgacttgaaagggtcttttacccatgtatgattttggaaaatactggttaactgagttatgtagcttttttttttgaaatgcctacacatttttttttagaaaatatcccccgaaaagtacattattaatattactatcaatcttaccatacacatcttcagtactgggaagctgtcaagcacagggttgcaaatatgagttttccaaaatttcagttttcactttcacctgacagctctaattttatcattggcagataccatcaggtgtttttcttgaagtaatagcctcatttctgggaaaatatcaaatggtttaagtgttcaaaaaaggattgttaggatatacctttgtgatgaattatgtggccaatataccgtttacaaataatatacagaaagttgtcgacttacgatggggtcacatcctgaacaacccatcctaagttcaaaatactgtaaatcaaatatgcatttaatacacctaacttgctaaacgtaatagcttggcctagcctactttaaacgtgctcaaaacacttgcactagcctacagttgggcaacatcatctaacacaaagcttattttatgcttaagtattgaatatctcatgttatttactgaatactgtattagaagtgaaaaacagaatagctaaatgggtactcaaaatacgatttctactgtatttgctttagcactatcccatcataaatctgtaaaatgctcataatataatgttaactggaaaatacaaacaaaacatgtttatattactatggtatcagctgtgcttcaagaagtttgcccaccttttcctgaacttcttctgtattagacaaaatagccataaaaccaaacccaaaactcgtacccagagggcaggtatttatgcctttaggagaagaatttacaaatacagtcataaataccaaatattaacagttatgggaaaaactgacaaatattatcatatttaagttagatttacaattttttaagcattcagtttaactgacacaaacaaaaataaattaaatacacatcctatttgactacaatcaacatggaagaaatgaaacccagtcttttggcagacagggtataaagaagcatgaatttacaggttcttcctaaaagcactctccgtttgagatgctgacagaatgggctttgtccaaaattcaagacatttttgctaatcactttcttatattactaagtgtccacatgatgcagtattaactcctaaaagctattttcattaacatgactgcagtacacaaaaaactacattattaataaaaaaaattccaatagtctatgtgtctatctacccctctgataattaaaaattggagagaatgattaaccactcaccaattcaaaaaaagatattaactttttcatgaacgtcctaagagcttttttttaatttttatttttttttaagtacgaggtccatgcaaaacaaagggcctattctcccaaggttccccgaaacaaatgcatcctctaggatgtcctgcactttcaggctcctctctttagcacatgcctaagcatacaagctccacagattgctagcaaaagtaatgtcaatcccatgattctaggcatatcagtgtctgctttcaactatcacatttgctatcaggttgaaagaaaaaaaaacaagcgaaaccatccttggcttgggttttatgagaaacgttaccatttttctggtctaataattatttatatgtaagccacctctacttgactgcaaacctgttagggctgggcccaccttttatgcctttgtcttctcactgtctaccaccatggcttttaaaagatggtaccaaataccagcagttattgttcaccaagcacttatgtgcaaaacgtttatacatgtcaccttaattccccatcatgaccttaataggtagagagggttgtcctctttctatagaaataaagaggccaaagataaagtaactagtccccagttagcttctaagtaatgcaaatggcatccaaacacaggtttgggactaaacaagtgattctcaaactttgttgagcatcagagtcatctggagggcctattaaaggaaattcctgggccctgcaccctgattttctgattaaggagatctagaaatgggcttgataatttgcatttctaacaaggtctcaggtgatgctgatactgctggttcacggaccactgagaacaggtgctctaaccacattagcctcagcaatgtggaggtttcaacgtgttgaaaagacaatgatggctaacgaggccatcaaattcatacagagtaaaaaggatggaatcctgacacatttttcaaaattaaatttgagaaatgttttttcctacttgtatatttttctaccctaccatcctggcagagaaaggctgataagaaaccaaaagtcctcagtcctctaccttatagagagggaacgttcaagactggccctaataagcaggagagtgctgttgtctcttctaagacaatcaacagctcagtggcatctgctggagttagagaaggtagacagctttcaaacttgactagctatttggagaagattgcagctaaatctatgcgactgtgatggagaggacccttaatgggaatggaagccgaaggaagaaggaggaaatggaatctacaagaggagacatctactcagaacattaattctggatcagatattggctaccatgccaaaggatcatagctatgttactactgatttatcaatagtggccctgattcacttggacagctgaagagttcaatgtaacaaacttctgcctaggaagctgcaaaattggtaccattaaaacatggctctttcaaattgcttaaaactctcctactgaaatgtacacattttcagcaacatttcatttctcagagtaacatgactttcaaggacaaggcaaaaagactgcaataattttactgcaggaatctactctgaaaagtaaaagctataacacaagattgcagtaattttattgcagggaatccactcggaaaagtaaaagctgtaatatagctattacctacgggggttatctccaggagcatcttaattttcctgaaacgtttatggtgtggcagaaagcagctggactcttgcattccacacagatcaagacacaagcctcacacttcatcatggcaatagcaaaataactgaagggaataaaaaaggaaagaaggaaataaaaccagtggccttatatctaaagagaagaagaaaaaaagaaaaaaaaaaacacgtggtcagattggaaaccaaaccacctgattttgcctaagtcacgcatctcatctggttctttaattcctcattttacaacaatgttctgggaatgaaaagaggcactttgctctttagaaacaaaaattaagtgattccgaaagatatgatttttcagttgtaagactttgtgaggtaaatatccactaaaaactgcttcctaaagccagcacacttcgctgctgcaatgcttttttaatgcagtttgtccctgccaaaacttgcattgacgtttacatacaaagcattacacaatcttccaggagacttggtttctctatataaatacgaaaacggcatctgcctccctccccagtgatacaatgagcagagggccttagtcacgggtcaaacacctaaagtctggcctggtaattattagctcccagcttgaaaactagctcactgaacttaaaatcttttcttcctctcaaaggttagttaggatgctggccaactatcttccagaggtcttgtgggattaatgaaaaggttaaaatattaaggacttacactcaatgagagctattctcatccatctcagctattataaaagtaaacactcccccttacttccctgtgatactctagggggctgcaaaccacagcccatgggccaaattcacctgccatatgtttttgtagagcctacaaggtaaaaagaattttcccacttttaaatggttaaaaaaatcaaaagaagaatatcttatgatgtaaaaattatatgaaattcacatttcagtgtctgtaaataaagttgcactgggccaggcatggtggctcaggcctgtaatcccagcactttgggaagtcgaagtgggcagatcacctgaggttaggagtttgagaccagcctggccacatggtgaaaccccatctctactaaaaatacaaaaattagccaggtgtggtggcacatgcctgtagtcccagctacttgggaggctgcggcaggagaatcgcttaacttgggaggcggaagttgcagtgagccaagatcacgccactgctctctagcctggaggcagagcaagactgtctcaaaaaaaaaagttgcactggaacacagctatgtccattttgtttacatattgtctgtgacttttatcttaccatgggacagttgagtagtaatgtcagagaccataggacctgcaaagcttaaaatatttactaagtagcccttaacagaaaagttttgcctatccctgtgctctgggcccaagtctgctatgcctctgagtatcctgagacccttagagaattagccctgcaaacaggcagctgtactgagaagcaacattctgtttgttttatcccaacccaacctggtatctaacaaatgcttctccttctagttcaaagcaaggctatgacgtcacagaatgaaccccaacctcaatgtctgcactaagggaagggtagagcagctttctctatggggccacattttcagtaacttagtcccgtacttagaatcttatactccgccttctaataggtcttcacagcagctctagaaatctcaggcttcttttttaccactatattagggtacctttggttgaacgttcccaaaaccccttgagaaaatttaaggaaaatatgaacacacccccttttcatttgttgtaagtacaccggggtctctgggaactggagggctacacagaggaacttgagcatatctcttgatttttttcccttctccacgcacccaactccatcatgcttccctcactgcaggccaacccctctagttcatacgtcaccaggatttacacctcccctgcttcagagacagactaggagtagaatcataccccgtttccaaatgcccgggagacaggtcaaattcacacgtctaagtgtaacagtgtaaatggaatgcagggcaatccctagaaaatgagaagggagagatctgaatagacaataccttaaatatccactctgcctgccataatataggtagggaaaacaagccatttaaatttaggaagagagacagtaagtctccttccaaagacaaggctaataagaccctcacagtatggggcagtctcaggcatttgaatttcaactttcattaaaatcctaggtcttatgccaaatgctaggaaaaactgttgttctttttatagttcccctaaaaaataactatattattttggtcctggctggagtcaacctctaccttcaatctacatttcttttgtgcttgcttccccttcaccccttctacacacacacacacacacacacacaaaaccattatcaccagcaattctgaaaaaacctatacaggaaaaaattcagactagatattcactcccccaaagtgggactcttgtttacccagcaacgatcaatgatgccacttacaaacacattacacaaccccacagggcttcttacacatacagccagagtcagtccttgggagttggcagttcttgggaaattcccaatatctcacatagggctttatttgtatttatctgggagagggatgggcagaagatgggatagcactactcccttactttttttcttttgagatgaggtgtcgctctgtcacccagtctagaatgcagtgatggggagaactcctacgctcaactaatcctccagcctcagcctcagagtaactgggattataggcgtgagccaccacatcccagccacttccttacatttaaaggcacctcagcacttacaaagcttttttgcacaccttgttgtatacaaagtgatcttcaacatcccagcaagggaactacctccctccatatggacaaaaaaacaaaacaaaacaaaaaaaaaacctaacaaaaaaacctataaaagattaggtatcaggctcaagggaacacaatgggtcataaaatcagggatccaggtcacatttcaagcctagggtatttatggttttgtttcattttcttgttaaaataagagcctaagttactgaccagttagcatgtggcctcgggcaaataataaattgggtcagagaatcatgcacagacatgacttggccaacagttggctaattatgacaatttagcaatgattgcattattaaactatttcagcagaacaggtttcacactcccctgtatcccagggcacgttctctgcagctctttccttcctatcgtccctgtagcaggccctcagtgctcaaccctctgctccctttctttaaaggctgccctggaaatcctcatcagctctcatagaggcaaccactggcacaccaaaagtgacttcccaagagactcttgggtctggcaattcactcctctgctactattaacccaaatgtaattatgtttaaattttatcccctcacccctagaactcatcttctcttcagtgaggtatgttgtaaaaccttcacgtttatataaaatccacccatcagtgttcatatacattatctcatcttcacggtaactctgggaagtaaagagggcagcactatcattcccatttaataggtgaagcatgccactcaacctctgagcttattctgtcaggggcaacattcctcagccacctgatggccaaaccaaaatccagcaacatactgagatatgctacagcatgatgagccatgaaaacatgccaagtgaaagaagccattcacaaaaccatatcctgtacaatttccagaacaggcacatctacagtgacgaagcagataagggaggcaacgggaggcaggggtgactgctaatagcctttcttttgggagtaatgaaaatgttttaaacgtagtaatggttgcacagtcctgggaatatactaaaaaccacggaattgtataccttaaatggataagttgtatggtatatgaattacatttcaaagctattaaacctaacttctgtatttatatgtcttataaaaaaggtatgtctgctaaaacatgatcttaaattagaatgaaataaagtggaatggaagatggataaaaacccaaaccagctatatcttcaactcctttctgttcccttccttcaaaatgtctctctcacttagcaaattctgtcactattgtagccaacgaatcttctatcttaatccaggcctcaactctacaaacctgggttactgaaacaactcctccctgattaccacatctctagtctcttccctatcccaacaatcctaaagacgtccgaaactcttcttccacaaagcaccatcttcctataccacttccctgctaaaacattagtacctaactcagcatggaactgaggtccctcaagggtccaaatgaactctaccttttcccagttcattctagcggtctcacctagtcctctgtgactaacacacgtgcacagcaccaccactcctagaaatcctttcttctgcttacagaaaggcccttaggatgtaccactgtcatcaatttcccttgaacattccagaccataatgtttgtctacctaccattagtagtctgactcacttgatacttagacaacaagaaaaattttgtatcctgtctcccagtaagggtcaaaaggtagctaaggtagctagatgatacgacatcttctgtgccctgcccctccatccactaggcctaggatactgctatatacaaagcgtctctcaatttagtgaccattaaagaacatgagctcccagaaatttactatctaatttaacaccgcagaagctgctggcaaaacaaaaatttttttagtttgggaggtggatttctttaaaatcatcccttagtaaatctttggttacctgggaactagttttaacaagcatctagaatgtccaagcactgagtttaaggggaaaaacacattagctaaaacacaccaccttggaggagccaacagttttactcaatggtatcctgactggttagtgcaggacacacgacaggaatattaacggtgactgatgttatctataaaagctaggcttttttttcttaaaggtgagaatgcagtagagaagcaaaaggtatcaaaggaacaaaagaagaatggcagcaaaagttagaaactaagaaggcagcagcacaaacagatgggtgggtgaatatttgatggagaagacagggatgaaggaaataaaagtcagaccagccttgcaacctggagggagacaaggcagaataattctctgcttaccaaacccatggaacaccagcaggcaagttccctccctggcgtcagggccccgcaatctctctccaggtggggactgggccttttgacttcaacagactctactgcagggaaccagaggccaatgaactctttttcaatgatacctttttcaatgataccttaactgataaagaatgcttatgtggctaaattcctgtctcttgaattaagctactgcaatgaggacacatcaaaaaaacacttccttcatatctctagaataatgtgggttttatctcccccaaggtgacaccaaaacaaatgattaaattgtggtagccttctaaatctgattaatgttattcagactctcccacaaactgtttgccattattacacttgctaattaggagctgtaaggtctttatcttccccaacctacagtcacatgctcaggatggagctttgctaaaagcaggactcctggttaatactgttaatgagtttagcactgccaaaatgtcaatagttttttatttggtcagaaagggcctaatttacctagttcagctgcccttggtaatgttcatggaaatgtcagagcagcaatcaggggaaacaaatggcaataaagatgattactagaagggtgacagcgaaaaccccactgacagactgcttttatttttctctcaccactgcaagatttcattcagagataaggcaacagagtacactgagttcagcacccaacataactgcatattttttctaaagtataattacatttctgcaattttgaaacggacataatacaagaagcttaactgtaaactttcccaaagaaggaagagagaataagaaaatgtttcagggaaagaggtgggaagagctgaactgtttaacattactttctttcatttacaacagggtgtaggatgctaaagaaaagggtacctacaggaggtagatctagatctaactcttttaccacttttggactaggaaaaatgtttatgacttattcgagacaaagattccttctttagcattttcaacttaacctttcttaggtggttaggaatgtaatagttctaagtcagtaatgaataatacggctgttcatctttaggtcatccacgccagggtgtccaaacatgggctatattcactaaagcgtgcaacagaatgtgggggaatgcccatgtacctgtgctgacttcggtggctggactaagcctttcactgatagaattccaaagtttactggggcacacatcaaattcattcaagtttttaggaaaaaagagaaccatacaaaataaagaaaaataaagcactcagcctagtccccaagggctaacgtcctttagaataaaaaacctaggtacccaagataacaatgtgtcgtcccctttgcacccactgcattccctacctaactccctgtatcccacacaatgggacacagaaatgcttcatgttttctgatgtgaggcccatttaacttttttagcatactagatgaagcaaagaataagataacttttccacttagaaagttgagaaacaaaaattccaatgccaaattccatgtgacctgagctatatccctaacttccatgcatgttaccttccaggtaattcatagatccgtgctttttaaatcaaagggcccacacactaccaacactggtgctaagaaaagcctttgacagaaagataactgcttcactttacctcttaaattgccctgcaaaaaatatatatatatacaaacaaaaagctgacataattcaatctctccttggggaaatttaacattttgctaagacaaggataaaaatatttgcttcatttttctatcaatttacctagattaagcatttaaccacgccattgattacagctgtatcactcaaaatgggacccttagtgagcaagtatgttcatgttaagacaatagcaggaaatatacttatctaagaggcctttgtttacatttctaagcacagaattgcaaggatataatgcagctgactcagctgcctgtggattcctatgcgcttaagaaatgtcttgcttttccttgactcagtttcccatcattaacaatggcacagtcatctcttctaccacctacctagaacactagattcacaaatggttgggtaaggattaagcattgtgtacacagtgaggatcccttggctcaagtctggaaccagaaaacagatgaaacccatagacaagaggcctacttataatgaagaaaaagaagaaggttccttatgatcagtcatccttactttagtaaagaatttcctagtgtgaaatttcaaagaaaacctgatatcaagatctgaaataaagggagtaaccatccaggattgccaggactagcatagtttttgcactgaaattcctgggcaaacagaaatagttggtgctatggtttgaatgtgttccccacattgggaatgtgtcctggggaaaacttaatccccagcacaatagtgttaagaggtggaaagttttaagaggtaattaggccataagggctctgcccttacaaatggattaatgacatttatcaggggagtaggttcctcagaaaaggatgagtctgtcccccattcccctcttgccatgtgatgctgtccatgatgttatgaagcagcaagaaggcccctgacagatgacagtccctcaatcttgaacatctcaacttctacaacaatgagccaaataaattcctattaataaattactcagtctgtggcattctgctctaggagcacaaaatgaactgagacagttgaccatccttaacagagactcaaacaagtaagaatatttgcataatcaaagataactgattaacttaaatatagttactttaaactcaattctctgcattaaaaattggagattgtttagctttagcttgtttatatattatctttttctggattttgcttgcaccaaaagggaaatgggtaaggtttaattatctgaggttttgccacttactgtgggagtccaggcaagttatttaacttctctgtctcaagttcctcatcatgtcaggcacacaggaagcactcaactatgagccacaattattatctctaatattgtaagtctagtggaatggccgtatttgttctgctggtgattttcaaataccactcatctgaataaatactatgaattttttcttttaatctcagaggagcctgcaagtataatcaggttgataggctctcctttaattcttctctctttccctgacagatctaaataaaaaaataagcaatttaatttccttcttcaatttaaaattgggctctactgtgctcattttagcataaccaagtgatagaaaattcttttaatgataaaatatcattatttctttctcagtaatttctaattatcaggatacacttgtccatgttaggatatgtttccgcttccaacagctaacctagaaacaggaataagctcatcagaattctagcaacaccagtaacaaaacataattaggttcttggaatttatgagcccattctttcaacaaaatacagtaattattcttttaaaaatgaatatgataatgcttggattgcaaggaaacgaattatgggacattactctgctatcgtatctggcaaggttccctttactttgctgtccttcagtcatttaaattttcaatggcaagcaaatataaccactgattatcacgtgggtaggcagcacagaatcacaaaaacgtaataatgttgactaaatagctgctgtttcttggggctgccagcaaccagagattgtagaaatgggacaagaaagagtttaaagaagttactgttacttattactatttcactattgtgaaaacattaatgaactaaggagagagaactattagttcaataatactagaaagaaaaataaaagaatatcttaatctgtatttatcagaacagtactgaggggctgaaggtgacaatgaacaaacttttggaatagaaagacaaaagcaaagtttcctccaaagcagaaaattcattcattaccagttacagaaggaatgccatgagtatgtgtcctttcccttttctaacaaaatattctaaagggggtcagaggtttcccacttgctcagggttttctaagaactgcccccagggaatgtactgtggatcagcaatgagatcttaggaaagttgatataaagctggaaatcagggattgtatacttcattctgagttatgcctacaacattgcagggtctttctcacttgggtctttgacttttttggtattgggttaagtatgacacagaaatctaataggacataaagtagcagacactcccagccactgaacatacatacaaacttgtaggggaagcaaaacatgagaaacaggatcaggccacattttaaagaatttagatgtgtgtgtgtagagactaaatgcaatacaactgttaggaaagaggggttaaagtaggtatggggtggtgccaaggagaatcagctgtactaaataagggtattttcctgattaattgtattaagcaaatgaatgcaattaacactaggcaaatggtcacaataataaagatcaggaatcttctcatccatattagacgggatgagaaaaaaaaaacagtgagcaatatcaagcctggataggttaaaaagcattatgctctgttcctgtctccttccttcatctcccaagtctgcccactatgttacacccctaattgcactcctaattatgggctcctctcaggatattatgtgtatgactgacattcagggaaagagagggcttcgcctctgcacagaaaaacgctggcttctccagcacatacaaacaggtaaacattgtatacccaacatgtgtatgaagcaggataggggacctccagaagctcatcaagagtgccacacaggggatttacttcagtcacgccatcagacagtaccacttcctgtgatagcttcaatgcttgtaacaatgtgtggtagcaattacagtggagcataaatcagatctgggtgttagaaacttcttggtcccttcttctaaatgatgtgttttagcaaaccaacttccccctaggaaagggggaaaccaatagggaagcatttgtactaaggtgagatcatttaattttgactaaagatacttttgttttgttttgtttgagatggagttttgttcttgttgcccaggctggagtgcagaggcacaatcttggctcactgcaaccactgcctcccgggttcaaatgattctcctgccacagcctcccgagtagctgggattacaggcgcatgccaccacacccggctaatttttgtattttttagtggagatggggtttcaccatgttggccaggctggtcttgaactcctgacctttagtggtccgaccgccttagtctcccaaagtgccaggattacaggtgtgagccaccacccccatcctaaagatattttgaaggttaacagaattgaggccagactagcattttggaagctatttcccatcattcaaagggacaagtttctattacaatcctttggtgggtctaatactgggtgggctatggaatcactaagtataaatgttttcatcatccaagttcccacaatcaactctttctattttcataaatactcatttctgaatgaatgttataccttatgcttgagaaaatgtttgcactgaatgacatttctggctaggaagccaggctctgacacctcctgcaccatgcctagattcccagcttggctttcagcatgccagtgaagtgggggcagagaaaaacaaggccagcttgcaaatgcttcactcacacagcttgtggccttccctttacttcctgaaagccacaaaaacctaagaccatcctagcaaccaaagcctccagccagtccatcgcgcgggtgggccactggattaatgagctccttaaaggaaaaaacaaaaacaccctgaagctacaagcagcccctcctccattgtgctacaaaaatagtaactctgactctaagagctaaattgattatatgacacagtttgccaaaccagtaggtaaaatgttgctctagattagcattttggtcagatacagtttaaacaaaaattaaacttttaacagtacacttgtagttagcaacacagttcaatttaggaacttctcagtaataattttgtcattatttataggaagtcaccattaaaatacagaaacactagcaatgcgtaattgtagcaattttgggccagaaaataaaattcagctacctctgtgattaaaaaggactccactaggccccagggattaagcttcctacattagattggttcacagactttgcaaaacagattaatactaggctcatgcagagacaggtatagcccgccctccatttccatggattctaccaaccatagatcaaaaatttcaggaaaaataagaatacaaataaagaaacaagacagtataacaactatttacatagcattcacactgtattagctattataagtaactagagatgatttaaagtatacaggaggatgcgcatagcttatatgcaaatactacacccttttatatatataaaggactttaacatctacagattttggtgtagcgggaggtcctggaaccaattccccttgaacaccaagggaggctgtatatgtaaaagagtcataggttattaaatgttcaagtgaaattccctttttacaaaacattctaaaattgatttcacttgttttgtttttttttttttttttttaagcaggccaaccccaactcccatcccatacccatggatgggctgtcaaaggccacaggtggcaagaatctcaaggccacagtggccacattgattctggccccaaagggtaaccagtgtgggaacagcacagcagcccatgctggctccccaagctgctgccttcctccttgccccacacgcctcccctgactccctccagacaccctggcagcactccttcaccattgtaaaggcattcttaaataagcaacaggctggagactgagtacgcaggcctgggtagaacaacagatggtcctaatttattatagctatgtgtttggtttttttaaactgaactttatagtctttggattattttacaaagaccaccctggggcatcaaggtacccttgttttttcttctttaacgtcagacaccaattctgcacaatacactgctcagtttcttcatttacactattttccctctctcctcccccactttccttcctttgatctgccctaaagatattagaaaacacaaagttatgtaggtgtgcttataacgaacacagattgaaaacctacatacttactcagtcgttaactgtatattatgatatataagatggactatcagagttattaaaaatcaagttgtttgttttttgagacagggtctggctctgttgcccaggctggagtacagtggtacaatctcggctcactggggcctcgactttccaggctcaagtgatcctcccacttcagcttcccgagtggctgggcctatgtgtactcgtcaccacacccaactaatttttcttcttattttttttttttttttgtagagatggtctcacggtgttaccgaggctggtctacactcctaggctcaagtgattccccccacctcaggcttccaaattgctggaattacaggtgtgagccattgcacctggccaaaaggaatcaagtttttaaaaagaagctatatcaaggaaaacttgaaaaaaatgcagaatatgattctttaaaactcaagtatgatccctttaaagaaatctttataactaaagacataccggccaggcatggtggctcacacctgtaatcccagcactttgggaggcctaggcaggcagatcacctgaggtcaggagttcaagaccagcctggccaacatggtgaaaccccatctctactaaaaaaaaacaaaaaacaaaaacacaaacaaaaaaaaaacagccagacatcatggcgggcacctgtaatcccagctactcgggaggctgaggcagcagaatcgcttgaacccaggaggcagaggttgcagtgagccgagattgtgccactgcactccagcctgggtgacagagtgagactccatctcaaaaaaaaaaaaaaattaccaaaatgttacctgatagtaaaatacaaaattttttgtttactcatttatttcccaagttttgtatgaatatgcactatttttatgatcatgcctgcatactccttactctttatcctgccctttctgtaaggagtccaaggtggaaatgctcatgtgatgtgaactaattaaatttttcttaaaaacaattttaaaaaccatgacttaaaaagcacggtctgctttagttataatggcagattctgaactatacacacatgtattatatatacataaaatgctagaagacagactatggtcctttcatctgcatttgagtacaaacagtaccaaatggttacttcataccactctttatttatgtggtatatgcgatattggcatctactgtggagagactggaataaactatatgtctacatcacccatcagccatctgcattgtgagtgaacagccatgaagaccaaagatgcccaaatcctgacctgtctctgagccttattatccaacagtctactgcacatttccacttagatgaccagcaggcatctcaaactcagaatgcccaaatctagactcatcattcctcacgaactggattttactaggagatctccagtctcacctatcagcagaatcccctcagaaacctgggtattattcccaatgcctgtccttccctgcaacctaccaagccatcttccagctccaacagccatgacaacatggtctgagaaaggagtagcattatgcaaacagcagggacttcaggaatcaaaccctaattgaaacctggccctgccatctaccagacctgtgaccttggacaagatccttaacctgtctgagcttctattctctcacatcaaatgcccctaaagacaggatctgtctcatgggaccatggcatactttaaatgaaggccattcactagaaagtgaatgctgagggtcaggcactattaggcactatgcaggtactagggtcaatggtgaataacagccattgtggtacgaaataccaagtcctcaggcctttacagtgtattaactgctacaatgcgaactacccaatgcaacggggaacacaggagaggagatggaacctagaccgggggtggcaacatcagaaacagttttccaaggtaactaacatttaaactaagtcctatatgatgagcaggaggtagacaagcaaagtttaaggatgtggatagtataccagtggaggaatagcaaatgtgaagttgtgaagtccagagacaaccaggcaccttgaaggtgctgaaatcagcggtgttggctggaggatagaatgtgagcgacgtggctggagatataggtggagtgatcaacagggtatatggggctgggtacctcgaaatgaagggtttctaggcagggaaatgaccaaacaaatgctttcaaagtgcttagcacagctgaatgctcttcttgaaacctttaataactgccttcattctcaccaccatatagtctggtttatgctgtccagaaatttacaaatcaagtgtctctttttgcaagctggccttttccaaatattaacatgttagagtatttttaaaaagcaattttaaaatttttctatgtcgttggtatattaaaggcaagaatataaagggaaaagcccatgagtctttagctggggtttttgatagtcagatgtgcaatgaaaaggttaacttcttttctgagtcataaacctcagaactctccacacaactgatctcagtaacttcccaattccaattgctgtgttaagtagcacttataagacactacatcagcctcatcatttcacgacatggtgtgctccagtttcccacccaacccacataagcaccaatgttcaatgctcagagtcacccgaagcattgcaggctgattgctttgatgaaaacttaattctaccactgaggaatattacagtgtcgtattgtgaatgaaattcacccagtaacccagacctcattggaataccttattaactctatatagtaatctatgaacactgacattaaaaaaaaattagtaaaatgaatttaaaactctttcatttctactggattaagaatcattcaccccagaaaagcaattaacatatttgtctcttgcaaatgaatatcggagcttaactgcatggacttcgtatctttgtaagaaaggatgtctttttgcatgtagaacacaattatagataaaattatcccccaagccccatcttctaatactattcatttttaatttggaaagaaaccttgataagtccagatgcattacgttaccattctcacaagctcttacgaatttttagaataatcagagtatcaatggacaatatacatttaacaatactaatttgtaacaggatgctttgaatatcagaattattactgtgcatcactaaacagttttgttgtattaaaggcaatatgttttaaaaagtatagatgtagcttttgaaatgcataaagggaatacttgcaaaatgaaattgaagtaattctgtaccatactgcttcactagaagtatttcaacaaaataatatggtattgccattcttcacatttatcatttcttaacacaatctgcaacaattccagctcctggagctactcccatcatcccaggactacaacttgcttccattcggcctccacactgatctcttctcttcctgagagaggacacccagagccaagttcagatactctcatgtaatctggctggaaacaaagctctccaaccccagttgtactgggtgggcccctggggctcagtgtttgccttcagaagtagatagaggcgagctgtagcccagatcctttttcatggaaagggaacctgggggtggtgggttccaggggctcacaccgctggttgatataaaagtagttgccctatgtgtaacttttctatctatctcctagtattattttacttattttcattattctttattatcatgtattctgtcaagcacactgcaacaatgtagggtatgttctgatacgaaagcatttctccagccaccagccactctcaccagcaaaggtgctgagacagagacataggtgaacacactgtattatagaattctaagtcgtaagtcagaggggtgaggagtgttgccagacttcatggggtacttggcactcaccaggagttgagaaaggccttccagagaaggtgacatgttgagtctagaagatgagttggtgtcaccagatggagaaacgtcatcacaggaagaaggggcagtatgagctttgttttgagagggcaggagggaggaggaggaagaatactgactacaagaagattttgtattgcacaagacctgtgattctccttttacctgttggatattcagaccaacctaggttggaggcaacagcttagaggtggcagtcaaagccatgggaatggaaaccaccaccataagagagtccatggagatgacccagccatggaagtccaaggggtccaaagctccacaaccaagtgggaggtggaagagcctagggcttaggtttagggcttcttcagttcccttcccattgccctcatggtatatgctggtcagcaaatgaccaaactgcttaacaacttcaaaacactggcaggaatattctaccacttcctccttttgaccattagccaaaacctcaataaagtatcagaggctttaaaaaacttcttgcaaataaaaaaggtagctataaatgaaacacgtggccttcgttgctatgggggatattccaaatcctctcaaacctccagccatcattgctgcttcaaagcaatgctctcaccagtgcttctgtaaccttcttccagttaaccaattgcaactcgtacagtaattcacaaagtgtgcatcactgataaaacttctacagtaattcacaaagtgtgcatcactgataaaatctttacagtaattcacaaagtgtgcatcactgataaaaccttatctccaggaaagaatggtcatgcaccacatgaacacggtctgtttctctgcagtgcatccttattctggacacaggcagtgaccacaatgccacctctctcccatgacctcaatcatgatggtcatccaaaggttactgggcacaagagggattgaaaacaataaacctgggacaaaattagggcaaaagtcataaaaatttaaaaggaattagtattgccacttgttagcttattaacattctggctctgtgaatccagaaaagaaaatacccagtattctgacttgacactatttggataaacattttcccaggcaatgagcttttggcattaaggtagagaaagaaaaaaacaacagcaggcagtgagactctcagcattcctgcatattgttttcatgacatattggtctacacttaagaacttctcttaaattatttgagtgctcacaaatatagctactaatgcttctaaggcacttctactctacttggcatcttcagcaagtaggccctatagtagcaaaatataataataatatagcagcaagaactggcaattactatgtatttactaggcactgtgataatcactatatgggttatgtcactggccttcacaacatttatctagggaaaatacttttattatcactactttataacagggaatgtgcagcccagaaaagcaaccttccccgcatcacctagctaggaagtggcagggctatgatttcagagtctataactttagaaaaaaaatagttttacagacaaagaaactgaagtgacttgacccagtgaagttagcagagaaggtgccaaaaaacagaggcctttcctagtcattcaacttagtatcctgaccccaatatgtcatcactgctagctggggatgttttaatgccaaataaagaagacgctccatctttgacactcagggaattaaagggtttgaaggcagctttatcagcatcagacactttcttcagcagtaattacatgtgtgtccagacagcattttcataagcagttcagatgcccaaaatgagaaacagttttggaagtcgctctgtcaatcctaccaaaaggcatactgacttctgctccctgcttccatcagattatgccaaaagagagacagagacagagagaggataccaaatttgattttaaatctacctattctaagctggaaataaaaactcttcctgtcctggagtccaatgcactcatttttccctctcctcaatcttaacaccctgttaataatcagcccaggcccaacagcctctgaaccactacatttcctacagtagtcccatatggcgcttactcttattcaaatacttcatcaaaagtgctcccaatcaagcatgaaaataaattagattttggtttaatcacgattagagtcacatcaccaagaaataaagtaacagagttacctaatctaacagaccagcctgtgacttcctggctgctttccacaagcccctcttgctaaagccctctcctaaaactcctctttgaagactgtgaaatcacatgttggtggaaaactgttactcttcaaatgtcacagacataattcttaactctgtgcctgcctgacattgctagtcaggccacaagtagagttgctgggtgtcggcctgtgaaaagtagcccggcccgacaaagcatcagaatgcttcttattcttgggcactctggaggagccttcctgggcttgggcagagcccatttattttctgtggagaggctattcactcttgggctgtattttatactcactttcactcctactggaaataccaaggcgtgagtactgtgcaaagccccaatatggagaaaataaaaaatggacaaaggagaagaggactaagggattgataatccagaatatgcaaagaaactctgtaactcaacatcaacaaaagccaaaccagatttaaaaataggttaaggacttgaacagatatttttccaaagaaaatgtataaatggccaataaacacgtgaagagatgctcaacatcactaaccattagggaaatgcaaatcaaacccacaatgagataccacttcacagccattaggatagctacaatcaaaaatataaaaatttttaaaaagaaacggaaaagaacaagtgttatcaaggatgctgagaaattttaaagaaaggagaggcttgaccaatcactccctgtcaacatacagcagctagcaaaccagccaaagagtaagctcatctcattattccccccgcaaaaagaaaggcgtattgtccctgctaggctccaacaatctttgtcaataaaagcctgttgagagcaattacaacacaccctaaaaccacagttaaagctaaaaataaattcttattactaattacagttgatcattgaacaacactggtttgaactgctaatgtttgatccacttacatgtgtaaacttagcttctgccacctgggacagcaaaaccaaacctccctcttcctcctcctcagcctactctacatgaagacgatgaagatgaagacctttatgatgatccactgcatgaataatcaatatattttctcttccttatgattttcttaataacattttctttcctccagcttactttcggactatggtatataatacatgtatcatataaaatgtgttaattgacttatgttatcagtaagtcttctggtcaacagtaggctatcagcaattatgtttttgaggagtctaaagttatgcacagcctgggtgactggcaaaatcccatctctacagaaaatacaaaaagtagccggatgtcttggcatgtgcctctagtcccagctacttgggaggctgaggtgggacgatcacttgagcccagtgggtagaggctgcagactgcattactgtactccagcctgcaaaatggaattctactgcaggggtggcaggttggtgtttctatgccagcatggtttaagggtcaactgtattttgatagtgtgatctgtaataatgttgtatctagatatgatttactgaagaattaaactttctccttttaaaataattacagaatattccaaaacacataccttaatgtaaatatcctgtaatatagaaatagaggaagttgaggcagaagagaaaaaaatatccctgggaattagaaaaataaaatctcagtactacatttccccttttgccactagcaagccttcttcaggcctcagtttctttatcagtcatgcaaatggttaggacaagatatcgcttaagtcaaatatatgcttaatagcaccacccaatagaagcacttcctttgtctgattccatgtttgccaggcaattttctggtcataatctgactgccaagtagtttttcaataggaaataagtgtcagcattccagtctccttgcagttatatttgttataaatcaataaattgatattaaagttcataaaaataaagtctgattctaaatagttgaaggaaatgggtccatgtgacagtggaaggcagttttcaatttttctaattcaaaacccacctatattatacaacatcagcatccatcaatactgaaccatcaatcaagggaaagcaattttcaaatcattcttggccagtgtccatgccactcatttttttaaaccattcctttttaggggaaaatgaattcacatacactgaagatgtcaaaaaaataattacagtgtatttttatggtacataataattacttttgactacagaaaatgatacagtttgaaagtttgggaatatacacaggcttcaaaggcgggaagccaaaggagaggcatctgacgatggatcactctgccctcttctgaaaataccttctttaactggctttcagaacacaactttccaggccttttctttgctaattcctcctcttccctacatctccccctgcctaccccgccccccacccccacaaaatatgaaaagaataagaaagtaaaacaaattcaggcctgcgttggaaactctccagggagatccagatactcttccagggcttatgaagccctaggtgatctggccagaactgttttcttggacctcatctccttccactctccccctgctcactctgctcccagtcattgctgccttgccactcctgaagcatagcaagagtgccctgggctctgcaccttggccctcactcttcctttctgcctgaaatgattgtcccccatcttcacatgactgtgtccctcatttcacagactcccacagtgaagtcttccctgatcactcaaacagcatccctccccatttcattccctgagagtttttcctttacagcacatatcaccactgaacatttgtgtactgtctatgtatctgtgtaggatgcatagaacagggactacatcagttttgtttgttgctgtatccccagtcttacaatagcatctgacatgtagaaggcacacaatatttgttgactgaatatgtgaacggttacaagataataaattacagtcaaaatgaccaaactaaattccatcgaatgggtactttcaccaaaatagaaaaggagttaatccaacacatctgtcacagtaaaatggcaactgggatttggtccaaacaacaacttcaaagactgttgatatcctatctaccacatattgactaggtgctggcaatatagtgatcaactttactctgtctctgccttcaaagacctcatggtctccccaaggaggccaacttgtaagtattctgaacacagataagggaaggaacaactaacctggagacaccgggggccgctgggagaagagcaagaagactctaagagtgctgtgtgttctatggacaagttcacacaacccacaggaaaacaggaacaaggaattactcccactctcaccacataaccagtcagaggcctccattccttttctaactgcaaggccatcttttccctagttggcattcttcctttgacaactgcttcagtatttctcacaaccccagctgaagttaactgacatgcgcacacacattgaggtttcatgaaactttctgttctcaaataatcacacaccatagattttggtttaagatgcatttccacctctggccccataagtcctatgcgcgttccaggcactgatcaaatctcatgacaagggatctgctcaaaatattccaccaaccaaaacatcaggcagccttcaccacacaaatttcccagttcaatgggcttttttattgcttatttacaaagttaacaaactcaacatatggtttttggtatggcaattggaattaatagctgctaactacagaatttttttccctaaaagactttctcaaggtttaaggtctttgctgaatttaagaaatatcttgaaagattcatacatgcaaagtgctttacaaccttattcactcctgtggcaatgaaaacccttgaaaaggtttcctctttcctctctgtaccaattttggctgtttctagtcaacaagagaaaaaggacattggctagaaagacagggtatctctgtagttccagtaaatatttactctataaattgaacttctgtttatctgtgtaatccacattacttgcttttttctttttttcacccccaagagtgaaagatatcactgttgggaatccgggcagatatatgggggaggaaagagggttcaaaaaaataattacatacaatttatctctgctatgacatcctctcaccaatgtaaataatccaagtcctaactaatatctatcaattcttgttgtcttctttggcttgtctgattttataaccttgccaacacaaacccctcctctcagaatctagagatggcttaaaatataattttcattttctgtaatttgattccctggatcaaaaactaactttgaaatcttcatcaacaacttcttttttttgagacagagtctcgctctgtcgcccaggctggagtgctgtggtgcgatcttggctcactgcaacctccacctcctgggttcaagcgattctctgctcagcctcccgagtagctgggattacaagtgcccgccaccatgcccggctaacttttgtatttttagtagagacagagtttcaccatcttggccaggctggtcttgaactctcgacctcatgatccacctgtctcagcctcccaaagtgctgggattacaggcatgagccaccacgcccagcccatcaacagcttcttaattttgctataaatgcaggtttgatcttccaattgcagccccacctgggagaaagccttcctcatgacttgcattgggtaaatcagctaggcagctattacaactgcacacttgactttatttcctgagtatcaccatgacattccctactctagataagtgtgcccactcacactcagggttctggcatctccaattggtagcaactacctctaaggtgcttccttaagataagaagtcttgggacttaaaagcttcccaattggtcaaagcacttcctcagaatcaagcttctctccctgcttccaggtctgtggccatcccagttctgatcacctacctggtctttgagtaacttctctgttcatatcacatgttctcctttttcttgtcttccacctggttccagccaaacgaaccatctctgtggcttgatctactgcacctgatccactgcatttgactcaggacctcaatgtcatgttcagcatgtgcttctgcaagacctggctgtcagccgctgccttgccatgcagccgtggccactaacttcactgggcccctttggctttctccccaagcctcggcactctgcagccccacagtgatttggccaactgtagaaggaacttaaagccctgcctgcagggctgggaaagccctaattcttaagatatttaaagctttattcttctctttctggcacctcaagtattgtaacatcaatctctgagatgtctctgaatacacaggtagtgggtcacaggttgtaatattccaccttccttgcagtgaaaaaaaatagaagtctctctcccaacccccactgaatgaggatcacaactattccttatcgacgaatctgcttttagggctctggaaagtcaatgctttgaattcctccaccacttggaggctatggcagtgactatatccctttactctaatcatatcatttcatttttatcaaaatatctgggtattgcatagggattacaatacaaatcaagttaaacaggcttattaaaatagaatactccctccttggaacatgtgatcaaaagctgagggcagtaacagaagctaatgaaaggaattaatgtacacatggattcctctgagtgtgctctggagaaaggctacctgggcacaaatcttgactccaccttttacagtctgtgtagtttcgatatgcttttcccccttcttatgccataatttctaaacctgtaacatgggaataacagaaggcacctcagagttttagacaagcatgtcaatatctgggaagtgcttagaaaatgtgattcagagttattacaaaccacaaaatgaacagctataaagcaaaacaaaacaaaaaactaaaaaccattgccaggcattgggaattaagaagtcagggttttaaggtaggtgcggtggttcacgcctacaatcccaacactttgggaggctgaggtagatggatcacaaggtcaggagctcaagaccagcctgaccaacacggtgaaactctgtctctactaaaaatacaaaaattagccgggagtggtggcacgtgcctgtaatcccagctactcaggaggctgaggcaggagaattgcttgatcccgggaggcaggttgcagtgagccgagattgcgccactgcactctagcctgggtaacacagagaggctccatctcaaaaaaaaaaaaaaaaatgaaaagaaaaaagaaagaagtcagagttttggacaaggctctgtcattttgtggcttctggagtgggtttaaattggttgcaaattctttgtgacacccctcttggagaggtgttttctacttacttctttaaccttaatctaggctgggaaaacagctgttttgaccaacagaacacacagaaatgatcctgtgcccgtttcacttccatattttaagagaacaggcacctttacctcctctttctcggaacccagctgccatgctgagaggaagcccaagccacatagggatgcccatgttgaagagaattgagctgatctcccaattcacaggcaacattagtttgccattcatatgattaagccatcttggaagtagatcctcttgctctagtcactgacacaagtcttccccctgaactctgcccaaactgcaaatccatgagtaaataagatggttattttcaacctctaaattttggagcagtttgttggattctgcaccaggtcttgaccctgctcttcttacgcttatgctaatgctatggctaagacagacattcaacagctcattacaatgaagtgtgattttctaaaggcagaggactataaagaggcaaaaaagggtgtgtgaatactaggtgatctttcaggccccttccaatgctgatattttataattaatttgatgatgaacagcacagctgcgagctggccacttggagatagtcacacaagataatctaggtagagaacaactttcttctatacaattctccttcttaattagagcatcaacgaagaggtggcatttcaggagttactcaacacgcaaatggtgaaagcatggagagttgcctctatggcctaattcagaagtggaatgatctgatacaaaatgatttgaatgaagatctaagaagaaagtaagggaaatatgatttccaggggcatccaatgtttccaagtaaatagtgatgcagaattttgtctgtccattgtttaaataatgtttaaaaggcaaagagtttaagttgattgctttgtacaaattctttgagtaagaatattttttcatctccagaggttatgattgccatgggagaaattttttaaaaataaatttttatttttgtacataaataggcaactgtctaccagacaaccagatcaagcagacaactactctgcaagaataagtaaagtcaagttttaccctaatattgttaaaccttaagatatcttccttccagatacctgggattatttaacaagattaaactacatactggccccacaaatttaaccaagaccaatagagctaactgctgatctaaaagtcacgaccacgaagaatatgccagagctgtcccttggaagatttcgggagaatttaatgctgcttaaagtgtggccattcggcttcttgatcatgggggagagaggttgaattcaaacatttagtttttgcaatgcttttgatttgcctgatgttgaagtccttccttaatctcaattttaaaaaaaaatcccttcaaatctttatgacaggaacagctatagccaagaaaaaagaacaaatcactagtttatccgtctacattttccttttgtatttctgttgttactgctatgaattcctttgctttcaaaaaagcgttcagacttgacataagccatttatggtcaataaatacataaaaatatgtttgaatgttcatagaggcaattttactatctgctgtaatcaactcaggatcttaaatggctattgttcaaactaaagatacaaaaggaacacactcatgaatttcctgttttccattttgaagtacacatgcaaaacacctcatgcccaacacccatccctaggtctcctaattgtgtatccctcgcacacaaatccctcctatctccctagtatccaagcattcctggagtactaggtgcagaggccaacacctcagtggttgaccaaagcttgctgctgtcactaacaggatcagcagatgacaaccagaaattgattaaactcactctctagttcaggatgttacagagtcagtgtcaacattactgtcaaagagtcaatgacttctgtggctaggggacccttacagaaggagtaagcccgcaagtcaacaccaatgagagccattttgtttatgatacccaggataatggcaggtattttcagagttcttcctacccctgaaatgcctactaaacatcaggctgaaactgaccccacagtgacctctagacagcattgaggctcctgggcaatcagagagatggcactaaaggggccctgaggggttttattagctctgcttccaggtgaggaggaggactcaaccatcaaaagtgaatggcaactttgccctacaagatattaagcgaaaactagtgtttaagagaaaaatgacagggaatagaaacaccaaagatctaatgtgaggaatacaaacgaattgtatttgaatctatggatactgctctgtggatattagaaaaatggtaaatactaaagttattgcccatgttaaattgaactgagatttagggtccacaaggtatgaaccacacactctcttgccttacaaattatctttacacatattctaatttaaaatatgtacaagccgaggcaggcggatctctttaggccaggagtttgagaccagcctggccaacatagcgaaacctcttctctactaaaaatataaaaaaattagctgggcgtagtggcacatgcctgtaattccagctactcgggagactgaggtaagagaatcgcttgaacccgggaggcagaggttgcagtgagccgagattgcaccactgcactccagcatgggtgacagagtgagactctgtctccaaaaaataaataaataaaaatttaaaaaattagtgcagaaagtaaaaataactaccattcaacctgcaggataactaacattgattggaaagaggtacaactaaatcatggtacctaaaactggctcgaaagcaagcaaaaaatgaatgagcagacaccgatgagaagaaaagaacatctggtaaaggatatagctgaggaaggaacttatttccttaggaacaatattatgtcatatactgctcaaatagttttccagccaatgcagggactacaaagcactctcaactctttcatttgcctacaagctttatagggattacttagggagtggatacaactaggcaaaaaaaatgggtaattttatgtggcacctgagtgtcacattctctgctcacccaatgtgctcaaggacgtgccaataggactaaagtcaattcacatctcttccttcactcagggttctagcccccccttctcctaagtctgcgattcatttaaacaaaggttactggacagcactctgctgcatagaaacatcgtgaagggcctggcaaagagtctctgcaaaagaaatgccttcagttttggggttttcaatgaccttagaagatcaccaaaggcttctcctgaaacagggttagtgatggagcagggccctgggttctagttcagatttgagaccgttaattataaaattggcaaaagtcacttaaatcctcatgcctcctccctcacctcccatttttaagttctcactctcagcatttcttgagtcttctacatcacaggggcaacagccgttaaggattagcaaatgctctacttcattcagccagcacctcaaaatgctatttcaaaccggagcaggaacagcacagcagcagcatgacacttaagagcaccaggcagggcccaatagcattcaccagcccgacggcagacctcctaggtttcccccaaccccatttaatcccccctctttcccatcaccaggtgttccctcacacacacacacccccgcaggggctccatccctgcatttttcccttcaccattggtagtctgacatcaccattatctgccttccggctgcttttacactgttttccttttcttcctctttcctctcttcagccatactcaagaaacacggactacttatgctacttttgcccccataaatggctcagtgatggaaccaagagggaaacccacagacaccaagcctctagctgtagacactaagcacacagacttcctcttcttttcagcacccagttctacgggcttctcatcacttttcaggtattcaaagctttgagggatgtgcccgaagcatccctaaaatcatgaaaaaagatggctttgggcatcttaccgctcacacatttgcatagtgtttgatgtagctttaatttcaaagctggtctcaaacactcaagtggataggttacagtgggagcccaggaattgcaaatgcgcttgcctcaaagactcaggagtccagatccgggcaggaaataaagttctaaagcggctttgaagtgctttctccccagacccctccccagcgcgggtcattcatctcagcctagggaagagaccaccttgcctgaacgtagccaaacgcatcgcacgtgggagccaagtgggagatgaaataatccaatgcgtccccctcaccaccaccacccccaccaaattagttaccgtcggcttaaactcatcgggaatgtccgtgtattttaccgatcagggaaataaaagggtgtatataaattagtggaagcgggtgggaaggaacaagggatgcagactgtcgtgagtaaaacgcctcgcggcttggtgagaggttgtttcttttttaagccactcatttcagactgaaatatcaagccagttcaggtcatttcctgagtagcactacaagttaaaacaagatccagaaaatctactaatcttcaattgcgctgcctccagactgggagcacagggggatagggtgtagggctgtggggaggtcgaggggagggggatttgtggaaaagcaaacgcccgagaaaccctagctcccgacctcagctgtttcttacctcactcagctcggccgaggagtcgtttccatatttcatggcaactccggaattcatgatgcacttttcagagctgggctctcagtcccccaggtctcggagcttaagagttggacttcacaggctcaatatccactgcttggtcccttctgccacattttagtctagacagccattttcacccaggacagttgcgaagcgcaaacggaggatgcaggcactcttaaaaagagcagccgtggctcgcgtttcacggacgagccattgctgcaggaggctcggtggcgcggcgcgctcgcagctgcggcagcggcggagcccgcgcggggaccctcccgcgcgcacccagcgccccgttccggggcagtgccaccctgggcgccgcctcgccactcctacggtgcctcgccgccccccattaccaggatggagggcacttcccagcacgagccgacaccctagagggcaccggcgagctcccgaaaaaactagggcggtggggcgaggaagatccgcgcctcggattccagagaaggaaagaaagctagagggagccggagcggagctgcacttcacgccgaagtttccccttcgaatcgtctggagttgtaagtggtttctgattgaacacagctgtctagctgctggccacggggtgcgcggaggaggcggggctagagggagaaaagggtgggggcgagtagcctggaggccgagcagaggagaccgtgctgggagagcagagcaggcatccttccagttctctgcaatagtaattaaggacccgagtccaggagggggagtagaaacaggaaaagccacctgaataatcgtgcaggaaattaaaaaaaaaaaaagaaaagaaaaagaaaaaaaacttccctcataggagccgctttccatgatttaataaggtcaagacaaacctaaacactgtacatcagacagcacggtgcacttctcacggaacattaagattttacaagggtgcagggcagtcattttccctaatcagtctaaagtcaacgctacgggtgtaaattcaatgtcaaactccctctgtctgtcactggggcagagtacattttctgcatgtccataatgaagatagaggccccatcccttgaaagatgtcgataggctccccaacccccatcccttgaaagatgtcagataggctcctcaacccccatcccttgaaagatgtcagataggctccccaacccccagaccttccttaattgagcggaggtagagttgtatttatggagtgtggagtatgattcagaaaagattcaaggggctgttatacccagtacacccctgggatctgagctccccttcaactttgagttcccgaggtaaaacatcctgtgtctattgggagagagatgagatgggggaagaggggaactaggatttttctctccacaaacttaaagttccaatgaatttgagatgcacagaaaaatgttctgatgcttcaaaacagtaggtctgcgagattgcttaagagacctcatcagtctctttctacacaatggggacaaaatgtctccatccccaataacagaacttggcatatcctgaagccttctgtgaaaaagccattgtattgtcaacttccatggtctttttaaaaaatcatgtttattttgctctttaagaaggggcagagtgcaactatttgcatataacgttttacccatcccccttcttgttgagttcattcattgcctgatggaggtgctgctgggattaggaagagtttgctgctctttctagagcactgggtcccaagtccttgggcactgccaaactagagcacattctgcatggggaggagatgggaagctacattatttaatttatcttttcattgaaatctgttgaaaactgcatgtttgaagctggaaatggtggtatatacataactatgaagaagattcaagcactgcccctgccctgaaggtgtttatagacttgtaaaacatgaacagaaatgacaattctagatagaaaatgatacttgccataaacacagtacaaatgaggagcgactgcagttcagaggagggaaatacgattttggctggacagggtctggagagaagattctgtgaaggaatcttagaagaggcagcatgtgagttgacctgtgaagaatggctgagcccagcagagatgggaagtaaggggaaagcgttccaggccactgtgagagaaagtatggatggagactggaatgtgcagagcgggcatggggatcacaggcattccattctggagcataagctgggtgagaaaggggggttggtgtcagacagtgaacagttttaagtgccatgttaaaaaaatgggccttctcaataggcaatggagagccactaaaggttttttagcatagaaataatggagatcagagctgtgcttttagatattccagtagatttaaatcacactcatgagtaactaatatgaactcaaataggctagtgttgaatgtgattctggtgtttaaagatacatatttttcatacgactctacccctaaaaccaagcagatgacttcatctggtgttcaaccaaaagaaaagtaatctgttccaaaagtagaggaaaaactagcagtgttgaacttactgagaagcagtgtctgtagattctactttatagacaatataaggcattttcaagggtaatgttgattgtatgagattttcttcataaacaatgacttgaatacttcaatacttatacttcacataagattcaactccaccacaatctggcagcagcagatgtagtaggttgaaagtgggaaatgaacatgccgattgtactatcaagacagttcagcaagaggttaaaagggcctgaattaagaagggacggctggcatggtggctcatgcctgtaatcccagcatttgggaggctgaggcgggcagatcacttgaggtcaggaattcaaggtccagcctagccaacatggtaaaaccctgtctctactaggatcatgaggtcaagagtttgagaccaggctggccaacatggtgataccctgtctctaataaaaatagaaaaaattagctgggcgtggtggcaggtgcctgtaatcccagctactcgggaggctgagaaggagaatcgcttgaacctgggagatggaggttgcagtaagccgagaccgcaccaccacactccagcctgggcaacagagtgagacaccatctcaaaaaaaaataataataatactaaacttagccaggcatggtggtgtgcaccatgtagtcccagctgtagtcccagctactcaggaggctgaggcacgagaaccacttgaaccaggaggcagatgttgcagtgcgtcaagatcgtgccactgcactccaccctgggtgacagagtgactctgtctcaaaaaaaaaaaaaaaaaaaaaaaaagaagggacaatggaaataggaggggacaggcagaaagaaagtagatggaaattgtggagaaaacaggagagcttaaaaacaacttgtagatctagaacttggctgattggggttaaggtaatgtcctcaacaaaattaggaattccagagaataaatagctttgggaggaaattaggtttgtggtatcatgagtttgaggtggcatcaggatattcaaatggagatgttcagcaggagcttgaaatggaattatggagataagtcagggttgagctggagatggaggttcgaggttatctctgttagaataataaataaaaccgtgaaatcaggtaaatttgcctaggaagagaggacagtgaaaagaaaagtggtctaaggatactaccttaaggaaggctgttttgttttgtttttatggaggccaaagaataaaagaggaaatgatacagaaggtcaattagggaaatgggaagataaccaggagacctctgcatctgggagtctaaggaagatgccaaggcagaaggaggagcagcatcaatattatatgctacagagggtagagaagcctactgactgataaggtcatttcaaagacattactgtccttcaaagatagattcctataaagctgaggagaaagaaggcagataaattaccatagggagtgaggagaaactgggggtagtgaccatgcacaattctttccataaatttgatggtgacaggaaaatgggagatgagactatcttttggagtagataagcaatgttgaatagagagtagaatgggtgtatttgtaagctggagctaagggaaaccaggagatggagcaaagttcctaaaaagggagaaaaggggagcaggtgtcaaggacaaaaactatgagattagctttggagtaggcttggataggaggggatgctgatacttcttcctaggagaacagaaacaagagaacgagagagtgtacacagtagggaagacaagaattcagagatataataactaatacttatttgacgagtaaactaacttcctctttgtaattgtgaaggggaaacgaagactaatgataatttgtaatcagattctgactcaaggaaagttagacagagaaatgcctgtcaatgcaagggaataagcagttgtgatccccactcctgaaattgttcaagtataggtgggacatgctgaaccccattgcatgtaaagagtagggcttccaggccggatgcagtggctcacacctgtaatcccagctctttgggaggccaacacaggcggatcacgaggtcaccagttcgagagcagcctgaccaacatggtgaaacccccgtctctactaaaaatacaaaaattagctgggcgtggtggcacacacctataatcccagatactcaggaggctgaggcaggagaatcgcttgaacctgggaggcggaggttgcagtgaaccgagccgagatcacgctactgcactccagcctgggcaacagagtgagactccgtctcaaaaaaaaaaaaaaaaaaaaaaaaaaaaaaaaaaaaaaaaaaaaaaaaaaaaaagagtagggcttcttgcattgagggagtctagactggttttcttataatgtaaaattccatgaaatgatttttgttggtggtaatttaaatgtcttacgattttttttcacctcattgtcttggatctctgctatcaagaaagctaagatactgctttgaacaagaatgcaactgggtcaatattataagaacgttagaaacatatggaccaactcgtcatgtcttctcaacacaccaaagaataaagccccaagtaggtttcaggctataagtaaaaggtttcacaattagagcttgccagcgtttaccaagtgtataactctacatgactacaaatcctgttatactgtggctgccttaacatgatctctccaagaaagcttctccaagtcctcctgcttcagcagggattaagctcctatggagaggtgtgggcaggaggtggcaggggaatttatcaagatgagggagcaggtctgggagaaggaggaaaacctgctttgcaatcaggcaatagcctggtgcttgggttcctctccttcctgaggccttgtcttctctaaagcccagtctcttctcatctggtccctgggatgagaagaggcagcagcagtcttgggaacatttctaggtaagtggaagctgccctgggcatgactggatgaggctgtgcaccaacaccatgctgtgggcacactggcatcacctttctgctgttagagcagtctggcctctctgtgtatggctgccgacttcagtgaatctctacatggcagaaactctattctgggtctggtctgtaccctctactggtgataaacatcaggttaattgaagcaatcttgagaaaaaaccctgaacctctagcactagggaaactgaaaaccttggaattagttggcctggtccactgtctctacccctggggtgccccagcgatccttgcctaccccagcagtccactgtgctgaggaagcctgtcctccagcccacaagagtacccaaactctaaaattgtccccttctccattgactctctcaagctaaacaaaacgctgatacctcagattttaggttgaaagcagtctggttaaactaattcacacacacgtgaataatcttctcaaccacgcccagagtgtttacattgtaaaaggagaatgctttgaaataattcttaaattggtgggatttcctgaagaaagtgaattttgagggcatagggggatttcagaaccctatggagactcaggaagtctcagtcctttgagtccttgaggatcataaaaattagggagccctcaaagtacatactccaaagaatttcctgccctaaatctataagctcaccccactctcccaccgctgtgactccagaaatgctctccctatccaaactcctgtggccttctgatcaattaccggaccagctcctctctcaggtcctggtttgggagcctctcaccagcctcaatggcctgccccataacggacatcatttgctcaaggaactacaacatgaagaactcaggaagcattgcaatgaatgatctgtatcctcatctctatatcctcagagaaaaacatggacaacctgcaaggaattctgtagttacctagctcatccctgcatcccattcatatagatgaggatatgtagggtcggcgagtttgtggtgttcattcagaaaaagtaaagcacccactgtgtgctagatattgtcctgcatgtgccctgggattcagtggtgtatgggatggaaaagatccctgctttcacagagctagcactcttgatgggaaatgattaataagtacctttaaagagatagttacaggccgggcatggtggctcacgcctgtaatcccagcactttgggaggccaaggcgggtgggtcacccgaggtcgggagttcaagaccagcctgaccaacatggagaaaccccatctctactaaaaatacaaaattagccaggtgtggtggtgcatgcctgtaatcccagctacttgggaggctgagggaggagaatcgcttgaacacaggaggcagaggttgcggcgagccgagatcacgccattgcaccccagcctgggcaacaagagcaaaactccatctcaaacaaaagaaaaaaaaaaagatagttatagggcaacaagagtgaaattccatctcaaagaaaagaaaaaaagatagttgtagtttgtgttggatgctataaaggaattaaacaggagctatgataggggagagtaggccccttaagtgaacaggtcagacaaggcctctatgcagagatgacatttcagcatgtaggtaaagaaggagccaactaggcaaaaagtgagggaagggtggacaggcagagggaacagtaagggcaaaaagcctagggaaacagggcttcacctttttaatacattttaataaacttcaagtttttatttaattgaaatttaagctcattataatagtttactagcagtgatggaacatgatgaaaaagatcatgtcagagccaaatcgtgcagaatatgtatagactacacatttcactgtgtgcatgaagatgccacaggaagactttctgcagggcaaagacatgatccagtttacatttttaaaaggtaaatctatgtcttcacaagctttaccactaggtaacctaaaaagtaaaaaccaaggacagttcctccctcatacaagtatcgctgctaataaattaagaattgacaaaatatccctgttttgcaacccttaatgaattaatagatttaagtattagcataatggctacgaacattacaaaaggacatagagccagacacatgatttctgatggaagaaaacattaccacctacagagccaccttagcagtttttacatgaagaaatgttacattaaccacaaaaaaaaccctatataactctactagacaaaacaatgtggtttcttcatcaaataaaatgcaaagggaaaaagggaagtaagcaaatgagaaaccaccaaaagaaaaactctgcatattaaaagagactcaaagacatatcgaccaatggcaatatgtggactttgttgagatcctgattcaaacaaagtaactataaaaaattatgaattgtgaaaattacatattatacagtattcagaaatatactttttggatatttcatgatgttaagaaattattaatatttttagatgtgttaatggtcttgtggttacatttaaagaaaaagaatcctgtattttagagatatattaaaatatttaggggtaaaatgacatgatgtctgggattcatgtcaaagtactagaggaggtgggaagacagggttattgatgaaacaaactgtaatgatgaattgataactactatagctcagtgataggtatgtgggaattcatgctactcgctgtccaagtgtatgtgtacaaatcttcaaaatcaacaagttaaatcaagataattattccttctgtgtaaaaactgggttgaagtgccataaaagtaaggcaaggaaacctgttaaaggctattgcagtggtccaggtaagaggatgtttgtggcttagaacttggtgaaatcaatggagatggtaagaaatggacttgagatgtattttttaggtaaaactgaccaggattcagtgaatgattggatacaggtaatgagagaaagataggaatcaaggatgactaccagtttttgggttggtgtggggaaggaccaagtttcgcagaggaaatcaagtgttccatgttggatgtgttaaatctgagattcctatttgacatctaaggggatgtcaatagcagttgcatatatgcatcttgggttcatgagagactccagaaaatggtgatgatttggaacttattggcatatagattatagttgatgttgaaggtcatgagaacatatgaggtcaccaagggagagagtgagtaataatgcagtcccaggacttatccttgagatccttaattctttcaggttggatagaaattaccttccaccaaaaccaactttaattgcagcttacagatttctgtaaatagaatcataagaaagaacatccagagaagaacagaaaaactgaaaactgtatcatgttttaagaaggacagtggtaacctgtgtgggatgctgctgagagtttaagaaagctgacaatgaagaagtgtcatctggctttggagattactagggaccttgagagaatcaatgtcattaagtggtggtgatagaaattagacgagtgtggattgaatggtgtgtaggaagtgaaaacactgagagagcatatggagataacttcttttttttgagacagagtctcactctgtcgcccaggcaatggcgcaatctcagctcactgcaacctccacctcccaggttcaagtgattcccctgcctcagcctcccaagtagctgggattacagtcgccagccactatgcccagctaatttgtttgtatttttagtagagacggggtttcaccatgttggccaggctggtctcgaactcctgacttcaggtgatccacccgcctcggcctcccaaagtgctaggttttcaggcttgagccaccacgctagcctggaggtaacttttgggaagtatgttgcccaaagccttactactagtaaactatgagaatgagatcttgaaccaaagtctctacttgtacttctgagcttttcttcctttactatgtcccttcagtcaagctagtagaagcacctcggcaaggattagagaatctgggctgttagcatggttgacccctcctaaaactgctcactgaagtctgtcccatcatggccaggtcttcaccttattgttcatgaagtcagctacactgctttagacccagtgacttaccactaaaaaatagttgggatgcagtaggtaatttggttagtctatgtttaaaactggctaagaaaagaactacttgaagactatttccagattacatctcacatacagaaaaaacaaacaaaaacccaaccttctccaactgcaaatataactcaagcaaagaaagcacccccgtggtgtttgtctgtctcattagttacatttacagactgcttcacacccagcctaggcatcctaataacccacagtcatttggcatcaacatctccgacattatcagtggggatttgataatgatttgagattcactactttatgcaagcatcatgtgatgcatcaaataccccttcactgtctgattagatattttcgagcctaaaacttagtatctgtgtcattgtcaatattcagagtatctttcaaaaatttttgctcatttgttctccaaatttctttaaactatatcacattttctatggaaaggaaaattaatcagtggagattagagatttggaaatccaaggaagttaaaaaaaaaagttttgagtcctcccaggagtacctgcatatggtcaatttcctggagaggaaaacaaaaaaagtattttaaatagatgcataaaaatagatctagtaaaatttggagaacatgcttaaattaaatgaattccaaatgcctgccactgttatttctggagctgtttgggctaaaacagcatcattccattactgtctcttagctagaatgttacggcagctacccaaaaggggcaaaaaaaaaaatgagtatgatatgatgcctcatatacttaataataaaggagtcagttaacctggtattgtatcaagctgaggggtgaaggaaggtctgaggcacaggctgggaaagccaccttcctagcctttgagttcatgaagtgcccatggatggactgctatggtagggatttcctacagggacaggctgaggcatgaagaatgggctcctgcctactttgataagacagcttccctctcccagccatcctcagttgttttgcatgattatcacatgagctcaaacttccccttctaagcaaatcctttcaaattggcatctccagctactcttacctgtgctccagttaatattctttatgtgacaaccagacactcttgctaagttctgtcatcactataaaaccatgtttaaagcagaatttgtcaccttccaccaaaaaccaactttaattgcagcttacaaatttgtgtaaatggaatcatagtttccagtctaataagtttggagtcattttcagttccccttccttcatcttctcttccagtcatgtagtcctttcgtccccacttgctctccacttttaccgcttagcagcacctttcccaggccttgtcaccttacattttggttactatagctcaatgatatgactccaaagcattccatatactctagcccagcgatttttctccaaagtacagttttccgtaatgtcattctacaagttatattttatgttttattaatggataattcacatatcataaaatttaccttttaacataatttagtggtttttagtatattcacagagttgtgcagccatcaccactatcttatttagaacattttcatcacccccaaacgaaattcatactcattagcagtcactctgtatgtatccctcctccagccctggcaaacacaagtctacgttgtgtctctggatttacctattctggacacaccatataaacagagtaagacaatatgtggctctttgtatacggcttctttcacttagcctgttttcaagttttatccatgttgtatatgtattaatggttcattcctttttattgccaaataatattccattatatgggtttaccatattttgtttatccgttcatcaattgatgaatatttttgttgtttccatttttcaactattatgaataatgttgctatgaacatttgtgagcaagtttttaatatggacatatgttttcaattctctcgggtatatacctaagaatggaattgcttggtaatagggcaattttatctttaagattttaaggaactaccaaattactataatttccaagatggctgcaccatttcacattcccactagccatgtatgagggtttcaatttctctacatctttgccaacacttactgtctttattcttgctatgtggctttgatttgcattaccctaaagattgataatgttgaacatcttttcatgtgtttgtaggccatttgtatatcttctctggagaaatgtttattcaaatcctttgcccatttttaaattgggttgtctttttattgtttaattttaagatttctttatatactctggagattagacctttagcagatataaatttgcaaatattctctcccattttgtgagctgtcttttccctttcttggtagagccctttgaaacatcaaaattttaatttaatgaagtccaatttatctattttttcttttattgcttatgcttttggtgccatatttaataaatgattgcctaatgcaaggtcacaaagatttactcctattgttttcctctaataatttttttagttttagcccttatgttgaggtcaatgatccattttttgttaacttattattgaaaaaaaaagtattctttcctcccactgaataatttttgtacccttgtcaaaaaccaattagccataaatataaagatttatttctggactctcaattctattccacttatttgtatgtccatccttatgctaatactacacatcttggttattggagtttcatacaaagatttaaaatcagaacgtgtgttgagtcctccaactttgttcttcttcagggttgcttgggctcttctgagtcccttgcatttcaaagaattttaggatcagcttgttattgtgccaagtagacagatgaaattttgataggcgtgcacggagtctgtagatcagtttgggaatatcgacattttaataatattaggtcttccaatccatgaacataggtgtcttttcgtttacttaagtttgctttgattcttttcaatggcattttgtagttttccatgtataaatcttgtacttctcttgttaaatttattcctaagtattttattcttttttaatctattgtaaatgaaatgtttttcttaattacatttttagattgtttatgaatgtacagaattgcaattgatttttgcacattgatcttgtatcttgcaagcttgctgaactcatttattagttctaaccttttggtgtatttcttggaattttctatatacaagataatgtcatctgcaaatagagatttttttacttcttcttttacaatctggatgtttttatttctttttcttatttagctgtcctagctagcatctctagtataatgctgaatagaaatggaaagagcagacaactttgtcttgtgctgctcttggcagggtggaggggaggcattcagtcttttaccattaaaaatgatgttagctgtaggttttttgtagattcccctttttcttcaataaatttttatccctgaccacttgaatggaaaacacttcttccatttaaatgcaagtcaaggtgtcttcttactatctttcccaagctcattcccacattaatgtatcttcctgttgctctttctcctgcgtggagtgtcagctccatttgcctgtctaaatcctttttttttttttctaaagacagagtgttgctctgtcacctaggctggagtgcagtggcacgatcatggcccactgcagcctcaacttttcaggctcaagcaatcctcccacctgagcctccccaatagctgagactacagacgtgcaccaccatgcctagctaattttttatatatattgtagagacaaggtcttgcaatgttgcccagggtggtgcctgtctaaatcttaacaattctttggtgcctgtctaaatcttaacaactttttaactcttgtcctgacattaacctttctgttctctgaagtccttcagcactctcaccttgatagctccattaaaaggtgagctgtatgatgctcagttcaattaattaaagagaaaaacagggctggtatgactgtatcagtattagaaaatattaggaaacaattcttactgagttggtacatgactactgccccaaaccagagagtgcccactccctcctcaggttgccccatccccatctctaaaaacctccagacctttccacagtttagcagccataagactaacactttgggctaggcatggtggctcatgccaataatcccaccactttgggaggctaaggcaggaggattgcttgagcccaggagttccagaccagtctgggcaacatagggagacctttgtctctacagaaaatctaacaaaaattatccaggcctggtcccagctactcaggacgctgaagtgggaggattgcttgagtccaaggccaccttgagccatgattttgccatggtactccagcctgggagacagagcaagaccctaagaccctgcaaaaaaaaagaaagaaagaaagagagagacagaaaaaaagagagaaagataaaggaaaagaaggaaaggaaggaaggaaggaaggaaaagaaagagagggactaacattttgattttgcacaaccaaggtttctaaaatcttcctccattgctatggctagtccccattgacaagtattttgaatattattcctggagaaaagaggccatatttttaaaatgaagccagagtcaaataataaatctctttatcaaagatactcaattacattgtccaattaaactatcatcatgctcttacagaatttcctaacagaatttgaatcaacatcccccaactcctttaccactctctgaatatgaaacccatttactgttatacattcttttttaaatttcagtagctttagaggtacaagtgatttttggttacatcgataaactgtataatgtggagtctggactttttagtgtagccatcactcaaatagtgtacactgtagccaataggtaattttttaccccgtgttcttctcccaccctcccccactgagtctcccatgtccactctgcatgcctctgcatacccatgcatgcagcactttgctggcatccccacagcttatctcccatttataagtgagaatatgtggtatttggctttctattcccaggttacttcccttaggataatagactccagttccatccaagttgctgcaaagacagtatttcattgtttttttccaatggctcagtagtattccattatatctacacatatatacacacacaccatgttttctttacccactcatctgttgatgcgcacttaggtttattccatatcttcatgattgtgaattgtgctgtgacaaacatatgaatgcaggtgtcttatttatataatgacttctttttctttgagtagatatccagtatctgggtattgctgtatcaaatggtctgttacacattcttaacaatacatttcatttctttcctttctttctttcctttcaccttctttctttcattccttcttcctccctccctctcgcccttccccccttcctttcttccttccttctttccttccttccttccttcttccctccctccctccctctcttcctctctttcttctgtgtttcataccattatcaatattttagaatttcatattctagaactaaccaggctctgaaatacttggcttattttcccagttataaggaatacacgatttgaaggcaccagcagcctactcttggcccttcagagcctgttatgtggaagcctgctatggtttgaatgagggtgtccccttcacaattcatattgaaacttaatccccaatggaacagcgttaagaggtgtggcctttgggaaggctccactctcataaatgagattaatacccttacaaaagggcttgaggttgaatggagtgctcttttgctcttctgcttttttcaccatatgaggatacagtgttcctcccctccagaggagatagcaacaggggtgccaacttggaagcagagagcagcccttaccagctaccaatccttctagcgccttgcttttgaacttcccagcctccagaacgctaagaaataaagttctgttctttaaaaatcacctagtctgtggtatcctgttacagcagcacaaatgaatgaagataaagcctatgacatatgagaaagctagcccaaacctttgtccaaactaatgaaaactacttatttttttcatatctaaattattaagtttttgttctgtttcttcacatagttcatatctcacctttttcatttgaaattatttttcaaacaccttccactactgtcactagtgatagagagggaaatgtgtcacatgggaaataaaagctaaccctgaaatgcaaacagctactatttgggagaatttgggaatttgaaaaaacacaaaatggataacaatattggactaatttattttatctttcttaaggtgggaacctccttcaaaagtggacatttctctggattcttgagacaactgcattaaattaatgctttttcatattccatccttccttcattaaaaaaatatttatcacccactatgtgccaagtatcttgttgggtactagagatataatagcaattaaaaagaagtccaccagctgggcacagtggctcatgcctgtaaatctcagtactttgagagacagagaagtgaggatcacttggatgcaggagttcatggttacagtgagctgtgatcaagccactgcacttcagtctgggtgacagagcaagacctgtctcttaaaaattaaagaggtacaccatcattgccttcagttaaacttagagtcagtttgtggtagaatgcaaagatggccccatactttacccatgcctgtaaacatgtcctttgcctataactttgtagtaccctcccactctgactctggacttgtccatgtgactaactttggccaacagaataagatggaattaatggtatgcccgtgtctcctccttaggagtctgtcatgtttcctcttacatatctgccgctaacgtgagtgcatgtctaggccagccttctggaggataagagacaggttcagcagttgctctagtcacccaaaccaaggtctggccagatcagccatcaagccagcttatcctcagatatatgagtgagtccaggctttacagtcaagaacagcagctgccctgccgacctgcaactgaccccaaatacatgagcaataaacacttattggtgaatgtcactgatatagtcttttaaaattacacaacattgttgtggcaacagataactgacacattgcttaatcattaaaaaaaaataatagctggccgggcatggtggctcacgcctgtaatcccagcattttgggaggctgaggcgggtggatcactgaagtcaggagttcaagaccagcttgggcaacatggtaaaaccccgtctctactaaaaatacaaaaattaggctgggcgcggtggctgatgcctataatcccagcactttgggaggctgaggcgggcagatcacaaggtcaggagttagagaacagcctggccaatatggtgaaacgttgtctctactaaaaatacaaaaattagctgggtgtgatggtgggcacctgtaatcccagctactcaggaggctgaggcaggagaatcgcttgaaaccgggcggcagagtttgcagtgagccgaggtcgcgccactgcactccagcctggctgacagagcgagactccatctcaaaaaaacaaacaaacaaaaaattagctgggtgtggtagcatacacctgtggtcccagctactggggaggctgaggcaggagaatcacttgaacctgggaggcagaggttgcagtgagctgagatcacaccactgcactctagtctgggcaacaaagcagaactctgtctgaaaaaaaaaaacctataaaactgcaatgtcttctctgaaggacagggaatacagaaatatgaatacatataacagagttcacatagactggtggggagtgaggttaaggaacatttctttaaggaagagatgtctgacctaagatctggaagacatgcagaagttaaccaggtgaagggtaggggaaagaggtgttcaagtcacagaaacttcaaatacaaaggccctgtagggaaggagtacagatgctgagttacttagaaggtcaatgcagctggagaatggagataaagaagagaatgcaaagaaatgaggctgggatgataggcagtgactagaacaaatgaaaggctttgtagatgatgtgaagggtttaagacttgatccaaagaactatgagaactactgaatggttttaagatggatacaagttattcttctcacatgcttactttgctatgaaatgggtagggagtttctcatatatataccttgaaatttgcccataaaattcataatctagtcctgaaaaaaatatttatttatccatctatttagtcaatgaacatttattgagaggtttcagttgggaataaataaatgattgagagattaaatgaatgaatgagcctgtgtcaagcaatctgattggcactggagagacacaaacacaagattcctcctcttgataagctcacagtctagtggggaagagagacacacaaaaaacagacttccttgttaacccagagaaatatgagcaatgtgctttaaaagtgtagagaaggggcctggcatggtgactcatgcctgtaatcccagcactttgggaggccgaggcaggtgaatcatgaggtcaggagttcatgaccagcctggccaacatggtgaaaccccgtctctactaaaaataccaaaaaattagctgggtgtggtggtgcgcacctataatcctagctactcgggaggctgaggcaggagaatcgcttgaacccaggaggcggaggttgcagtgagccaagatggcaccactgcactccagcgtggtgacagcaaaactccgtctcaaaaacaaaaaacaaacaaacaaacaacaaaaacgtgtagagaaggaacatctagttctgtgaaggccaaattgcactcactgaaagcaaagtgagcttgaggaaattatggctcctattctggcccgagagttcctgtcatatctgatagcggtggttggggaggaaggagggttggagatatgatggcaatggcgagctactaaggaaaagagatctggagcactttctactctggaagtccatctcctaatgcaggagtcacagatcagtattggccttcagctattttcttgggttcctatttactagggatgttctttatgcatcatctggtggaagactccagagagtctggaaagattcttatatttctaaatagatattccatattctctcaaagctcccagggagacctgtataataatctgccattttctttctctctctctctgtctgttttttgttttgttttgtttgtttgtttgtttgtttcagacagagtcttgctctgttgcccacgctggagtgcagtggtgtgatcacagctcactgcagccttggcctcctgggctcaagtgatcctcccgcttcggcctcccaagtagctgggaccacaggtgcaggccaccatgcctggctaattgttattttttgcagagacatgatctcactatgttgcccaggttggtcttaaactcctaggcttaagcaatcctcctgcctcagcctcccaaagtgctgggattacaggtgtgagccactgcacttggcagatatctataattctaaacagatattccagattctctcaaacctcccagggaggcctgtataaaatctgtcattttctaggcaaaatgatagagtataatttaaaaatcatggggcttcattttgcctttaattggagttttaaaatgatagaatagacaaataagagctcatttttctaattacaatttggatggacttgggagtgaaggctggatgactgtgtccttcagttttaaagatttttatgggaattccatttccctgcaggtcctgagttgttcaaaattagaaaagggcatgtaaatgctgttagtgtcagcagcttcacctgaaagaactgtttttgctcaactccacacagtatagagccggatattctgagtattgctgagtgctcatggtgacatggtccaagaaggagtttcaggggaaccctgaactctccacctttgaccccacttggtcatttttatttttatttttctgagatggagtcttgttctgtcacccaggctggagtgcaatggcgtgatctcggcctactgcaacctctgcctcctgggttcaagcgattctcctgcctcagcttcccgagtagctgggactacaggcatgcaccaccatgcccagctaatttttgtatttttagtagagacagggtttcaccatgttggccaggctggtctcgaactcctgacctcagttgacccacctgcctcgacctcccaaagtgctgggattactggtgtgagccaccacacccagcctccattgggtcataaccttcactttgggaagtcagttcaaaagtccagcaggactggtcttagtgctcttccaagagttttgctcattatcctggattctggcctttgattctcatattctcttgatttgtagagttaatctgccaagagctttgctctccatcagtaaataagaaactgttttatgatgaaatacattataaactctattcagtattcacgttcttggcaaataaagtttgtgatccttactattggctgaggtgcttttaaggtaaagatgagaagatgttaaatataaatcccaaatttatctctggtcctcaattcttttcatcccttcatgcctgctagggaacccccaaattcctaacagtatccatagctcttcttcaacagcagttcccaaaggtactgcctgttttattattagaaattgaatattctttacgtactaaatatagttatgtatctagtgggtgctcaataagttataggtattagattaaatcatatgaaattgcttttaatagaacaaaaagagaagacgttgacaattttaaatagttcaacttaatactaagttctgctgcatacagccaacatagaaagtcgtttgaattatgttaagtaatttcagcagcatccaaaaaggtcaaatgcccttcatgtgctcctttttaaaaaaaatgacagcaggccagacgcagtggctcacatctgtaatcctagcacttcaggaagctgaaggaggaggattgcttgagcccaggagttcaatatcagcctgggcaagatggcaaaaccccatctctacaaaaaaaaaaaaaaaaaaaaaaaatagcaaggcattgtggtgtgcatctgtagtcccagctactgaagaggctgaggtgggaggatcacctgagcctcaggaggtcgaggctgcagtgagccatgatcacaccactgcgctccagcccgggtgacagagtgagaccctgtctcaaaaaaaagacagcagaagattgggatgattaggccatttcttctttcgaagtgcccaaaacaactaggtacaaagtagaccttcaagagatacacgttggccgggcatggtggctcacacctgtaatccagcactttgggaggctgaggtgggcagatcatgaggtcaggagtttgagaccagcctgaccaacaaggtgaaacccggtgtctactaaaaatacaaaacttagctgggcgtattggcacacgcctgtaatcccagctactcaggaggctgaggcaggagaatcgcttgaacccaggaggcagaggttgcagtgagctgagatcatgccactgcactccagcctgggcgacagagagagactctgtctcaaaaaaaaaaaaaaaagaaagagatatgttatattaagtagtctacttatcataagtcatattcacaactgaaaggctataacttgataatattgcttaagaccctttgtactgctaactgaattaaaataccaataacaaataccaagaaaaagagaacgaagtttgcaggcctcatctgctagcacagccactacccatgtcttgacagaaatgaattctcataaggattgaatattctcctagagctcatttatatttctgtcatgatccaataagttccaagagtgagagaaactacatttcacatagcccacatgagccctggcacatctaatctgcaatctctacctttaatttatatctgaaaaatgaatgaatgaacatctacagggatataaaagtcagggtctcataaacacaatgcgtaattctattacacctgatgcccagctctgaacatatgctagctttgtatcaaagagggtaaaccaaactgctcccccaccaccaggagacatgcaaatctgtcaaataacatagcattcagcccaacccactgatttgctcatatatgtttgtgtgtgtgtatgtatttttaaaaccaagttttaattttaatagcattcctttttaatttaagcaaagcaaaatggaaatgacactgaaacagatgcaaaagtatggtgaaaaatgtctacttggacaaagctattttaatgaaagcaacactatgcaggcttcctgattccttttagttattcaaccacccaaattagattcacttcactggctgtcttcatcagatttcacaaaactggggactaccgaaaagaaataaaaggtgagggttttccttaaagcgggataccaggttttgaacacaaacattcagattaagtgaaggaacttgattaaacccacagttcaaaataatgatgaactgaatgctggaactcagctgcctgacacactttagcatatgaattaaattttctgttcgctaacccacttaaaaaaaaactatattcaaacatctcctttcagggaattggccatatgtgaaatgaacagacccttgggtccacatggggcttggcttgcaatttctgagtttgctagaaaagtgagtttattgcattacattacaatggacactggtagatttatttgagtaaatgacactataatagccatgcctatttaatcaaatgggtcatcactaaaattcatacaggtgtaccagcagttgtttcatgactgatagtatcataaagggatgtttatggccaggtgctaaagaaggtacttcaaacaaggaggtgagtacatgtgatgacagggaaagagctgtcatgatgtatgacacggatattcctaagcacattcacaattctggagcaaaatgttttccataaaaccttcgttccacaaatagaatttaaaaatggcattgtagcatatggccatgtaaattgtaaatgcaatccacatgtcttcaacaatgccagtgtggatgggctaatgaagatgcaaatggaaaaaggtatactactaagttggctacttcagaacacccagatggcccagaaattccagaccattttgtgaataccaaaaggaaaaatgtgatcaggatataattacagccgtcataattacagtcttacagatttaagatttcacatagtttaaatatcacaagatgcagagggagacctaaatgctttatgaatcatataagaaggaaaaaaggaagcaaatcaattatgaagaggtggaggtcagaggatttccaattattgatattgcactgtagggagatggattgagttttgtggtgtagattagatataactaagtcttgaagagtttagttagctgggaaggagctacagtttgagtacattcattttttaaagcactgtactttacaaacatgacatcactgttattgccattttgagatgaagacaactaaagctcagagagatgaaacaatttccccaaagtcacaaagctagtaagtgcccaaacagagatgcaaattccaagtctaactaactccaaagcctacataagagctaaccaaggcagtctttcatatatcacctttacaacttttgccagactatgtaccatctgggctttaatctacttaacatgattctctaaattgatggatttatacttcaaaatgtttatttaaaatggtacatatacaccatggaatactatgtagccataaaaaagaatgagatcatgtcctttgcagggtcatggttggagctggaggccattacccttagcaaactaacgcaggaacagaaaaacaaatactgcacgttcttacttataagtgggagctaagtgaagagaacatatgaatacatagaggggaacaacacacactggggcctatgggagggtggagggtgggaggagggagaggatcaggaaaaacaactaatgagtactaggcttaatacctgatgaaataatctgtacaactaagtgccatgacacaagtttgcctatgtaacaaacctccacgtgtgccccggaacttaaaataaaagttaaaaaaaatgaaaattttataatgctattttattttaattatttttttgaaacagggtctcgttctgttgcccaggctggagtgcagtggtgtgatctcagcttaccgcaacctccacctcctgggctcaagtgatcctcctacctcagccttctgagtagctggaactacaagacacacgccaccacatctggataatttcttatacattttatagagacggagttttgccatgttgccaggctggtctcaaaatcctgggctcaagcaattcacccacctcagccacacaaagtgctgaaactataggcgtgaacctctgtgccaagccttctaatactattattaatggaaaataactgtaagtggcataagcagaaggcaactgtaaaagtaaaagtaaatttagtctagctaaatactgttgcttaccaaagctctgatcctggggccggccttttccttgtaaagagagctccgagaagcagagaggtattagtgaacttcttgcacccaaatgaggcttttctcttgatgtaaacataaggactggaagagaactataaagggaattctattcttgtcgtatgataccgtcctatttgatgccatgtggtgtgccacctgtattcactgtgtcttccacctgtggcatgctggccttgttttgggaaagcatgttcccattggctgagcattttctgtgagctggaccaagagaagatggaagggagtgattggatctaatcatttttttcaaaccaaaattcaacttgaaggaaactagatgcctgtttccatgcatggctcaattaaattttatatataacaaatatgagatcaaactcaaaattaagcatagagctaaaaatcttacacaatgttgatgtctaacagcattcaaacatgttggctctaggaactactggatattgtttaccaggcttcctggataaactatgggatatcattgtacaagccacagcaggcctctccctcttgcaaaactttgccttggagaagaccggctggaagttcttagtgccttgcctactcctgggcaaaccccaatggccatatgaggccccaaagttatttcttagcataattttatcctgggcttctccttacttctatttaaaaacacagaacaacagcatggctattacagtaccaagatcatcaccataaaatactaaaacccaactccatgtgtcaaacagaatgatcaaaagatatttgtgcattcttatttcaaagatattttatttcctaatcttctataatttgactcactagtatgcttattagcgtatataaacttttgcaaaaattcaaccagtatcctggctttttttatagcatgtactctgtctgcccagaaaaaacccacattcatgcattcaagcctactatgtagtacacacacacacacacaattagttgtttgtttttaaaaaactgaatttcagtagcagagagggtaagggatcctaagtggcaaatatatagaaactgaaagaaatgcaaattcagattcatgtcaggaaacagattttcaaatggtgataacattgtacacaagactgtttaagaaaatgcaccagactcattgcaaaaaaaaaaaaaaggctgtttaaatgtcatcttgggaggaacacagtattaactggcaaagcagggtgataacctacaggccctctacatgttccaaatatttagacttctgaggaaatacatgtttattttagaattaggaaagcatactacttatctcttaaaattttcaggaaccagcaactggtttaattattagcagagttccttggccaaactattgcttccaaaaaaggtgatatcctcacatattaaacattcctttttgcaatcctaaggcctggcacagtgactggcacaaaaacactgctaaatgaaaaccatgatgggtaaattagtatataggtgagatcttgctcttaaatacaatataatgtggccagaatttggaaatgtgaagagagagttgatgtgaataccaattgtttcaccttcctctagcagagtaccaatgtaacactcatgatactttctcaaatatttccaatagcatagcctacactttcttagttgacacaattgtttgttctaattttctaaaggtacatttttatgtaaaaggaaaagcataggcatgaaacaatattccactacacacttgtggttcagtaatcattttgctgttttagtgaaatatcctcagagcaactgaaaatgctaaatataaaggaatgaaaacagaaacaaggataataagcaatttctatttctactgaaatctgaaaatatagaatttctgtttttaatttgaagtctagaaataaaaccaaaatatatcttttctatagctgagtctaaaaaccaagttttctttgtaaaataaataggaaaactttttttttaataaggaaaagcattattctccaggttataccattttaatacatctgaccccaatttttagatcttggtttctggaacctgaagcaactggttctctgctgattgctaatttgagggaggaaaatgatcaggaaggaggtaaaatctaagtcagagctcggccttctggatctgagaggaaatgcataaaccaggcaagtgcggagcccacattaggaaactcccaagggggatggtgatgttctgtagttaaaacttaaagtcttctcaattagagaattgagagatagcttctcaattagaaacacctcagttctaagaagatgctgtcttttattcctgaacttgactgcataaaagcaaatgctccctatttctccagttcacaagccttcttcaaatgcaaagcctgggttaagcaccaaagagcaatgtttctcaaactttagagtgaatacaaatcccagagagctggttaaaatgcagattttgattcactaggtccggggtgatgcccatgatttgtatttctttatttttattttttatttttgagatgaagtctcgctgtgttgcccaggctggagtgcaatggtgccatcttggctcactgcaacctccacctcccgggttcaagcaattctcctgcctcagcctcccaagtagctaggattacaggtgcacaccaccatgcctggctagtttttctatttttactagagacggagtttcaccttattggtcaggctggtctcaaactcctgacctcaggtgatccacctgcctcgggctcccaaagtgctgggattacaggcatgagccaccgcacctggcccatgatttgtatttctaacaagctccaaggtggtgtggatgctactgatttgtggaccacacttactaccaaggacatagagaatacacacctgtggcttccttgactttaccatctggtggggaaagtctataagtaaatatgtaaccattgcagtttgactgcacacttttcctacttactgattatctaatatggctgtactataattttattttatttctgcatgaaaacttcttttcatgaatatattgaaacataattgtataaaatcatacagaaaaagaagaaaagacatatctgttatgaagttttactttaaaaaagaaatcaattatgagaaaacaaaaattacacattacaatttcttgactgaaataaatgcaagtgtttcattaaataaagagaaaatcaactccccctacaaacatccaattattcaattaaactttcttgggtaaagtcaacatcaaccagtaatgttgattttatacctatttctacctcctgttttaaagaatcagctatcaaaagataagagtttcctacttattccataaatatttactgagcatcaactatatattaggcactgggctgggtacagaggatagcgagttaatgaatgagggaagccaaacaagaaacaagtaagcaatgaattggtaatagttagaaaactaagtgatcaagatgaagaaccagcctccaagatagcctacaatgatccccatctcccagtattcatttccttgtacagacctcttccaagctaaataggactgacctgtgtaaccaataggatactgcataaatgacagtgcgtgacttctgaggctaggtcataaaagacattgtagctctgccttgctctcttggctcttttgctctgagggaagccagctgccctgtcatgacggtatgcatgcagccccatggagaggcccacatcatgaggaactaaccaagcactaacttgcctggtgtttcaataggccactttggaggcagattctccagccttggtcaggccttcagatgactgcagccctggctgatgacttgactgccacctcatgagagaccttgagccagaaccacccagccaagccactcctggattcctgatccacagaaactaggtgagacaataaatgtttattgtttaaagccactaaggtttggggtaatttgctgtgctgtaataggtaactaatacagaagagaggtgggtgagaaggtgagaacacacctacttaaacaggtggtcaggaaaggcttctttgagaaaaagacatttaagctgagaatggataaaatggagccagctctggggtggaaggtggtggcagtggtggtaggaagaacagcattcccaaacaagaaagctgaatggcagagggaagatccggagttgtatatgggacagtgtggccagagcaaattcctgcagggaaatgggaaagatgaggtcacagaggcggtcttagccatatcaggtatgacttcttgtgaaaagtttaaattatattcttaacacattgggaatcctttcatgaatctttagaagactaatgcaattctctctgtttcaaaaatctcacgtgggcctggagcagtaatgcacaactgcagtctcagctactcaggaggctgaagcaggaggatcactcaagcccaggagttctaggttgtactgcactatgatcatacctctgaatagccagtgcactccatcctgggcaccatatcgagacaatgtctctaataaataatctcacttgggctgtagtgtggaaaggaccactaatgcctggcttactatctacttttcagttatttagaggctcagagaagaatgaccaggaaagatttgaaagtattaggagttacataaatatctaattgttactagtattactcttgctattattccaaactcaggcctggtatggcctctgcggtgttgcaagggaggaaacaaatggacaggagagagcaatgaggattttgctggtttctatagaaccccagaatcctttctgaggcagcctctgaacctcaccaaatccaattccaaatttaggaaggagtttctacttgctaggcaagtagaacaacatcaaaatgttgatgaataacaaacacaaatgcatagtacaaatatttacttttggtgtgggcatgatttttaaaaatatataatttttaattatgcagataatattcactgtagaaaaatccttgtttattacacacataatattcattgcaaaaaattaagaaatgtaaatgtgcaaaagagaagaaactaccaatcacccaaattacacaagataaacattgttttcatgttggtgagtatccttccagtatccctatgcccatatgtaaaatatactggctaaacctaagattttaaagacttttccttctctattataaaaaccataaattctgatgttaggcaatttgaaagacacagaaaatataaagaagaaaatagatggcatgaataacactacctctatttctttctgagaatctaaaggtagcactggcaatctatccaagcctgcagctgttactctgagctgacattttctacaaatattcatttccttaatttcagcctacctttttacctcattagaaaaggaaaataaaagttgaagactgttcactttgtaggaagttttggaacttttttttttttttggagacagggtccccctctgtcacccaggctagagtgcggtggtgcagtcatagctcactgcagcctcaaactcttgggcttaagggatcctcccaccctagcctcccaagtagctgggactacaggcacatgtcaccatgcccagctaattaaaaaaaaaaaaaatctcagtaaaggcagggtctcactatgttgcccaggctggtctcaaactcctgggctcaagcgatcctcctgccttggcctctcaaagtgtctatattacaggcatgagccactgcttccagccctggaaccatttttataactcacaatgagataagttagaggggtgggaaggaaaggtgttgtgtgataacattgggaaagaattcccagtgtttccttcttaccacaaactctaaccaatcctaaccctttgaaagatattataggggcagcgcttgaaaagacaaactaaatgttaatgattcacacaataagagtgctcaaactgaattttcaacctcaaaacaaaacccatctggagaagtgtactaaattctgattgttttcattactcgggcttctcgcagcacttttttttttttttttttactgacttaaatctaactttgaaatagaaattcttctcatggacagtagccactcttactttcatatggcttcctagacttccctgcaaagtcttttgctgctgttaggcaatcacgcagaatcacaagtgctgtgggctcagagaaacttcagtctcggtggtaatcttgactactttattgaacaacggaaactcatttgctaaatggaaagtattgtagcatatggtgccattccaaccaaggtttaatccatttgaaagcagactttcaagaacataaacctatattttccttctaaaaagagtcactttacagttgaatttcacagaaattttaaacccttgatccacagccaacactgacatggttttactcctctaatacaacagttacctttctgaattcactggaaacatttttagccaacaaggtttaacagacacatgatcttaatgtatctgaactctggaaaaccaaaagctgggaatctggaccatactgtaaaaagtaatctgagatgccagtgagtgtggagtaaggggcagagaggcattaagcaaacacacgaattagggttttatttatatctttgattataaattagatgttttgtctagattaaagccattaatatgcacaggtatgaaaaatgtgtttgaatgtgatatggtctgaatttttcacatttaagtatgaatcaagacaacacaagaataatatgggatacacagaagaaccaagacagaaccaaggctacctggttaaaggttatttccggttccacagcaaaagaaaagttaggacacataacataaatcattacatactatttatgtatcatttgggtgctgtcttagtccacttgtgctactataacaaaatacctgagactggataatttataaagaacagaattttactctcacagttctggaggctgggaagtccaagatcaaggtgccaagatcttccagatggtgccctcttgctgtatactctggagaggccaaatgctgtgtcttcatatagcagaagagatggaaggccaaaaggcctaagctagttccctttagctcatttataaggaatcctcattactttatcacttaccaaaaggccctacctcttaattagcaccacgatgggggttaagtttcaatgcgaattttggaggggacatattcaacccatagcaagtgctatatgaagtttataatgaattttcaatagttctcactacactatatggattcagtcattcttaacactctctgtgttatcttcataatcttctatggtaatgaatatattccagtattatgttaaacataaaatggctgaattaaggtagattatattcaactatttagaatcaagattctgtacatgatcccttatttcagattctgtcaataaggtctttttctataatgaaataaaaattttattcccctaaaatatctcttaaagagagtgcagcatttccttgcaaggaatgcttttataattcacatatggtaaaagcataagatgctaatgtcatgtttggcaacaaaaatggttcctaaatttcaacatataatattaggagagaaatttgcatccctccaacaaaaaagaaggaagcagacaagagtaagtaagcagcggcattgcttgggagaggggtgtgaaggtacggagaaaagcttcagatctgggataaaggaggatctctagaggacagaagtatcaaatagaaactcctaagctgtttgcttgaaaagataggtatgtgtgtgttggggggtgggatttacatttaacataaatctcagctgggcgcagtggctcacgtctgtaatcccagcacttcgggaggccgaggcaggcagatcacctgaggtcaggagttcgagagcagactgaccaacatggtgaaacactgtctctactaaaaataaaaaatttgccgggtgtggtggtgtgagcctgtagtcccagctactcgggaggctgaggcagaagaatcgcttgaacccaggaggcagaggttgcagtgagccgaggtcgtgctactgtactccagcctgggtgacagagtaagactcagtctcaaaaaaaaaaaaaaaaatatatatatatatatatatatataaaaatctcatcctctatgtactctttccttactaagatattgcctaccaattcttttgtgatcatagattcatcactaagttccaagtctgggttgcaatgaggagaaaacagagctggaattaacagaaacaaaaactgaaggacaaagagcagctgacatttgggctttttaagtaataattattaggttggtgcaaaagcaatcgtagtttttgccattaaaagtaatggcaaaaagcacaattacttttgcaccaacctaacattattatacctcagtgtggaaaatatgaggaatatttaggaaaaacattaggaatacctaatagtattattcctcagtatgaaaaataaatctgacacatataaacatgaaataagatgtaacaactaacaaatgattattcttctcaatacaagtataattgacaccataattcacagatctactaatccttttctgcctttgtacctggcaacattcacttcttgagctaatgtaaatgccagtcttataaatacgacttacctctcccctgagagaaataaatgacatagtaagtgttagattagaaaggaagaggtggagagggttaggtttgaagagggactggccatctgagaattaaatgagatgatgctggcaaagcgcttctactgatatcctacatgtactaaacacttagcaaacgtgaccagttattcataggaataatcgtaggaacacattaattccttctgcctgcttctgtctctagggaaaggttttgccctgatccatgacagagactattacctaaaagatacaagtgggacagggctagggaagagattatccctctgccccagaagaatctactgagaagttaatgtgggatccacctctcttactactaatggttttcctcttcacttttaagtctagctgaaaacaacctccagcattctcggcaattaggatgaagtctctgggtttcaaatgcatctctgatagatgcctctaactgcatcaacgtggcagatgcatttctctcagcatttaatgctaatcctccttgttgtctaaggataaataactgcacaatcgtgtcaggaggccccaacataaattcaccaggggttttaattactctccagtgacaatatctcatacaaaatcagagaagtgaaaatccagtcagtgtgtgtacatgtgtgtttatgtcccaggctatccccagaacagtctggggatcatcatttctgttccaatagaggaataagaccaggaacccatgtccagttcagatgtgtgagacagcactgcaccctgtcgaatgggtccgaagaacaaatgatttcccaatgacactgcctgcagcatccctccttcccttgggggcacataaatgagtagctacaaactcaagctgtggagtcaaacaaacctgggttcacatctcagcctgctacatgctcactttttcatgccaggcaacctctgtaatcctcaaatttctcacgggtaaatggggatcatacctatatatgcagcataaagttgtgaggattaagcaagataatctatgcaaaacaagtgacacaatatgtagtgtacggtaaatccccaatgaatattagcaacaccaaaagaaatgcagagggagttcctgtccctttgttgcagaggacatgttgctatgagggtccaggtgttcttcctcccacccaggcctctagttgggtgaattggaagaagagcatcttatctcccacctgggcctaagagtaaagatggtgaataaactatatatatacacacacacacacacacagaaacatatatccacacatacatatatacacacatacatatatacatatatgtatacacacatgcatatatacgtatacacacacatatataaacacaactgctgtagatctcacaaatgaaaatgctaatgtctgcaagttcattctatacataacttttataaatccagaaagccatacaaactagtttcagaggattatctctttcaaagaaacagtccaacaaccaaaagtaattaataatagatacaattctttatttaaggtctcatacttcatcaaataatctactggcatactttttaatgtccctttgctttctcctcttgaaatccattatactatccaactgcaatggaacttctctcctccctaccccatccactcacctccagtccatccctttagtgtatatagatcagcttagcctctcctccagaaagcagggctcccttctacttagaagaggggcaggagaggaaaactgagtgatctaaaacataactgtccttggtgatcatgaagaagggggcagcagtgcagtcatctaagtgacttttgcctctgtcaaactaaatttggcctgaattacataaggacagttgagtcctcatgtaattaattgcagtctaacttagcacataaactaactgaaagcctaacttaggagtatagttttgtaacaaatagctgagtctcagtcaatcacaggcagccagctgatcagaccatattcaaataaggcaaatgccaagctgtaatcaatcaagtttctgtacctgacttttgtcctgtccataaatgctgccgcccatgtaatggagcagagctctctgaaccgcttctggttctgagagctgagtgattcctgaatcattctttgctcagttaaactctgtgaaatttaatttgtctaaacttattcttttaatacctctgcacatacaaaatacaagaatacattcctgtaccttttttctccctcattcttaattcatgactttattttcaaatacaaagatgcaaagatagaaaaccttactaccccaaagtaggaagtatgtttcctatctctcctttgccttttcttcaaaaacgcaaaaagtcattaagatgttaatgctgagataagtcattggaagaaggatggaaaagaaactacaagaaatgatagacatggtgctgccaagcagctactctgtttttataaaatacttcagacataaatggcatttgtattctgtgacgaaaacccctcttcccctcccctacacaaaaggaaaggcaaagaaatgcaaaggaagtggtaattgccaggtgtctagatatgggaccactgccctctagtgtacttgaaatttttctaaatccctttatcagagatctttacctgaaagatagtaggaaacagaataaaacatgaacctctgttgaactatccaatagaatcattttaaaaaatactgtcaattattaggagagtgatatgacggcttcctaccacctcactatctgttggtgccaacactttcttcaggtcctacacatggacctgaacaaggtttcagtccaacagattgccaaagggcagaagaaatattaaaagtatttcacaactagtgtggcatacgcactagctaaccagaacagatgcccggaagatgccagctggcagcaattctgcctcttccctttgcagggccagcattaaccccttagatgctgaactgtggagaggttctgggttcctggcagagggactaggtagccaagagagtagggggtctgggacaaaagcatgtcaatatttcaacgatctgtactgtggtgttctggctgaacattcactctgctaagaggattagaagacatcagaaaaataagccagtaccgctgagcagagcagaagagtgactcagcgtccactagcaaagatctgaagtagctcttcctcccagcagctgttccttctcttgccaataaccagggacatcctctagaccaggacaggggtatagtagtgttagtagcggatgtcaggaaatctaccctacagtcttggttctactacttttgtgtgtccttaggtggatattttgatctgggcctccatatccctgtttttaaaataaaaaggttagactgaagtttttcaaggatccttctctctgtaggtagaaattattatttttttcatgatctgcttttttgtttgttttgttttgttttgttttgttttgttttgtttttgagatggagtttcactctattgcccaggctggagtacagtggtgccatcttggctcactgcaacctctgcctcctgggttcaagcgattctccttgcctcagcttcccgagtagcttcgagtacaggcacccgccaccacaacccggctaatttttgtattattagtagagacggggtttcaccatgttaaccaggccggtcttgaactcctgacctcaggtgatccgcccacctcggcctcccaaagtgtgggattacaggtgtgagccactgcctctgactatgatctggtatttccaagtgaattctacatacaagatcattcagcataatttttaatgacaataccaccttgagaactcctgatgacaacaacgtcatcttgagacagctcttagactataaaaaagtgatcagtaaatatttcgaaatctccttgaaagatctcatttctttagaatttttttagtttctatttccaaatactaccccaaatgtagccacttgtaagtaactttcttttttgatgtttcctttattttttgagacaatgtcttgctatgttgcccaggctagggtgcaggcatgatcatagcgcactgcagcctccaacttctggccttaagcaatcctcccacctcagccgcccaagcagttggaactagaggtgtgtgccaccatccctggctataaataagtattttcctaagatttacttaattctttgagttaactggcaagataataaaggtgatttaaagaaggatagaagaggccagggacagtgacttatgcctataatcccagcactttgggagtctgaggtgggaagactgcttgagcccaagaggtcaagactgcagtaagccagtgcattccagcatgggtgacagaatgagaacctgtctccaaaaaaaaaaaaaaaaaaaggaatagaagaaactagtacatataaatccagtagaaaaaaataatgctggcataggactgcaaagttagttacaaaatggttgccgttttactagggccaataaaatataacatttggggttaccttccatgctgggcaaaagtagtttgtatctctaccaaacaaaagtcatcagtaacttaccgatcttctgcaaattaacatccaaattttacagattctagacttcaattaatagcaaatagccaaacaaagctacacctcctgaaatatcagctgattcttagaggatctaatacgactttgaaagagcacccagtaatctttttgctttatttcaaaatttctgaaaactcttcttaagaattttcaaatcccttgaccctgaaacatcaaggtagcagatctcaataagagggagaataataaggactgtgggaactgaaaagtgtaaaaacaaacaaaaaaactcctcggtattttatggttgatatgaaaaaagggggaaacaaaccaaaaactaatgtgaaacacaagaagctgatcaagtgtttaaaccaaaaagaagacctctgtctctctcaccactactacaccaactcttattcacacaccttttaaagatgtttctgtattggatgaaacgtgtggatgtgcagtattctccaaagtaaccaataatgttgtatcaagtttcagttaataacgactatattaataattttgatcatatagcaaatgagcatgataatacacagttttaattcgattttcaattcacaggtgttaaaccagcctaaagtaaaaaggctgcttggagtttttgactgttggatacacagaggagcaaaacttgctatgtcagttttttaattcgcatgattttatttgcacaactcatgactttttttctcctttaaaaatgtaaattacttttgcaaaaaagcattaaacacaaaattaagtcttaaaatgggcaaagttgaagccaagtcatccaaaggaaaagacagccttgagcagcagggtgcagaatacagacattaccatcttcatctgcatagaaatgagtctgactgtgtttacagcttcatcatttgaaatgttacagaaaaactcatgaaacagtgcacttccccacagatagctggtatgttagataactaaatgcacaaaaacaaaatgtctttgcttcatatatatttatatatatatgtatatatgtatatatgtacatatatgtatatatgtatatatgtatatatgtacatatatgtatatatgtattcacatatacatgtatttatatatctatataaatacattataaatttatatatctatttgagggaagacaaggagacaaatgattacttttacttttcatcaactttctgttatgcacatggcttcttttatagtataattaattttagtgtacatcaattaatacttttattaataaaaataaagctaataatactttaaaaaccaagtagtatagctgacagaatctatctagacattgctatttcattcagaaatttatctctgctgtatatagaaagtgaaacttctgttatgttttatgttttagaatatttatatatattatatatatattatatacactttttggggggatagggtctagttctgttgcccaggctggaatgcagtggcgtgatcttggctcactgtaactttcacctcccgagctcaagtgatcctcccacttcagcctcccaagtagctgggaccacagatatgtgccaccacgcccagctaatatttgtattttttgtagagacatggtttcaccatgttgcccaggatggtcagactcccgggttcacgcgatctgcccaccttggcctcccaaagtgctgggattacaggcataagccaccatgcccggctgtattacatatatatttacaatacacatttttaaaaaatcagtctcaatcacttggaagtgacaattcaaggttctgatttctgattttttttttttttttttgagatgcagtctcgctctgtcgcccaggctggagtgcagtggcgtgatctcagctcactgcaacctccgcctcccgggttcaagtaattctctggtctcatcctcctgagtagctgggattacaggcacgcaccaccacacccggctaatttttgtatttttagtagagatgtggttttaccatgttggccaggctggtcttgaactcctgaccttaggtgatctgcctgtctcggcctcccaaagtgctggcattacaggcgtgagccaccgtgcccagccaatgttctgaattttaaaaaaatcaaccctatattctaggccattccttagcccttttctcaaaattccaatattttatttgtcctatcccaattccctgaaaatctaaagggtgacaagcatgctctatgctgaagaattttttgttctttgactctgaacaatgcccagaagagggtgctcatagaacaatcagccttgctttaaccgcaaagctagcacacatcctctagatcaaagtttggtaaccccaaatttggcaagtaccataatgattgtagtgtgttaagactgcagaaggagaaatgaaaagttccctatattaaaagcaattcaagaatacattttaaaaagttggtgaagaccttttaaatgagggaagacagagacaaatgattacttttacttctcatcaactttctgttgtccacatggcttctcttctagtataattaattttaatgtacatcaattaatacttttattaataaaaaataaaacctataattaatactttaaaaaccaagtagtatagctcacagaatttatctagacattgctatttcattcaggaatttatctctgctgtatctagaaaatgaaacttctgttacgttttatgttttagaatacttacatatgttactactcagaatccataacattataatttatactagcattatttcctggtaatacaaatctttgtagaaaaaatctatcagaaaacaggcagtacatctttcccactgcataccctctttaccagactcttaaaatatctcatattgctttacccatagttttatgaatagggcttagattacactgagttttgctgctgctttgtggtgacttggtactaaattcagctaagctggaaccacattccccagagttctctttcttgtatggttctgtatggccatgagagacattctgtgtgaaatccagaaggaagaagtaaagaagtcatactttttatgctctgaaacttggtacagagttactgtcgtagtctgttttgtgctgctatcacagaatatctgaaaccgggtaatttataatgaatagaaatttattggcttatagttctggaggctgggaagcccaatattaaggtgctggcatctgtcaggtgacttcttactgtgttatcacatggtgaaagagtgcaagggcaaggagaaggtgagagaaaaagaaagagagagagacagggagtgggagagagagagaggaacctgtccttttaaaatggcaccaatcccacccatgagggtggagccatcatggcctaatcacctcttaattgtcccacctcttaatactgttataatggcaaaaaaatttccatatgaattttggaggggaaaacaaaccatagcaggcactatgcaccttgtccacttgcacacattattgctaatctgctgcttaactacttggtgtaccaggcttgcagtaattctaattcactaaatctcctccttcagcttctctgagtcctgggccaagtgtgtgtgcaggagacacactgcaggagatagtgccagtttctcctgcaggtcacccgcagcatcaaggttggacatggtaagacacagaagagggttccagtttgtcctcaatggtcccattggtcctcatgagttctggtttgtccctactctcctatacatctagctttccctcttaacagctgatctgacaaacctatagtaacttcaggctcagcactagacacagaaccaatagtcttcatagattgcatcaccagctctcacatttgtgtaaggtctagcccttaggataataaatctcttattctgtataatgtgtggccattttgctacttcgataaaaccatggctgctgtaagtatctgtgtacaacactgtcttgttgcctttgcattgtgaacggtatgttaagcctcatggtatccactgtcttaggtagaaggagaagactggtgattggtggtagaagaaaaggaagagatgcttagaaaggtaaaaagcttatgtaggaatctctcaggaaatcctcaatgctaaaaatgtctgtgctagttatcatttgttgcttctcatctccaaatccagctttctttgtcctgttttgtggtcttggagctggaccatgtaaacatttctcctttgtcaatagagggtgctggagggacactgtaggaagaagggaactcagcttgactctcgtggcttgactgctgtgctctcccctgctagctcttgtggtgggtaggcgccagcagcataggacatctagtgactcaccctattaagttttagtggcagtatttgggggacttttcagtgggtttgccaccactccagcaggcagcttcccagtgaatccctctggcacctcggaggacacctcagtgatacctgatgagtcttgcagatgccccaatgggtggtataccaggaggctggacgaaggttcagaagtttggtttcctgcttgccagccctggcctgcaacatctcagggaaattctctgcaattcagtgggctgcagactttctttgaaaggggtctgaatcagccctgggtgaggggagggccctcttccaaatttgttccttctttggtactctttccttgggaacagccttaggggtagtggctgttcttcgtatgtgctattcctgtgttcagtacggttttctttacccttagtaggtaatcctctgctactagttaataatcatttatattaaactttccctgtgtgaattactgtgtgctttctgtctcctaactagacactgataaaatgccttttgctcttagtagctatttaaaagaaaaataataaaacttaattttattagttcaagatttttccttagaagggacataaattacttttaatgtgattatataaataaagggattgcccaaatgtgcagtttcaagagactatttgctttctttggccacctgggaagggtatttctcaaatcgggctctacagacccttctgagtagaccctgagtcactatggctatgaaacaaactaccgcaaacacaatggttaaaacaaccatcatgtatcactctcacgtatctgacagaaggactctagagttgcatgacaaatggtgaagacacaggacaggatgaagaactggggcccaaaatgtactctaccacagggtccaagggcattaaaaatgggtctgtgaattcaaatggtatttttaaagttttacttttccatttggtgaggaaataaatagtgtaatcatagtcataggacttcagtgcctgcatttgcattcatggttcagttcttgccaagggatcgccttaagtgagtgtgcagaggaaatgttaggcagtgttccctcatttctaaagcttaaccagtaaagtaaaaagagggtatgtatatgactgtggggtatgtgagagctctctgtgccttgactcccctgaagagccaacttagagaacctggctgtgggaaccccaagggctgagctggcctccaatcaggagagacaggagaacagaaatcagtccaggaggttactggagaagctgggaaccacagagtcatacagagataggaaacagccaactcccacagttttcaatagcagatttgctgcagaaaactggtcggccatgaacctggaaccctccagagaaggtaccatcaaattttgatctctgtttaacactgatttctgctataacccatcctgttatggcaatgtctgtcttgagaaaaggctgagctgatatagtacagaggagggttcaacttgctgcaaattatttgaagcaggcatagcctaagtccaggcctatgccagagaaagatgacatattcactgataatcgcctaatctcctgagcacataggagggcaagattaggatagttagagttctactcaaactgtgcaagaatgtccttgaagtgtggccaagtgacaaacagtgcaataactatgaatgtttttacagattttatgagacattatcataccctagcagtgactgtgcatgtttatatgtttttaataaattttttattttataatagttttaggctaaggcgggtggatcacttgaggtcaggagttcgagaccagcctggccaacatggtgaaaaccctgtctctactaaaaaaaaaaaatacaaaaattagccaggtgtggcaggtacctgtaatcccagctacttgagaggctgagacaggagaattgcttgaacctggaaggcggaggttgcagtgagccaagactgcgcaattgcactccagcctgggcaacaagagcgaaactccatctcaaaaaaaaaaacaaatagttttagacaaaatttgcaaagacaggagagagagtaatcatataccccacaaatagtttttcctacttattaacatcttacattattttggtatactagtcataataaactgatgttgacacactattattaactaaagtccatattttatctaggcttccttagtgtgtgtgtgtgtgtgtgtgtgtgtgtgtgcgtgcatgtgtgttttactgtaatgtcctttttttctgatccaggatcccattgaggatatgcattccatttagttgtcgtattttcttaggcttctcttagctggacagtttctctttattagactttccttgtttttgataaccttgacagttttgaggagttttggttacgtattttgtagactgtcatttaattgggatttttctgatgattgtattttaattattgttgccatatttacaattgctagttccttcaaacatcccaccaaaagtgtcagaattagaaagtgtgcctcaaacacagagtttgaaaaccactggtctacatcaaagcagactgtaaatatgcataagtcaaggttattgagatgcttagtctaccatttgaacttcagtttcaaaaagccaggtaggcttttagacctttcccacagtggctgcatagcaatctcaatttgtactgtctgcatgtcacccaaaatggccaggccatcggccacccgcctcatttggcagccctgacttagaagagaagacaatagctctttgcccaaaggtcgctttgtagtgactcaccttgaaggaaaaaggaaggtaaattacacataatggccttctaagttgtcccacagttttcaacagaaaatactcttaaagtataaccagaaacaagaaaccttcaatgcaatattttcctttttgttttccaaataagtaaagtccaaattaggaaacagaagcaagtatatcctattaatttgtaatgtctagaaccatagaagtagtctagttatggaagagctgttgtgcatcttctagtaattaaacctgtgcaagttacagccttaatcaaaacaccttttaggagtctactctggtctccatgagagtgaagtccctaagtgctggcaactttggaacactaaacattactggcaatgctggaaatggtacaatatttaccgcaataaagaagacaatacccgatatgtcccctggagcacaaaattaaaatatttgtattggaatacagacaggccgaaatatgtattccatgaaccaaaaagtactcactgtgttggccagctctagatagcttcctcctacagagttgccaatgtgcggggactgtgtgagcagtttgtggagagcagcctgctgatgcaaagagcttccgccatactcgagcagcttctggagggctgactggctctgcacatccgggctctggaggtccctggcaccagagtcgtattcccagctctccctggctgctgataaggcacctaagtccgagagaagcagagaaaatgaaaagacatttccttcattagcctgtgggtggccaataggcaatgatttggaacctcctaagccttccatgtgccagcatctcagaacacatgtgatgcccaggctgcatgctaagcgctttctctttcaaactgacacatggggagcctggagataaaagcaatttcaggcaaagcattcaaaaacaactgtcccatgaatatgtgctccctaaacagaaatgcttagcaaaaaaagcactggagagccaagtaaagggaatccagatcagagtcacatctgtgatttgcacagggctactacattagccttagcactggtcattctttctcccaactgaggaaaaaggaagcaagaagaatgacaggaagttaacatatggcactttatcatgactctctttttctccttccttccttcctttccttccttccttccttcctctctgtctctctttctttctctgtttctttctttctttctttttttgaggcagggtcttgttctgtcatccaggtgggagtgcagtgttgtgatcacggctcattgtagcctcaacctcctgggtcaagtgatcctcctgcctcattaaaaaaaattttttttgtagacctcatttctatactatgttgcccaggctggtcttgaactcctgggttcaagaaatcctcctgccttggcctcccaaaatgctaggattacaggtgtgagccactgcaaccgacagtatcatgactttctactgttgatgtactcttacctgaaggaagctagactgtattttccagttagggatagcaatgaagctgagttctgggcaatagaatatgaacagaaatgataagcatcactgctggaccttgcttataaagccccacagtgtgtgattctccatgccctttgccttctggcctggttcagatgggaatggtacccttggaaaccatgtggtacagatggtggagccacaaggtagatggaagatgcctggattccagaatcatcacttgcagaagaggtgtctgctcatcctaagtaccctattttgccctaacatgattagaaaagaaaacttttttttacatgttttttatttcataggtttttggggaacaggtggtgtttggttacatgaataagttctttagtggtgatttctaagactttggtgcacccatcacccgaacagtgtacgctgtgcccaatgtgtagtcttttatccctcacccccccactcacactttcccccaagtccccaaagtccactgtgtcactcttatgcctttgagtcatcatagcttagctcccacttatgagtgagaacatatgatgtttggttttccattcctgagttacttcacttagaataatggtctccaattccatccaggttgctgtgaatgccattattttgttcctttttatggctgaatagtatttcatgatgtatatataccacattttctttatccagttattgattgatgggcatttggtctggttccatatttttgcaatagcgaattgtgctggtataaacatgtatgtgcaagtatctttttcatataatgacacttccctctgggtagataaccaggagtgggattgctggatcaagtggtagatctacttttagttctttaaggaacttccattgtttttgattcactacatacttttggtttgttgattagagcagctagtattaccttaattattacagacgattagaaggtaataaaacatgctaatagttataatacaaatgggaaagtgcaatgaaaaagtagaactaaaggaaggatatctaactcagtccatctggagatgaatggggaatgttcagggaaagcttcctggaggagaaagcctgatgcttgagttgtcactctttccagaaaaaaatagatttgaggtaaacctgtttccttgtgttgttcacttcagaatggaaatgtcttgtgggtgcatctggttggtgaagcctaggctgcatgcctctagctgcaaggaaagctgggtaaatgtgttttctggttttactttagagaggtagtattgataaggtgagacatttcctaaacagaagggtgctcaaaaggcctaggcagccacaacacaaacaacggtctatgcacaggacgtgtactgggtcctggggatatagcagtaagcatgagaaattatagtccctgcctgcaaagatctcattctggtaggtctttaatacatggcttttaatgacaaaaaaaaggacacaaaatgatccagtttgtactatgaaatgagaacatatacagattactctataatttacttgagaataattacatacagcaaactgcagtttgtgtacagtgagttctgatatgaatgtccagtctcctcttatcaggtattgatgaatttaatcaatgtgaataggaaaactgtcttcagatggtttccccttactgttctggctctactgatcctctccagtcggtctaacccaacattctttttatacagtgcctttatagctgggatgcatcaactgttttgtatcaaagcaggcaattctgtcactatatttgcaattgctccaagtttactttaatgttaaagtctattgattgtattgcaaggcaggttcttctttccttaacatagactgccaaatgcctgctctccctccccttgttcctctgaacactgtctgttatctgcctaaatgcctcagggcctctgttctggctccagcaacatgtggcaagaagactaacagaggtcagcgttgaaaagtggagtccccacattggactgagtcacagacggacttatatctcatacataagacaaacagacagagggctgggccttgccttatatgttcaccacagtactctcagcaccgtgcacatggcctgtgacatagatagcatttaataaacatttattgaatggattgctgaattatccatggttgtagtaccctacagtttcactttttaacctagaaatacaacatgggaattaagtcaaaataaattatacatttaaactttttctttatgcaaacatgaagcctcattctcaaacaggaaaatataacagttctgaggtggagcaagatggctgaatagaagcctccaccaatcatgcccctgtgcaggaataccacattttaacaactacctacacataaaaaagcaccatcataagaactaaccatcaggtaagcaatcacagtacctggttttgacttcctctcactgaaagaggcactcaagaggtaggaaagaccgtcttgaatcaccaacaccactcctcccgtactctccagcagtggttatgtaccatggagaatctgtgcttatgggagagggaaagcacagcaagtgggggacttggcattgaactcagtgctgccctgtcacagcagggagccaaactgtgaagacctcagtcattgcccacccatggagggagcatttggatcagccctagccagaggggaattgcccatcccagcagtcggaacttgagtttctcagcaagccttgccaccgtgggctaaagtgctctggggttctaggtaaacttgaaaggcagtctaggacacaaagactgcaattcttcctaggcagatcctagtgctgggctgggcttaggtggactagggcagcatatgacctgtgagacatcacccgggttggctaagagagggcttgcattaccccacctcagtaaccccaggcatcacagcttgcagcaaagaaagtgacttgttccttctgcttgaggagaggagagagaagagtaaagaggatttggttttgcatcttggaaaccagctcagccataacaggacagggcaccaggcagagtcatgaggccccccattctaaggtctagcttccagacatttgtagacataccctgggccagaaaggaaccttctgccttgaaggaaaagacccatttctggcaggattcatcacctgctgactaaagagtcattgggccccgaataatcagtagtagtagccaggctgtacttgccgtgggccttaggtgagactcagagctatgctggtttcaggtgagtcctagaacattcctacctgtggtgtctacagtgaaagactccttatatttgagaaaagcagagaggaaagtaaagaggactctgtcttgcaccgcaggtaccagctcagccacagtggggtagagcaacaagcaggctcttggacagcatttctggacctgccccgggccagaagggagcccactgccctgaaagtgagtcccaggcctcacagcattcaccaaaagctgactgaagagcctttgcactttaagggaacattgacaatggcctggcagaactcaccatgggtcagtggtggtggccactgagagaggctcctctgcctatggaaaggggaagaaagagcaggaagaactttgtcttgtggtttgagggccagcatagccatattagaatagagtaccaggtagattttacgttttttttttactccaatccctggctcccagacagcatttctgacctgcccagagcctgggggagctcactgccctgcaggtgagcacataatcctggctggtttcccaaactgctgactataaagccctagggccttgagtgaacataggcagtagccacatagtggttacagtgggccttgggtgagatccagtgctgtgcagacttcaggtccgactcagtgtagtcctagtggtgggaaccacaggggtggttgcatcaccacactcccagttctatgtgtctcagcacagggaaagagaggcttcgtatgtttgggagaaagtaagggaaaagaacaagagtctctgcctcgtaatctggagaattcttccagatcttatccaagaccacaaaggtggtacctctaagagtctgaaaaatacacagtattattgggcttggtgcccaagtccctttggatactggaaggccttcccaagaaggacaggcacagacaagcccagactgtgaagactacaataaatacctaactcttcaatgcccagacactgaataacatctacaagcattaacaccatccaggaaaacatgacttcacccaaagaactaaataagccatcagggactaatcctggagaaacagagatatatgaccttccagacagagaattcaaaataactgttttgaggaaactcaaagaaattcaaggtaacacagagaaggaatttagaattctatcagataaagttaacaaagagtctgaaataattaaaaggaatcaagcagaaattctagagttaaaaaatgcaattgacctactgaagaatgtatcaaacagatctctctccctgtgctgagccacctggagcttggagaggggtgacacaagcacagtcagaggagacaaaagaaaaaagaataaaaaaaatgaagcacgcctacaagatctagaaaatagcctcaaaagggtaaatctaagaggtattggccttaaagaggagatagagacagagataggggtagaaagtttattgaaaggaggtggggcacagtggcttatgcctgtaatcccagcactttgggaggccgaggtaggtggatcacctgaggtcagaagttcaagaccagcctggacaacatggtgaaaccccatctctactaaaaatacaaaaaaaattagccaggcgtagtggtgggcacctgtaatcccagctacttgggaggctgagcaggagaattgcttgaacctgggaggtggaagtcgcagcgagccaagatcatgccattgtactccagcctgggcaacaagagtgaaactctgtctaaaaaaacaaacaaacaacaacaacaacaacaacaaaaaaaacaacaaaaagtttattgaaagggataatatcagagaacttctcaaacctagagaaagatatcaacattcaagtataagaaggttatagaacaccaagcagatttaacccaaagaagactacctcaaggcatctaataatcaaactcccaaaggtcaaggataaagaaagtatcataaaagcagcaagagaaaggaaacaaataacatacaatggagttccaatatgtctggaagcagacttctcagtgtaaaccttacaggccaggagagagtggcatgacatatttaaagtgctgaaggaaaaaaaaaaaaaacccttttacactagaatagtatatctggtgaaaatatccttcaaacatgaaggagaaataaagaccttcacagacaaacagaatctgagggatttcatcaacatcagacctgtcctataagaaatgctaaaggatattctttaatctgaaagaaaaggatattaatgagcaacaagtgctcatctgaagatataaaactcactttcaatagtaagcacacaggaaaagacagaatattataatactgcaattgtgatatgtaaactactcttataagtagaaagactaaatgatgaaccaataaaaaataatgactacaacaactttttaagacataaacagtaaaatgagacagagagaaagaacaaaaagttaaaaactggggggaagatgttaaagtgtggaatttttattagttttcttttcgtgtttttttgtttgtttatgcaatcagtgttgttatcagttaaaaataatgggttatgtatacatatgtaacaaacctgcacattgtgcacatgtaccctaaaacttaaagtataataaaacaaaacaaaagtaatgggttgtattacttgcaagccttgcggtaacatcaaatcaaaaaacatacactgaatacacaaaaaataaaaagcaagaaattaaaccacaccaccagagaaaattaccttcaccaaaaggaagacagaaaggaagaaaaacaggaagagaaggccacaaaataatcagaaaacaaataacaaaatggcaagagtaagtccttacttaccaataacaacattaaatgtaaatgaactaaactctataatgaaaagacagagtgcctaaatggataaaaaagcaagaccaaatgaccaaatgacctgttgcctacaagaaacacgctttacctataaagatacacacagactgaataaagggatgaaagaagatattccatgccaatggaagccaaatagtagctctacttgtatcagacaaaatagatttcaagaaaaaactataaaaagagacaaataagctcattatataatgataaaggggtcaattcagcaagaggatataacaattgtaattatgcacccaacaatgaagcacccagatatataaatattattagagctaaagagagagagagatctcaatgccataattgcttgagactttaacaccccattttcagtgttggacagatcttccagatagaaaatcagcaaagaaacattggacttaatctgcataatagaacaaatggacctaacagatatttacagaacatttcttcaaggtctgtaggatacacattcttctcctcagcacacagatcattctcaaggatagaatatattttaggtcacaaagcaaaagtattaaaacattcaaaaaactgaaataatatcaagcatcttctttgaccacaaaggaatacaactggaaatcaataacaagaggaattttgaaaatcgtacaaacacatggaaattaaacaatatgctcctaaataaccagtgggtcaatgaagaaaataagaaagaaatggataaatttctcaaaacaaatgataatggacatgcaacattccaaaatctatgggatacagtgaaagcagtactgagggaagtttatacctaccaatgcttacatcaaaaagtagaaaaacaaataaacaacctaatggtgcatctaaagaactagaaaagtaagagcaaatcaaacccaaaattagtaggaaaaaataattataaagatcagagcagaaataaataaaattgaaataaacgaaacaatacaaaggatcaataaagcagaaagttgggtttttgaaaagataaataaaattgacaaacctttagccagactaagaataaaaaaagagaagactcaaagaaatgatatcagaggtgaaaaaggaaacattacaactgatactgcagaaattcaaagggtcattaggtggctactatgagcaactatgccaataacttggaaaacctagaggaaatggataaattcctagacacatacaacttaccaagattgaaccatgaagcaatccagaacctgaacagaccaataaaaaatcatgagcgtgaagccataatgaaagtcttccagtaaagaaatgctgggacccaatggcttcactgctgaattctaccaaacatttaaagaactaatgccaatcctacccaaagtgttcaaaaaaatagaggaggatagaacacttccatactcattctatgaggccagtattatcccgataccaaaaccagaaaaagacacatcaaaaaaacctacaggccaatatccctgatgaacactgatgcaaaaatcctcaacaaaatactagcaaattgaattcaacaacacatgataaacttcattcatcatgacaaagtgggatttatcctgtggaagcaaggatggttcaacatatacaaatcaatcaatgtgatactcatatcaactgaatgaagcacaaaaaccatatgatcacttcaattgatgccaaaaggtatttggtaaaattcaatatcccttcatgataaaaatcctcaaaaaactgagtatagaagggatatacctaaacataataaaagctaaatgtggcagacccacagctagtatcatactaaatggggaaaaattgaaagtcttttctcaaaaatctggaacatgacaaggatgcccagtttcaccactgttattcagcatagtactggaagtcctagctacagcaatcagataagagaaagatataaagggcatccaaactggaaaagaagtcaaattatcctagtttacataggatattatcttatatttggaaaaaactaaagactccaccaaaaagttattagaactgatagacaaattcagtaaagttgcaggatacaaaatcaacatacaaaaatcagtagcatttctatatgccaatagtgaacaatctgaataaaaatttaaaaagtaatcccaagtataatagttacaaataaaattaaatatctagaaagaaatttaactgaagaagtaaaagatatctataatgaaaactataaaacactgatgaaagaaattgaagagaacccccccaaaatggaaagataatccatgttcatggactggaagaaccaatattgttaaactgtccatactacccaaagcaatctacagattcaatgcaatccctttcaaaatactaatgacattcctcacagaaatagaaaaaacaatcctaaaacatacgtgaaaccacaaaagacccagaacagccaaagctatcctgaggagcaaagagaacaaaactggaggaatcacaatacctgacttccaattacactacagagctaagtagccaaatggcatgctactgacataaaaatagacatataggccagtggaacagaatagagaacgcagaaacaagtccacacacttacagtgaattcatttttgacaaaggtgtcaagaacatacattaaggaagagagtctcttcaataaattgtgttgggaaaactggtatcttattcagaagaataaaactagacccctatctctcaccatatacaaaaatcaaaatagattaaagagttaaatctaagatttcaaactatgaaactataacaagaaaactttgaggaaactctccagaacattggtctgggcaaaaatttcttgagtaataccccacaagcacaggcaacaaaagcaaaactggacaaatgaggttacatcaagttaaagagcttctgcacagcaaagaaacaatcaacaaagtgaagagacaacccacagaatggagaaaatatttgcaaactacccatttgacaagagaatagtaaccagaatctataaggacctcaaacaaatctaaagggaaaaaaatccaataatctgattttaaaaatgggcaaaaaatatgaatagagatttcttaaaagaagacataaatagctaacaggcctatgaaaaggtgctcaacatcattgattatcagagcaatgcaaatcaaaactacaatgagatatcatctcatcccagttaaagtggattttatccaaaagacaggcaataataaacactagtggggatatagagaaaagggaaccctcatacactgttggtgggaatgtaaatttgtacaaccactatggagaaccatttggaggtttttcaaaaacctaaaaatagaacaatcataggatcctgcagtcccactgctggatatatacccaaaagaaaggaaatcagtatattgaaaggatatctacactcccatgttcattgcagcactattcacaataaccaaggtttacaagcaacttatgtgtttatcaatagatgaatggatgaagagaacatggtacataaatacaatgtacattttttattcagccataaaaaagaatgagatcctgttatttgcaacaacatggatggaactggaagtcattatgttaaatgaaataagccaggcacagaaagacaaatttcacatgttctcacttatttgtaggagctaaaaattaaaacaattggaactcatggagatagaggataaggatggttaccagaagctggaaagggtagtgggggaagtagaggggaagtggggatggttaatgtgtacaaaaaaatagttagaaagaatgaataagacctactgtttgctagcagaacagggggactgtactcaataatttaattgtgcatttaaaaatgatgaagagagtataactggattgtttgcgacacaaaggataaatgcttgaggggatggataccccttttaccatgatgtgattattatgtactgcatgcctgtatcaaagtatctcatgtaccccataaatatatatacctaaatgtacccacaatattttttaaaaatacaactgttctggggtaagacagtcaaaggaagcttcatttgaaatttattatgccatgttaacagacctaaacccagtttctggcagaatcacttaattaggttagccaagctctatattaatcagcaagatttaaagaccttcatattattaccataacaatttttgctgaagtgatgctgaaaatctcagatcttctgctatggagccaaaatcagtcataatagcttccacataaatggaccatataaagggaagtggacttttaaaaaaactatagtagactgttcccattactctcttttaatctgtcttcatgttaaattttttctcaataaaaaccaacattcatgagacaaaaactagtcatttaattgtgatgatgtcactgaaaaactttgaaaatgcaggtctggtaaccatcttccttttgccctttgaagcatgatggtacctgatggctcatatgcagcctcttgacagcctgtgttcacctccttgtgaacctcaaattggttcctgtgctccaggcaaaaataaataaataaataaaaggcttactatcttcccatattttttcctcttccctctctttctcctgtcttcccatcctttctgcttgcctgccctccaacagattttgagaactcactaagtaatagattctacaagaaatactagaaatattaattcaaagctaagacaaaaatctttgctgtaaagagctcaccatctggtggaagggtagaaagttctatgacttttctgaagcattcaaattatttccttttttttccccctgcatcagcacggggggcagtgggagaaagggttcatgaatgcactctctcaaatttcacttttatcagatctatagtaagagatgaggaaggggctcctttttcttctcaacatttgaatcggtatttgtgttaacatgaatgttctttccttaatgttcaagtgattcttcgtcagaagaaactttgtaaatacatcatcaggttacaaccctcaactcctgcttaatattgagtactgtaagtgaaagaaaaattaagaatgtaattttaatatgatttgggttttgtctgacatctgcacgttaggtcaatggtctcatgagccctcttgtaacatggcttttcatatgcctgttccccacagggttatggctctgctttcttctccttgacatggacaccactgtgtcaatgtctcctggctcacgaggttccagccaggctgaccttctgtatcttctgacatgatgggtgctttcaaggcagaggcctttcacgtgctgtttttgtgctggaaatgctgctcctcacattctttgctgggctcaggtctcagacttactgagttctcgaacaaatgacaaggccattgttaggagcactcctagcactctctccactctcaggccagacacaggagggtctgggggttcatgagcactagctttggctttgggctttctgcatttgagtcccagccatgtccttagcaacagtcatgagaaggtaatgagaaggatgacagtgtttatcactgtcattttatgtcattttatttgtttatgaaaaaaataaagattatacatttaaacctctctctttatggtctctcaatactacttaaatgtcagttccctttttgttagcaggcttacacacataaattgcctactaataagcaaacataagtggtcccacagatatacgtaaacatttaaaccaatatagaattgataacctgtgaaagcctccttaaatattcaatctggtctagagggtcacccgtaggattctaaacattgatcagtctacacatggttaggctccctataccagtctatactggtcagttagcaaagtgcatgaggcactttagacatgttgtgatatttttatttttagctgaccgtatgaagatagatacctatcaactgacatagccacatgcacaggactgttttctacaatagctagagtggacaatggagaattctttaatcatttttcttttcaggaatggtatgaagacaactgacaaaggtcacttctaggaactaatttcttcaaaagcttaccactgttccattgtccactgagagtcaatatcagcaatttgccaatataattctattgattaggacaagctagattatgctgcagtaatgaaaagaccccttccctccccaccaaatctcagtggcttaaacataaaagacttatttctctgcacactgccatccaagggtcagcaaggcctctgctcattgtaatcactcagcactatctgtcactgtctagcagacagagagtattctagagggtctgacactggcaattgaatgctctgttgcacaagtgactcacatggctcataacccactggccagatatagtcatatagcccaaccctaccctgaagggatcccagtcacgtaatcttactaagtgtccagaaggggcaaaactggaaacatctggtgaattacaagaacagagtttaatattgattggatttttatattatctcaaatatgataacatctgagggattcttttcctttttctttttttttttctgagacagagtcttgctctgtcggacaggctggagtgcagtggcacgatctcggctcactgcaatctccacctcctgggatcaagcgattgtcctgtttcagcctccggagtacctgggattacaggcatgcaccaccacacccagctaatttttgtatttttaggagagacggggtttcaccatgttgaccaggctggtcttgaactcctgacctcaggtgatctgcccgcctcggcctcccaaatgctgggattacaggcatgagccaccgtgcccggcccctttttcttttagactttttattgtactatgatcaaccatataccctgtattattattattattattattattcaacatccagaattaatggccttattaagaccttattcttggcctgttaatgcaagaatgtggcaatagcactttgttcttacgtagaaaaatatttagaaaaaaagatagtctttttttctgtctcaatattcttattgagaaatctctgtacatgtatatatgtatgtatacacatatatatgatatagatatgtgtatgcagatgcatatattccagcttttatattaatgactgaagaaggaaatactatgttaaaaaatagtggcataagaaaaaaatcctaattcgcattttgcctgtattttgacaatcaaaaaagaactataaaaataaatgctgaccaacctcaccttagttaaagcatccagagaaagatcaggtgggttggtcaaaggaagtgcaagacatgccaacctcaaagggcaccaacaaggaccttttaccaaagctagaggatactcttgggtttgggaatttgccttctttcaacattatttctattaccttttaaaactgtaatttcatctcacccctattgtgcatttcataggtcatctcctaaagagctaaaacaaagagtcaaacagagtactaataggtaggcagggctcactcataccagcactctcttcttatgctggttttgcttaaaggctcctcaatgaagagataaccactatattagtctgcttgggctgtcataacaaaataccaaaacttatgtggctgatgcaacagaaacatattttcttgcagttctggaggctagaagtccaaaatggggtgccagcatggtagggttctggtggggttctggcgagggctgtattcctggcttgtaagcagctacctcttgctgtgtcctcacatggtaagaagagagggcaaggtcaagctctgcagtgtctctacttataagggccctaatcccatcataaggctccaccccacgatctcatctaactttaattaccttccaaaggccccatctccaaatgccatcacactgggggttagggtttccacatacaaatttgggcaccgggacacaagcattcagttcataacagccactaagcagtttctctccaggccagtaaggaagctgcatggcatctggcatccctgtaagtagacatccaaagcactccctgtgcccagaggtggtctctgcacaaacagaagcaaaggaggccatcatatctgccactacaacaactattgggtcctttgaagtgacaggcaaggtgtattttttttttttttttagagacagggtcttgttctgtcacccaggctagaatgcagtggtacaatcatagctcactgtagcatccaactcctgagctcgagtccaggagtgatcctcctgcctcagcctctcgagtagcctggctaagttttttatagagactgggtctcactatgttgtcccagttggtcttgaactcctggcttcaggtgatcctcgtgcctcgacctcccaaagtactaggagatatatatagcatttatatatgcatttatatataatatgccagcaaaatatatattctaatagataatattatatattttatataaatatatatatcaagttttaaaatatatatatatataatttttaactggaatatttagtgtttgaaggtagcagaccacaaattctaaatgtttctttcacttatctaaatagcacaggaaacaagtggcaatttgacatatttgtaaaacataccactgggaaaatcctgctctcagagagaatgctagaacagaaaaacctgccggacactgagacatttgccctgctgggtacttggcagctacaagttagtactttaatcccatcttcaaagtgccacccaggtttggcttcaaggcctacaattacagagcttatttaccaaaggcactatgcaaccttcccagcaggccaagactcctgtgagaatgagacaagccaaagcatctggaacacctaaaatttaccttaaggttggtaacaattctgacagctaacagctattcaaagtccaccacactaaggaccagatactgtactaagcatttcacatatattatctttggtcctaccaatagcctatgaattgccacaacatttttcccatttttagaagaggacattttctctctttcagcttaatttcatagacattgctcatttgcatagaatagtggttaagaactggggttttgtagtcatgctgcttagtatcaggtttaaagacaccataaccagctatgtgacatcaagcaagttatttagcctcagtttcttaatgtttaaaatagggataataaagtgtactttcatgaggttgttgtgagaattaaagttaaaatatgtacagcatttaagacaatccctggcatatggtaaactgatcaacaaatgttagccattatctgatcacacttcataattacttatttggaatccattttagataatagaaagcaaatatatagggaaaatgtacactctcagcttctgaaaggtaacaattatgattaccaatttaaaaatacaaaacaattgacacccaaccagtgcctaaaattttaaacaatagttttgttacagtaggtagtcaggcatgagcagggcagaagagggccccccacctaccaggaatgtccggtgaccatcaggtgatggtcaggcagttgttaaaactgtctctttaaaataataattggtcacagcaagtaccagggaaaggcagtctcccaatagacagaaaaaacctgaaactgcagatcagcagcttcccgataagatctcaggagttggggcaagtgggctcaaccatgtgcactaaggcaaaatggtggagcttaactcatatatgaccttctaggaacactactggtaacggaagaacgcctgaagtgagcatgtgtacaacgtcagtaaatacactatgcttgcagcccctcccaagtgctagcaggccactgagcatgtggatagcccaaccaaagggaagactcaggggagaagtaatgcaaccacagaagcatgccattgtttaagacccaaagtcagaggtcaaactgcacacttgaatctctcaagttgcccactggccttcttccaagtgcactttacttccttttgttcctgccctaaaattttttaaaaactttctaaaaaactttcattcctgctctaaaacttgcctccatttctcactctgccttatgccctttggtcaaattctttcttcttaggaggcaagaactgacattgctgcagacccatatagactcacccactgctaacagttttattccagcattattgtaaagaaaatgaaaatagccaatcatgtcagagccaaagttacatttctctgagtatggaatattccattagtaagtcagtctttggttactgggtttgacagacttaacttccctattctacttggccagctctaatcttgagaggacattggccctcccaaaacttgtggccagcaccatgaggaaatctgcacttcctggcagcagtaatgacttaaaagcagagtaggcatgatttattaattagatctgtgctctggccacccctctgttttctacctttagcttcttttccatccttcatttgagcactgggctctttcatcacaacaaaggcagatgaaaatgcagagtgtttaggggatcctgagacctgtattaacagtatcttatgatattgtctatgtttagtggccctgtatctttcagttatgtgggttctttagagtacattgcctaatttattaccctccatgtcaagaaggaaaataatcctttcaatataccagaagcagctacctttatgaatttaaagctaccacattgccacaagaagcatgggataattttaacaaattggctgccaggtgtcagctgtccctgtcacagcatatttactatttctagataatactgacatcaacagaagcagcagtaaatcgcttagtccacaacagaatcaccatgagtctttagtcatttattaatgtcaatgcttggtatgaaattcaggaacctgatccccatgagggcccctagcatcgtccactacaaattacattactaacacaggccaattgtcttaaaatctgtgcctgtggtcacaaggagaactgggtgggaatgtacagataaatagagtctatctatccttctcctaaggaaaaataaagagcaattcaaaggacatgtctactaaggggcggtaaataatattatctctcaggtagttcctttgccctttgtctgtcttcaggaagtgagcttattagtgtcttatttagaacatatatatgttacacatatcctatctagggccaatgcacggaatttcaatgtaacattgggaatatagtggaagatatattttgaaatgcaactccctctccccttcccccaccccaagactgttgacaggtgctaagaaagaaagaaatgaggaaatttttcttaccgaagcatgcttatcaacaccatcaccattagtggatatttctaatgtcccactgtgcccaagtgagttcagcaatccttgatgtctttaagcacaggcctgagaacacttaatgggagatattttagagacaactaacccaaggagcagctgcaataaacagactttaaaattctcctccagctctagcttctgttgttctgttcttcatcaagtttaatataaaaggcaaagtgtctgcccttgggcagttaataatctggttaagaaagcacagctgaggcaagcctctttaaccttttaaaaaaaacaattaaaaataatatttggcagctcattatcttggtttgtctaaactatgtatattgaaggagataagcaagaaggttgattcagggctgaagaattcaaaggagagtttggggaaggagcattaaaatgaagaggtattaaagcaaataaattgactttcacttcatagaagataaatagaatgtttggtcctttagcccctgaagcgggctggggagtaggggtaacatccatggtccatatgagtttaagatttttttctttaagatttgtctctcttggttagaaggcagagattgcattttggatcaatttatctttctcttacaaggcatattaatggaagccatgtattcagtaagcccttgctagtcactaatttttaagtgtcataaatgggagactgtgaatggggatgatgctaatctgagcctgctccctgccatgaaaagcatcacatacaacctctcgtatggcatgccaatgacattgtcatacctcttggctgaaaatcagcctaatcaaaatggaaaatgccaggggaaaaaatacaccaaggggaataaaaaaaaaaatgatttcgattccagcttcttcacaaaaaacaaaatattatcctttattcatgaaaagttgacatttttcacttaagttttcttaatgtggtggattacattgattttctaatgttaaaccaagtttgcattccagagacaaactctatatactctaaatcttgtttatatattactgattttggtttgctagtattttgtttaggatttttgcatctcttttccaaagtaaaattagcccataatttttattcctaacattgtccttgttatgtttccatcttaggttatgtgtgagtctgtctgtttttgaatgttaggtagacgtcaccagtgaagctgtctgggcctggaattttctttgtggaaagattttttaaattactgctttaatttcactcatagttatggaaccattcagactttatactccttaatgaatcagttttagtaaattatgtttttctggaaattcatctattttatctaaaattttgcaaatattgacagaaatctgttcataatcttttcttttcaaacgtgtctgcagcatctatagcagtctcctttttactcctgatattagttataataaaccctgacttggccaccttgcctgccaatgtcattgtagagttggctggatgacccaatcttgactcagttgctacctgtgcaaagcagaggcccctggatgtcctactcctgctatgtatgtatcatacttacacaggacatgcccttagctagcccagtatgtatggactcaacaagcctagatactgccagataattaacaatgtctaggggctttgcatttctcatttgggacaagacaatttgtggtcctttcttttctcctccaaacctcaaccagcagagccttcctagactccatgctttattggattgcctgtttagcagtaaaactcttctactcagcaatcaatcctggctttctaatcgtctttttttttctttgacggttattagtgccttatcttttttttacttaacattcttgccaggaagttatcaatttcataaatctttaaaaaaaaaacccatcttcagtctttattgtacctctatagtgcttttctattttattaatttttgttctcatctttattatattcttttctgttttgttttgctgttctctttcaaaattcttagaatggatgctcaactcagcctttttattttgttttctaatatatgcataaaagctatcaaatttctctaagtactgcttgagttgcatttcaattgatatttacataatctttcaattcaaattatttttgaattttcataatttcatctttgagccatgggctctttaagagtatatttgtgatggttaattttaggtgtcaatttgactggttaagggatacccagatagctggtaaaacattatttccaggtatgcctgtgagggtatttccagaagagattggcatttgaatcactggactgagtaaggaagatctgccttcacccaatgtgtgcaggcaccatccaatcagttgagggaccagatggaacaaagagaaaagctatattcactctcttctggagcttgtatatccatcttctcccctgcccttgcacatcaaaattctgggttctttggccttgggactcttggacttccaccagcaacccctctggatctcaggcctttggacttggactgagagttacaccataggctcctctggctctcagacctttggagtcagactgagccacaccagcagtcttcctggttccccagcttatagatggcatattgtggggcttctcagactccatgaacacatgagccaattctcatattaaatccaccctcatatatctatgtctatatatcctattatttccgtttctctggaaagccctgactaatacaatgttcctgaatttcctatcatatggggtttatattttatttatttatttttgaaatggagtcttgttctgttacccagctggagtgctgtggtttcaccatgttggccaggctggtctcgaactcctgacctcaagtgatctgcctgcctcagattcccaaagtgctgggattacaggcatgagccactgcacctggctgtctgtgttactttacttataaatttgtcgagacttgttttatggcctatacatgataaaactttatgaatgttccatatacatttgaaaagaaagcatatcttgcagttgggtggaatggaatttatatgtgaattatctcaagctaattaattgagttgttcaactcttgcagatccttactttctttctttctttttttcttttttttgggccaccttgttctagtagttaacaagaaacatgctaatatctctcataatgattgtggattggtgtatttttttataggtgtcaattttttgcttttgtattttgaggctatataattaggttgagacaaattttaaattgttacatctttctaacaaatttaatacttcaccatttaaaaattagcctatttctaataatgcttttgtggtatagtaaaatatatatatttagattttggtcctggttactggcacagagcttcaaaaatctttgaaatttcctgaaacataattgtctttttttacactaatgggatgactccagggtggagggagggagcttctgcttcattctttcctctgcttctggaaatataattttatgttatgttaaaaacttcctgactatagcctcttgtgttagtccattcttgcactgctattaaaaaaaaacctggccaggtgcagtggctcatgcctgtaatcccagcactttgggagacagaggcgggcggatcacaaggtcaggagatcaaggccagcctggccaacacggcaaaaccctatctctactaaaaatacaaaaattagctggtgtggtggcacgtgcctgtaatcccagctattcaggaggctgaggcaggagaattgcttgaaccagggagttggaagttgcagtgagccgagatcacgccacagcattctagcctggcgacagagcgagactccgtctcaaaaaacaaaaacaaaaaaacaaacaaaaaaaaccctgggagcaggtaatttataaagaagaaatttaattggctcacagttccaccggctgtacaggaagcatgatgccagtatccacttggcttctggggaggcctcagtaaacttacaattatggcagaaggcaaagggggagccagcacttcacacagcctcagcaaaaggaagagagagaagggggaggttctacacactttgaaccaaatctcatgagaactcactcactaaatagtaccaaagggggatggtgctagaccattcataagaactctgccccatgatccagtcatctcccaccaggccccaactccaacacttgggattacaatttgacatgagatttggtggggatacagatccaaaccctatcgttccacctctggaccctccaaatctcatgtccttctcacattgcaaaatacaatcatgccttcccaatagtccccgaaagtcttatttcagcattaactcaaaagtccaaagtccaaaatctcatctgtgacaagactaggccttatgcctataatcccgtagaatcaaaacaagttagttacatccaagatacaatggtagtacaagcactaggtaaatagtccccttccaaaacgaagaaataggccaaaagaaagaaactatagccagacacagtggctcaagcctgtaatctcagcactttgggagaccaaggcaggcagatcacaaggtcaggaattcaagaccagcctggccaatatggtgaaacctcgtctgtactaaaatgcaaaaattagctgggcatggtggtgggtgcctgtaatcccagctactcaggaggctgaagcaggagaactgcttgaacctgggaggcagagattgcagtgagctgagattgcgtcactgcactccagcctgggtgacagagtgagactctttctcaaaaacagaaaaaaaaaaaaaaaaaaaaaaccagaaaaaaaaaaaaaaggaactctaggccccatgcaagtccaaaacccagcagggcagttattaaatcttaaagctccaaaataatctcctttgacttaatttctcacatccagggtacacaaatgcaagtggtgggctcccaaggccttgggcagctctgcccctacagctttgcagggttcagcccctgtggctactttcatgggctggcactaagtgccgatggcttttccaactacagggtgcaaactgccagtggctctaccattccagggtctggaggatgatggccctcttctcccagctccactagacagtgccccagtggggacttgtgtgggggctccaatcccacatttccccttcatattgtcctagtacaggttctccatgagggctctgcctcagcagcagtcttctgcctggacatccaggcttttccatacatcctttgaaatctaggtggaggctcacatgcttcagctcttgcattctgcacacctgcaggcttaacaccatgtagaagccaccaaggcatatggcttgcaccttctggagcagtgggctgagctctatctgaggccctttgagccaagtctggagctggagtagtttggatgcagggagcagtgtcccaagcccacacagggtggcaggtctctgggcatggccatgaaaccctcctatgtctccagacctgtgatgagaggggctgctgtgcaggtttctgaaatgcctttgaggtcttttccctattgtcttggctatttgcacttggctcttctacttacacaaatttatgtggcctaactgaattcttcccctgaaaacaggcttttcttttctaccacatggccaggctgcaaattttccaaacttttacaccctccttcctttttaaattccagttttatgtcacttttctgctcacacatatgagcataggctgttagaagcaaccaggccacatcttgaatgccttgttgcttagaaatttcttctaccagatatcctaaatcatcactctcaagttcaaagttccacagatccctagagcagaagcacaatgcagccagggtctctgctaaaccgtagcacaagtgacctttactctagttccaaaagttctttatttctgtctgagaccttattaccctggacttgattatcaacatcactgtcagcactgtcataaccattcaacaagtctctaggaagttccaaactttctcttaacttcctatcttcttctaagccctccacactcttccaacctctgcccattacccagttccaaagctacttccacattttcaggtatctttatagcaacaccccactacttggtaccaattttctgtattagttcattcttgcattgctataaagaaatacctgagactgggtaatttataaagaaaagaggtttaactggctcatggttccacaagctgtagaggaaacatgatgctggcatctgctcagcttctggggaggcctcaggaaacttagaatcatggcagaaggcaaaggaggagccagcacttcatatccagaaggaagagagagagcagggaggtgttacatgcttttaaacaaccatatcttgtgagaactcactcactatacagtaccaagttggggatggtgctaaatcactcatgagaacttgaccctgtgatctaatcacttcccaccaggccccacctccaacacttgggattacaattcaacatgagatttgatggtgacatagatccaaaccatatcacctctctttcatattttacatctctttcttcttttgtgctttcgaaactaatgtcctcaaacccctctttcagttcacgaattctctcttcatttctaattagttaattttaatcagattttaatttcaattataacatttctcattcctagatgttcatttggttccttttttgaatctgctttgtctttttggttttctttttttctagcttagattttctttctggacacagtaagtgtaattatattctgaatttgataatttcaataaatgaaatcttagtaggtttttttttatgttaattcttgctcatgtgtgtagtctctttatatactaagtaattgtagaaactgaattgcccatattctctggagaattatttgtggatattcttttagaactgctttaatcacctccaaggcaattttccttttaatatttcgagggtaatatatgggtagaatacttctgttcaacctaagccagaatatatagccctctaggcttctagattttttaaaaaacgatttgtcttatttgatttcctacctgagaagacgctgaaatttgtcttctgttcccagagtccataaggtcatgtaatttttatgaggttcagacaataagtaagagtggcttggtgtgcaaggtttcctcatttacttagattttagactcatacatctttactcttttgctggatattcagcatgtttaaaggagaaggttaaaaatatagttatttcagctttttaaaattatttatttatttacttattttttgagacaggatcttactctatcacccaggctggagtgcagtggtgcgatcatactcattgcagtcttgacctcctgggctcaagtgatcctaccaccccagcttcccaagtagctgggaccacagctgtgcaccaccatgtctggctaatttttaaaattttttgtagatacagggtctccctatgttgcccagactggtctcgaaatcatgggctcaagatcctcactcctcaacctcccaaagtgttgggattacaggtgtgagctgctgtacctagctttatttcagcttttaaagttattttcagctgaacaatatattctgatatttaatcatgttaattgatatggaaatcaatattcattatgtaaataatgaatatgcaaattattataatgaaaatacatatttacagataagccgagttttttttcttgaacaatttttttatttccttgggactaatttttttgtattttcatttgtttagttttctaagcatcatgagttcagcctcaaattcttagccaattatctaagtcttttctcaataatttaagatgtacatatattccatcaaatttagtgtgaaggctttctcctggagctttttttacctactcttctggacttgctccaatgtccattatgtttcacttctcatctgttttcattctctttcatgtttctgttactgactagaggttcttgatttctcattgcaatagaaattgacatgaggccaaaagaattttcccagacaagccttcattaaaacttatgcttgggcataaggaaggcagagggtggggggggggaagagagagagaaagagagagagagagagcgagagagagaatcccctgactgactctgaaaagagccagtagggcttttttattagactaagcaaaggaaatgacatcagggtagggtatgctggctgaggggtagggcatataggtcagcattatctggtcattagagttatcttgagtaatgggccacctggtggtctggccagtggcaacaagactataaatcaattgtccaacattccttactgaggggggacactgcaaccttgcttatctcctaaggccagttcctagaattatttaagtaaaaggactatagcagtgaggtagtagtgtgggttttatgatcagtgggaatacatgaaagaatgctctagtaggggtaagctgaagccaagccccatctctactcagtctcatttccaaatacagaaaatatttatattctattctaacatttcattaataatttgattggtaagggattctaggttggaaataatttttcttcacaattttgcgttggtcacttaacatccagcatttgtgagatgtctgaagctattctgatactgaatattttgaatttgtcctgttttgatttcctctctgaaaatttgaagaatcttttctttgtccctagtgttataaaatttcataattggtcagagtttatcttttatgctaggatacttcccaggcacttttatcaataaacacatacttctctttgaaggaaaatttcatagactattttgttgatgatgtttttccctttgttttctttgtttactctttctagaatgcctattatctgaacggtgaacatcctgcatcagcactctaactttcttaccttttctttcctatgttctatttccttgtcttttccctcctttctctggaagatattctaatctttatttcttattttttcccactgaatttatcattatgatattctccgtataggagaaaaagtgtttttttttttcctattctttcactcaacaacaagcaacatggaagatttctgtgaccaaatatgtggggatgtttccccaccaacaagcaaggaatcagttctgcagtggatgctaactgagtgtcctctaattcaattcaattcttatactatctacctagagagagcatcagctcccacaggctgagggttcagtccctcaagatgcccaccctgccaccctgccttagatgccaaccacaagctccaggttgttttacctgtacttctaatcaactgggtataaaagtgggttcccacaatcttttccttggatttgattaatttgctagagtggctcacagaactcagggaaacatgtttaccagtttattacaaaggatattgtaagggaaacagatgaagagatgcatgggtaaggcatgtgggaggggacgtagagcttccatgccctgtgttcagctatccagaaactctctgaatccagtccttttttttttaatggacacttcattacataggcatgattgattatcactgaccattggtgatcaacttaaccttgagcccctcttccctccccagaggttgggggctggggcttaaagtcccaactccataatcctgccttggtcttttcagtgaccagcctcatcctgaagctacctaggggctgccaaccatcagtcaactcattagcacataaaaatacctcacatttggagattttaaggatatgaagtgttgtatgccagaaaataaggacaaagaccaaatatatattttataatatcacaaatatatttttccagagtttaaaaaatgcctcttttaccccattctttttcatggatacaacattttcttctctttttcagagtatattaatggtagattttttgagtgttctctctgcagagtctctgttccctttaagttactttttctattgatttggtctctatcttttattttagaggaattcttcagatgtttgttgctctttggttgtttccacctttgggctacataacctatttaagctctgagatctcagctcaccattcttaaaactatggtagtctgttgggcccaatttaggaaacgctgatctatgtcatactaaatgaactttatcagaccaggcatagacaaaagtgaaacagacaaaatgtgcttttcataagccctacctccctctcccttccttaggtttcttccataactctaatcctccctcaccctacttctttccttcaaaatctctctcttgtctgtttccctcattaaaactgattcaagtaaaaaatctatcattttattcatacacagtatgaatgactgataagactaaacatattctctggtatttggttgttaaaacaagaacaaaagtatttcttggggataaaccaaaggaataaactctgaggatataacttagtcaacatcaatgcaaatcagcagaaaggtgtaagaaacagacaactccctaaataaaagcaaacctcttattctacacagttggcaatggagggagaatctccacaatggatgacgtagcagaaccctcataatcccaactgttgccttctatgattcaccttccccttaaggattttcctctaattatccctgtaaccattcctaggccatgaagaggcgaaggtttttccctttggacactgaggcccaaaaatggaagcctgttcttctttgacatcccaaacagggcaaagtgacaccattatagaagattttattaatgtctaaagagaaattaacagaaacgtcacaaaactagataataaggagtatcagaagtgaccgtgggtactagcccaatcctatcctcatttctgttcccagcattcagaaacatagactagatagtctgattcctctttttctaaaagcaagagatgaaggctcagaaagaagccatctcctcctctactgagttaaggtctttcttctaacagaagctgcagactggtagaatatggactgatccatagatatattttgttagttctgttctacttaaaaatcacttaaaatttagtcatcagcactgaaatttttgagattgtatttcaaaaaagcaaaaccattttccagcattgaacatatatgcatacacagacaccccctccccttcaacacacagtctgcagattctaaacatctatacagaaatttctaacaagaaaaaccatcttagagacctaaattctaagattttattaatatagcacaagaaaacgggagaaataatacagcagtgtgaattagctgaaagacagttgaggctgggcatggtggctcacgcttgcatatcccagcactttgggaggcagaggcaggtggatcacttgaggtcaggagttcgagaccagcctggccaacatgatgaaaccccatctctactaaaaagacaaaaaaaattagccgggtgtggtggcgcatgcctggaatcccagctacttgggtggctgagacaggagaatcacttgaacctggtaggcggaggttgcagtgagccaaggttgtgccactgcactccagcctgggtgacagactaagactccgtctcaaaaaacagaaagtaaaaaaagacagttgaatcagaagccaggagagttccattctagtcccagccatgacacaattagttttgtgacctcagcaatatcatttagtcctctaggtctccatttccttatctatcctatacagagaatgaaattaaattatatttaacagaccttcttggctataatcttgtaattcaagggcaaaattttatcaaagtactcaagtcagataaatcaaagaaaacactataattatacaaagaaataaatctgacacggtaatatttttgtgttaaaatttatctagaactgacaaatatgcatgcataaaatgagagccaaacaaatatatgaagtaccagattaaattctgcttcaactaggagaaaaatgtttttcttgtagatagcaaacttaaatggatcaactggaaaccatacacaattcttccaaaacaaccatataaatttaacggatttaaacttatacacaaaacattagttaaaacattaatcatttactaatgccctctcatttatgttctccaatgaatttgcattagtcttacaagagataaaacaggaagcaaaataagccttcctgagctttctgtgattataatgttgagtgacagattctgtagaatgaacaatggacaatggaatagtctggccaaattaaacactttctgtaagcagactgagcctttatctcagccaagtaatcatttttcttccatgaaaaataactaaaatcacgccaagttgtatcactgccacagaaattggaatggcttcaacatcccataaaaacaatgacacttaatgaattgcttcagttaaatcatgccggagagagaaaatagatgaacaatttcattgtgttatgtgtggtccaaaagatatgatcaacacaggtaatcactgactcccttcatgccagaattaccacctgagataaacacacctggattcccacgaactttcttggtttatgctgactaaaatgaagtgattaatgccattaagaagcaagctaaaataataggttcaaaaagagcagcaccaaatagtgtgaaacacacagacaaaagacaaaatcagcaagtaagactgaaccagtttgtactacttgagacatcattttaaaagaatttagaccaccacaaaacaacatactgaattacacaaggtactgatctacaaaagaaatctaaaatatttaatacctcagaaatatttgtgaatccagtgaccttgtacatgttttcttagaagtttaaaaaatatatatattgtattttttctttgtattgctctttagtttttccttctgtctgcagtgaatacagaattaagagataatgtccaatgtaccacaaatagaatataacatcataagtacagaatttcaagtttacactaagaatgaatgtatgaatgtgatcactatattgttctgcatgtaaaacactgttaatctttttcagagactgggtctcgctttgtcacccaggctggagcgcagtggtgcaatcacagctcactgtggcctttaactccccgggctcaagcagtcacctaccctggcctcccaaagtgatgggattataagcatgagccactgagcccagcctaaaacactgtttaaagacacatgtataaaagatgtttctgtccgggcgtggtggctcaagcctgtaatcccagcactttgggaggccgaggcgggcggttcacgtggtcaggagatcgagaccatcctggctaacaccatgaaaccccgtctttactaaaaatacaaaaaaattagccgggcatggtggcgagcacctgtagtctcagctactcgggaggctgaggcaggagaatggcgtgaacccgagaggcggagcttgcagtgagccgagatcgcgccactgcactccagcctgggggacagagcgagactccctctcaaaaaaaaataaaataaaataaataaaagatgtttctaagagtgcaacttgggtgtctgattgagaagagagttgtttcaatgaatgaaggtgtccacaacacaattctgcatgtgacatactctgaaaagacacacatataaaatatgtttctaaaatattctaaaaaataataaagtttgcactaaaaaaaaattaaatacaaagaactgaagttcaaatatacctaatacagaaatattttcattctgatagataaataacatacatctgactattgattactctgtcttagatgtcaaagtcatttattatctttggtttcatcagctgttttgtacttacattttaatatatgggttcagttgtctgagaatggggtgggggaaggtttacagtttcctctttcattcccttgttcagaagaactcttgttcgctcctcatggcagatgacgtgacctctcaagataaatttaaacagattcttcctctatttctttgtttcatattttccatgggttggaaaaaaatggttagttttaaagctgtgaaatatataaaggatactgtcatgtaatatccttaattatgttcataattttaaaacaagatttgccacataaaagctacccgtgcataatcaagattttcctgtgttaacacattttcactgcaggattgcttccctatacatgctaagttgagaagctgaggttttttgtttttgttttttttttttgagacagggtctcactctgtcacccaagctggaatgcagtggtgtgatctcagctcaacctccacctcccaggttcaagcaatccttccacttcagcctcctgggtagctgggaccacaggcccacaggcgcatgccaccacgcctggctaattttagagatggggtttcaccatgttgcccaggctggtcttgaacccctgagctcaagtaatctgaccacctcggcctcccaaaggctgcggttacaggcgtgagccacggtgcccagcctggggcttctactttttttttttttgtttttttttttaatagcaaagccattgcaatagtcgctccagaaaatgtctttgctatgatcttaacagtgtttgacagccttaaaccttctttgttccttgatcctgatggactctgtaaatcattgtctggtactaaaacaattgtcagctcaaacgtcaggagccctaaacaacccaaagagacaaactaaaagagaagtaagttctgaggtttatatttttaaaggaaaccttcaatgaagcatttctcagtctcttccaccagagtatgctgaaggcagaggatagtcaaaagagtctaggggacagaccgacttacgcccgagccagagatttctttgaagtcacatgtttcatcttaaaaattcatttgaatggttaattctacgccatatttgtattaatacaaattttaagcaatttaccaagttatataacttttcctccaaatagtcaactaaattgatgcttgagaagatgcaccatgtttgctgggcacaatggctcagctgtaaatcccagcactttgggaggctgaggcaggtggatcatttgagcccagaagttcaagactagcctgggcaacatggtgaaatcccatctctacaaaaaatacaaaaattagctggggcatggtggtgcacgcctgtggtctcagctactcaggaggctgaggtgggaggatggcttgagtccaggaggtcaaggctgcagtgagccgtgactgtgctacagcactccagcctgggtgacagagtgagaccctgtctcaaaaaaaaaaaaaaaaaaaaagatgcaccatgtttgtcttggagcttttagtacttcccacacccaaccacagctatgtactccctggatgttcatataactcggtatgatgcacagggacattgaatttaattacaggttgaatactttctattgagctcttctccaacttatcatgacctgggtgtgtttccttatttcaacattgttccattttttttttccagttttccaagatcagcttggacttaatttcttccaagagtcttctctggtttctgacaatgattctcctttctcatctcctatagcacaacttgtttgcttcacacatttttcacttgatcatatatgatcctgtactagttctatttatatgttttgtcttgattcacaataatttcacaaatttcttaaggataattctctatgtgtttcatgtttactgctacataaaaaaccaccacaaaacttagtgacttaaaacagcaacaatttactgtttctcgtgattctgggggtcaacaattctcagctgggctgggcttagctgagcagtactttggcttgtcccatctggggtcactgatgtgactatagtcatctggtagcttgacaggggctggagggactaagatatccacacttagtccatgtctggggcttggtgctggctgttggctgggcctccctgtgtggtctttcaacttttgttagtctagtccagatgttctttcatggtggcaggggtgttccaagacatgaatgaagaagctgcaagggatttgaggccttggctccagaacttgcacaatttcattcctgtgacattttattttcaaagcaaaccacaaggccaccctagatttaaggggtggggaaaaaatactccacctcttgatgggaaaagctgcaaaatattgtggccatgtttttcaatcagccacatcacacattctctttcttctgtcaatttagcagcaagtgtcatagcgaaggcacgtactagatattagctgatgtgaactcagtgttctggtgttttcatttcatccagcttgagactatatcctcaggataagagtagatttaaaataaaaaaattaaccttggtaatattgatctttaactcattacttggactgattttctctttaaaagttgctcagatccaagcacacatttcttatttcaaaggaataactgtaccttgaacaaacaggttcatgctttgaagactgacaataaattgaaaatagttgttgtccatgggattaggtgctatgggtatcagagagctttgttcactggtatatttgtttattggccaaatactcacccaatgcatgccctgtgtcagtctctgtactatttgcccaacatgcataattgagtagagaagatggatatacagtggatgattataacacaatgtggctgataattgcaatgacagttaaatgcacaagatataatgaaaacacattaagagacataaaataaaatgtttaccaattcagttagaaacttacaattgggttgtgtataagacacacatgaatctcctagttgccatattttatacacacacacacacacacacacacacacacacatatcagtattatgtagcattattaaagccttttgaggatggtgaaaatacacataaaaagaaaacttccattaaaaccatggaatgggcatctgttatttttccctgcccggcactcattcgcctttctggtagtgacagcaccttgattccctacctgctctttcctcagctcttagtccacaagatggggatagagccaactctaccctaatttctcaagctgagcatgtaatccaggcctggccaatcagatcactgcattcttatagtctgagtgacttgttcaggaatagatatatgacccaagaagagctagtgagaccaattcccaggacttctgtgaagccaccattagagaagaatccctcttttctctgtggctacccgacagaatggctgtaagacttgggctgctggaagccatgaccaggagcctgagaataaagccaattctaaaggaaagggctgagacacagcagaaggaaggctgatgacatttgatcctttgaatccatccatgctggacctaactgcctaggcttctccaatatggtcacatttgcattctctctcaccacctcccacttcttcttcaaagtattagagttgggtgtttgctgcttgtcaccaaaaagccctaatatatagtacagaaggaacaaaactcaagaagtaggtttgaggggttgtataggggtcataagaaggccagcattactgaagctaagggcccatgtgggaagcagtgggaaacatgatgtgatatagtagaatgagcccactagatggttaggagtcttgacatccaaaagcatccagaggtgacagcatagtcaattaagtagataaaagagagctgtatcatgagtacctagcaaaaatattaggaagccatagcagcactgactgaaatcaacagcttgcaggcagaaagaacaactaggaggaaactccagtaatcaagagatgagggaggatccatacctagaccatggtactgccaatctgagaagtatgaagagaagaatcaataggaattagggactcctcaaggacaggaaggacaatgattaataaaaagagacaaaaattaactgctaatcaaagacttggctaaatttgcccaaacttaatctatagatagttgcttcacagcattctcagtatgcaacaatagaatgtaaaatggtacccattacttaaagactttaaaggcctttataactcccaattaaatattggaataaattaaattgtttaccctttgacagagggcttagagtatgtaaaataaaacaaaactacaacaaaaatgaaaaaaaaacccttttaccttcaaatggggctgaaggctatcgtgtgtgacttgagtctggttttatgctcactgggcagtatttttaacaatgaaatctaatagtagcattcattctggaaaactgggatatgtcagggctgaatagattttgtatatattaattaaaactgtagttttaacttttttaaacaagatatcaaacccaaattcaggaggctgcttattgtttctttaaatctgccaaggaatcaggatatctcctcatacttcctcccttgggcttgtgggtttgaggtccttcctgtctcaaccacatattctttcatctaactttttgagttcctattagagaaaacttttttttactgttagtttttctgagaaacttcagtactttattttttccttagaccatggggcaccatcagagcagcaatgaaggctgacacatcaggtgagaatctacctcaaggaaagggcaataaagagtctttggagatataggttattggaaattgtgcctggtgttctaatcttagtataaattaaaggtaattgtactaattagcaggttgttatgtctactatcttaaacaatgttttacaactacggaatttgattgaaataagttttggggctctctgagacctgaccaaaggaagaaaaacaagtgcccccaaagctctgagaagcacagacaggtgacagcctcattaggtcagctcaaagggatgcatcagctctcctcaggcaatccctgccccttcagtggccatcagcctgaagcactgcccctttcacataattcacatgtttgacacaagtacatggaatccatgtgtaaggtttacagcttggctgaagtaaaaaagaaaaactatttattcaaaagggcatgtttaaacaaaggctccgttggaattgctaacatatgtaaatatctaatgctagaatttcttttttaactccagtctttcccaatcacaaagaaaagcacacttttcaaaatgaaatctacaagtaattataatgaacctagattatttgtttttcatgggaaaattaggtagcatacagaatacctcacaactgttctggtataatgtatgcatcactttgctgccaacaagatgggctttcactaacacgaattgccctcagaccctgcctcaagtccctgaggaccatatgtctgtcatttctgggagtggcctctgggtggcagtgttattttcagtttgcactttgctcatcacgtcagttttctaagttaaagttgcaagagactcaatcatctctttcaacagactgagtgttctctattccttacttgctctgtggcttacagcctcagtttcctcctgtatagaaggagcattctattctagatgaggaaagtagttgcaaggattagagatgataatgataacaacacgattatatactgaaaacctgtgatattttaagctctatgtaggaactttacatgtaatatctcactaaatctttccaacttccctataatgtttgtgttaccgctttatcttgagacataaaaaacttaaagctcagaacaatcaggaacttagcctaagttccatggcaactcagtggtgaaattgggatctatctttctagcattataatacaagtaaagtgcctagcaaattgtctcatgctaataaatactagtaattttaaaacatttgtattattgctacaagtattaaattgtatagctgatgtctaaaacacataaaaatttaaaaatattgtttctgggatggcttaaaccgatataaaaatctgttatgacgtgtttgttcaggtgccttaattttcacccaaagaacttttgagcagagaatgcatggcctaagagaagctttgtgagtaaaagtttatagtcaattaagtgtggaaaatgcttatattttattcttcttctggagactttcaagaaacaatagcatattaaaggctccgagatgtcttgccataaagaaaactataatctagtttaacccaaagttttcacatgtacttaacaaagaaattccttcctcacataatatttataaccatctctttaaatcagtgttctgcagaaaacacttaggaggaatgaatctatggaaattcctcttccgagctgagcatgtaatgttttgactagtctttttctgccaacccagctccctgctgtagatgtgctgtgaaatgtcgaggctgacaataaacttcttctggcacttaactattaaaccgaagtttttcttaggcttttctcacaacagcacaacattctttctacttctctccatcctacagtcacaggtaaccatttcctgaaactcctgttcacagtatttcttagctcctcttacagagcagaccataacttctgtaccattcgatggcttccaaacttttgttaactctactttaaagcttattgtcacttaatttgtcatgtgcttatgcatccacaatcacattataagttatttagtgtctggaactgtgcactgcacttccctgtgtccctaaagtagcatgacagtgcattgctcattcattcattcattcattcattcaacaaacatgcaccaagcatcttccctgtgccaggcactattctaagtgctggagtatagcagtaaacatgacaatcaacgtcattagtaatccggtggaaatttatttgtatggggaaagatagataagtaaatattcaaggaggtacataactcatgtcagataagggtgagtggtatgaagcagttaagggcatgtgaatgaggaaaggaggagaggctgcttgagcttggaaaggcctctctgaagaggaaatatttaagcccggttaagtgcctagtaaaggctcagagacaggctgagtttgctaaattagaggaaaagcaggaaggccagtgtgactgtggcaaacatggtaagtcaggggagcaagatgagatcaactcagagtgggtggtgtgcaccacattgtggtaaggaatttggactttattttaagatgatacagaagccacagaatgttttagacatgggattgaactaagcatgattttataactttaaaagacaattctgactacagggtagaaaataaaatgtcaggagccaaggaaggggccagggaggccagttaaaggttattttagtaggcaaggcaagatatgatggtgatttggacacggtgatggcaggagagcaaaggaagtgggcagattctggctatacttttgcacgcgagacagtgggacttgccagcttgagcaaacagatgaacagaaatatttccaagatgcagatatttactaaatgcagatatttcctaggtaaaggttatctgggagactagtaagcctgggagaaaaagtaggggacagaatcaaaagttctttttcactgcattaaggttggaagtctgtaagatatctaggaatacatgtcaatttaacctgattctggagatcacaggaaagggcagggatatatataattatatttgggagttactggtacaaaactagtatttaaaaccatacgaccaagctcggcatggtggtgcttgcctgtaatctcagcactctgggaggctgaggcaggaagatggcttgagtccaagagttgagactatcctggacaacatagtgaaacccatctccacaaaaaaatacaaaatattagctgggcctggtggtgcatgcctgtagttccagctacttgggaagctgagacaggaggatcacttgagtccaggaggttgaggctgtagtgagccatgattgcaccactgcactccagcctgggtgacagagtgagatcctgactcaaataaataaataaataaacccatgggaccacaagaaatcatctaaggagagaatgtaaccccaaggcacctccaaatttggaagtagtataggctgagaaagggaagctaaaatggtaaacaggagaacatggtgtcaagaagtccaagagaataaagtatagctagcatgaaggagtggtcagctgggtcaaaatccaaagatttagatgtgggcagaaaaggaatctttggattgccaacatggaggcagcaagagcagggccagcagagtggtgaggactgaagatggtaagagttcactgaagaaagggtcagagaaataaggcagtactaatggggacacaaagtcaagagagggtttccctccacccccagaagggagatcctggagtttacctaaatagagtcagaaggagaggttaatagtatagaaaagagaaggactaattgaacatgtatatctttatctaattattgtcctttttttttttttttttggatacagggtcttactctatcaccccggctggagtgcagtggtgtaatcatagctcactgcaacctctaactcttgggctcaagtaactcctccatatcagcctcctgagtagctaggacaacaggcatgcaccactgcacctggctaacttttaaattttttgtacgttgcccaggctagtttcaaacttgtgacctcaagtgatcctcccgcctcggcctcctaaagtgctgggattacaggtgtgagccatggtgcccagcctaattagtgtcaatttttggatgtatttgatttacgttaggctgaatagggagttgttttcccaatccccaggacttaaaaccgggtggtaataataataagaatattagtttaacacgtatttagtgattatgtgtggggcattgctttatggactttacatatatattagctcctttattcccccaaataacaactgcccccattctacatttgaggaaaatgagacacagagaggttaaataatttgtctagtgtcatgtagacagtaagcatcagaaacaggattctcactcaaatagtctgactctgaactcttaactaccaggagaaagtggtaggaggtttcacagccgctggcacttcctcagttcaggacatgttttatgaatcacctcctgtcagttaccacctcttttcccaagggtataaggttatataaaaggatgaaagggtattgtttttcaatcctttctctggtcaggacagtcttccaagctggtcaaaccaattagatgtgtgcagcaattctttcaaaccagttccttttaggatttttataaatatctactacacataaacaattttttttcacaaaaaatttccttctgtgtacatattttgatacacatttacacattattttaatgctatatagtatgcaattattggttggggtgttccacaatgtacttaacacttcaactatgtatgtgtgtacacttatgtgtttatagaagaaatccatgttcttggcagaaaaatctgaaaatacagcttagcagaaaaaattccttcatttcatcatttaataaatatttactgagtgtctattttgtgtcatgcaaacttacgaatcatgctttcaaataccattaaaagcatgaagaaaatgcaaaagaaaaactgcaagatacaaaatatgcagaagatatgtggaaaaattagtaaaacacaaatcacacacatgacgagagagacagagggagaggaaaagattccagaagtaagtatatcaaacgtaggcagtagttattatttccaggtggtaggattagtatgatttttattttcttctgcttgcctttttttccccgtgtttttttataatgaacatatattacttgaatactcagaaagtttgtatttcaatattaagtatttctacatattatgttaagagcacatgcattaccagacatctgatttgctgctaaagtagaatatatgaaggtagtaacgcatggagtgtatgtggacatttttattgtttccattactcaataataagaagcattgtttaaagatgtgtgtgtatgtggcactacacaattatctatgctcatttggacagggacaaccaacatgaccctttacttcttgccaatagatctacctagcagagaaacaatgagatcaaagacacattttcaaggaaaaacaaaccctgaaaattcagatactttcttccgtctctttgtcaaggctaccctttaagatgtctcctttctttcctttttaactttttattatgtaaaatctcaaacatactaaaaaatatgtataactgagtattcaaaaatatatacaagaaaccccatgttcccatcacccaatttcaataattatcaacagtattaagaactttctttccaactgcttatcttgcaccagtaagaaatataaacttatgaacagaaaaaccatctttatagaaaacgattttaatcttaaatttaaaaaattgcttttaggccaggcgcagcggctcacacctgtaatcccagcactttgggaggccaaggcaggtggatcacgaggtcaggagatcaagaccatcctggctaatacggtgaaaccccgtctctactaaaaatacaaaaaattagctgggcgtggtagcaggtgcctgtagtcccagctactcaggagactgaggcaggagaaaggcgggaacccgggaggcagaggttgcagtgagccgagatcccgccactgcacgccagcctgggcaacagagcaagactccgtcccccgccccccaaaaaaattgcttttaaaagcctctgcatgtaaccttgaaacttcctccccaaagagcttctgaggcctgctgatgcagttactacctttcttatgcatttgcccttcttccataatagctacttgaatgcattattatacttagaaaatggaagaagcaaaataaagaaagcagcaagctgggaagtgtgaagccatcagacagaactgggggaaacagtgagcactcccccagggaaagtgtggccaggagggcagcctcagtatgagctgaggctgtggcctcatgatggggaggctactctcatttaatgagagatcacaggcaaggccagtggagtgccataaaactgccacctggttatacctacccaaactgttgtcactgctcgtgggccaggaagcaattctatccctcagcttctttgtacaggagttgtctgactttgcagaaagatctacttcctccttcctaatttctcgaacaagctgcatgcggcatcttgtgaaatcctgaaaggaaatcttcccattttcatctgctcccaactggttcatgatctcagccacagactcttccatattcagctggcgacagaccattagcaagtcatttctgcagaaggggttgaacagaagaaaatgtgttatgagtgacatttaagctagagaaactggttaatgaaaaaaaaaaggtatttcttaaatatattcacatactagacctattttcaactttctcattgtttctagaaaagtgataagtgtatgaaaaaaacgtgttccatttgggttattctaaacaaaaactctattatttggaatggtgaggcaacttttaatcttttgttctctttttcttcctgtttccacacccttctctccctttctttgttttgaaattgaggattataaagttctttctttacacctgaagagcatagcactgtaatctcactgtaagataaagtttcagaacatagaacagacattatttctactcttggcagagtccaaaacctagtcaagttataaaagaaccaacagagattttaacaagcttgattttcagctttctggaccaatcagctaactttagtacttgtttaaaacatcatttaatcttgactttcgtggttcaatgcttagctacctttggtttttcctgcttttgagtattttccaccttcccacaagcaatcagtgagccctaagactaagagcagggatcaaaatctcaatgtcttccaggactagatttaatgtaaatgtgtgcagtggatagatctaagataagagggcttggtggggtctgtggctggactagagaagtgtatccagcctatagagtctcaaatttaaaaaaagaaaaataaaaaagaatttcaaaaagaataacaagaacaataaccctatgctgaccaagaacatttatgtggaggacatcggtttgatccctgacatacaagtcttgttcttttctctctacctaacctcctttagcaaatattttgctcatattcctccaactgcaggtttcaacaaaggtcaaaggactgtagaatttaagtgctggaagagacattagaaatttgttcattgtcacaaacaaagctaattagtgtgcctgtctcaacatactaccaaagttcagttatctggagaatataaccagtttgatgtttgctgatacctgaaacctaatcatgctaagaccactcttcaagtcacccttcacaaattctatctcctggtcaatgtcactatggtctctctcaaattccctaggctcacaaaattgtgggcatttttaatatcttctcattcactcctccttatccctaattctgtgccctgcactcccctcccccacctctgcccttgtccccttccccaagtttccagggtctgagttatcatcaaatttaggttagtcttctccccgaaatgcttttatacttgctctttatggtgtttctaaataaatgtaaaagactccaagacctttcaatttatgccaggcctatgccaccagcctttttagctcatcaccctgcttccatatgctatcccattttcatgttttataaagaatttttacacatagctacatgttttatcttctgtgtacatgtgtgtctgtgtccatatgtatatcatatatatatatatatatatgcctctgcatctgtgtatacacacatacacatatacacatacacatatatttgtaaagtagatgcatgaggataggaataaatatatacatggaagtgggtatggcaggttaaattattaatattagtcctaatttttcattatcccacagtagtgttataaaagtatacccttgccttggtctcagggccaaggacattcatggtaggtgtgtcctttcccatcccttaacttcaggcttcacatctaacttgctttggcccctcggatattactggacaagtgcctatactgttgagcttgtccccttttgcttcagtcatcattaggagaaaaacataccatggtagccattatccctgtatctagcctgggtctcaaaacaagccaccccaatctatctgaagactcatagcttaagaaaagtcattccagctgaccccaaaatgtgtgatcaaaagtaagttcttattgttcatgcaaattaaagttcattcttaagctcagattttgtgatttttcttccatcagtagctaatcgataaactggaaaaatgtttgtttggtttttaaagtaatattttcatataatattttcatataagacctacctgatattcagccagattcatccaagagttagggatgattaggattgctaaagcaggaataccaacagaaagaaaggatcctgcttttactctgagttcagggttcagattatactttctaaaataaggatttcttttttagatatttagagaatagtcttaaatttaggcttagcaaaaaataaagaggttttccaaattctagaagttcatgtaatgttaacattaatattctctgattggtaaaaatatggtgtattcatttttcctgtctgtgtattttcacttttcacagtgtattatactactttcataaattgatatgtcattgtaggtttaaaatggggatagtagtagtacctacctcatagggctgctctgaaaagaaatgaaataatacatagaaagcacttaacatagttcctggcacatattaagtactcaataaacagtagccattattatggttgttttataattgttgatcatagatctttcataataccccagtttcatgattagggctttaaaaatgaattgtgatctgctcaggggaaaagaatactgaacggaactgactacctcactaagtggtacaatctgtccacagaggcccacccttcctccctgctggcagcccacttacatatattgggcaccctggtgagaaactcagctctatccaggcttgagaagccccattctacaagaaacagctgcaaagaagtaactgtggtctagaaataccaactcagagtagaatgtgtaacactgaattttaattttaaacgtgtaggctgttgagaggctgatataaaagatcaaagccaaaatacattcattgcactctaccaaattaagtcaaattgtaagttttaaatagaagtactagtttttaaaaactaaattcaagctaaattctttcagtatagaaatacaaaattaacaataataactaacaagcctgcaggggaattacaattatcccctgatatggtttggatgttcaccctctccaaattccatgttgaaatgtaatctacaatgttggaggtggggcctggtaggaagtgtttgggtcatgggggttaatccctcatgaatggttgagcaccatccccttggtgatgagtgagttctctccctgttagttcacacaagagctggttgtttaaagaggcctgacacctcctcccccaccttgctccctctcttgctatgtgacatgctggttcccctttgccttccgccatgattggaagtgtcctgaggccttcaccagaagcagatgccaacatcatacttcctatacagcttgcagaacagtgagccaaaataaaccttttttccttataaattacccagcctcaggtgtttctttacagccacgcaagaatagactaacatgtccccattttacagattatgatatgacagttgaaagagtcagagacagtatgaggcacagcctggaaatctaaaccaaatcggtctgattctagagctcttgccctttccatgctatcatctagcatctcggacattaataacaggtacattttggcatgagaaaacaattagggacagcactaacatgagcagcttgattatcaaaggtcatgaattaacaacgcttttatatcaaaccagaaaattacaatcatctatacatgtgttatccttctatgttacacatgaatgagaatataaagttacattttgttaccaacaagatgagaaaacaaagttacaggagaggaagaaaattataaaagctctcctttatatcaagagctaagtctggagaacttgaatcgcagggtatttccatacgccaccttgccaggttgttacaaatggccttcaatgacgtacagtcccctgtgactatgcctctttacagcatgcctttgccattcctcccatcaataggtggaggctatttccctgcccttgaatctgggctggccttgagactggctttgaccaacaaaatgtggcggaaataaaattctaggattctgaacacacaggcctaaagacaccttctagcttccaatttcaactcaatgccttccacttccatgcagtcctggcagcctgctcagccccatggtggtcttttccttctgataacatttagtacctgcaccagtcatttggtgattatttacagttttgtgacagcttttggactgtacttaactttgatttctttctctctttctctttttaaaaattgttttcacatattcaatccttatcttcccaatatgaccatgagctcctggcagccagtgttgatgctacgtcaattccctttgagatgtgtgcagcacccagcacaccaccacatgcacagcagaccccatcacatttgttttgatggaatgatacttaaactctcagaagttgaaaatgatctttcttttaaagagggtccccactttggatattttccaccatatacctgtctttgtattttcccacataatgcagcacatgggatgctcagtaagtatgaaggaccaatggcctccataaaacactaataaccctgtagccttagtgacagaacagcaggacatttctctgccctaggcaaggaaagtttttcagaggaagagatactaaattgagactgtccaaaactaagatagtccagcagagaactatatcagtagcaataacaacatcatgtaagtgttctgccttgaaaaaaaataaaacttttgtatattatttcagaaaacacatattcattgtagaaaatgtagacaagcagaaagaaaatacagcttacatgcaatccctttacctagcaataaccacagtgaatatctggtgaattacacaaaattgtactgaacattttttcctctaagtcgttattgttacaaatgctttaaaaggtgtttcatactcatattcatgcacatatatcttatcttcagatgatatcatcataacatgagaaagaaaaagacctcagtttgtatcagaggagctggccaagtcaggcaatatttagctcttagagaacaccaatcaccagacagcagaactaaaatgacttcagtcatttcaagattgatgcttctcactcaaaactgcatggtttcacaatgaacagctattattttctatatataaaagtcttctttttctcttggctattcttcctttaacttataaagaaattgagtatgaagtgaaaattcagtaaaactatttgtcattcaagtaaattcgcagcctaaccttggggatgtataatgggaaagatgggctttggtctctcaggctcaggggcagagaaaaacactattcttccccacaatgataataaatcccaaacccagttggaatgagggctatacagaggcaatttaagtagtaggttgcatgcttttgttcgaaattctcaactaacagagacccctggacctagtaggtagtccagaaatagttgctcatgaaagactacaaaaaacatctaaaaacttattttgccccaaatcttcaatttgagtcacacaaaaaatgtaatttagaagtctctaatttcagttctacaaatattgaaagtatgaaaattataattaggtcataaaaagtaacaggtttccgggctatagttggtaatttctgtgtacagctgttgaacggaataaatgcatttgcctttctttcatcattgcttcttacgaaataagtagagtgaagtacaaaacaataagcaaataagcaaacaaaaccatatttaagaaaaaaggagaagaagttattaaatataggaaatttcaacaaatttcagagagacacaaaagagatgggagcatgatgatggatgatacaggcgctagaaatccttgcctagaatatgcagcaggggagctgctgggtggtactaaaacgctgaaggttctgggtttatagccagccagtgtgatgaattgtgagaatgagaagtggggctgaaaacagtggctgtacttccttttcctagcatggaataaggagatattgtctaaagttggtaatcagggttgggcatagtggttcatgcctgtaatcccagcacttttaaaggccaaggcaggaggatcacttgaagccaggagttcgaaactagcccgggcaacaaagtgagacattgatcttcacacaaaaaattgaaaaaattagccaggcatggtggtgcacactgtagtctcagctacttggaaggctaaggcaggaaggtcacttgagtccaggagtttggaggctgcagcgagctatgattgtactactgcactccagcctgggtaacacagcgagaccttgtctctggggaaaaaaaaaaaagctggtcatcaggatacagaagtattagcatatttttccgtgttacggaagaaatgatcaggagaactagaagcacaaatggtaccaagactttgcctctggggactgggcatgggtgtggagagggaggtagggtaggagggttgtgttttgtcacaaactcttctgtacaattttattttgttgtttcccatatgcatgaatagtttttattaaagtaatgttttcaaattttaaaaaaccaaatagattattaatgtaatttgagatatgacaaagattgtatttagataaagaattccacaatgcaataaggaaaatataacaacccagtagaaaaatgggtaaggctaggcgtggtggcatgtgcctgtaatcccagctacttgggaggacgagaagggaggatgccttgaggccaggagttcaaggccatagtgagctacgattgcctatgaatagcaactgcactccagcctgggcaacaaagtgagaccccgtctttaaaaataaagaaaaagtaagaaaaatgggcaaatgacgtgaacagtcaacagaaaagaaaaccccaatggccaatgaagatataaaaagattcctaacctcactaagtataaggaaaacgtaattttagaaactggatgccattttagtatctaatggattgccaaaaacattagtcttacaataccaagtgctgacaaggaaacagaaactttcacatggtattggtggaagaaaagctggtaccacctcttgagaggactttggcaacatctaaaaaaaaaaaaatagactcaagcatacccttcaaccagaaattcaacttttagttacatgtgctcaagaaatttatgcataaatggaggagacatgaacaatatctgtaacagcaaagaattgagaagaggttaacaataatattaatagtcatatttataataatagctaatacacactggatgtttattgtatgccagggcttgagctactcctttatatatattaattaatttaatgctcagaaccactccatgaggttggtaccattattatctccatatataagtgaggaaattgaggaacagagatgttaaataactagtccagatgcctatcaacagaaaatacgtatatatacaaattgatgtggcatcacataatgaaatacaatagaatgtaggtttgaaagaaatgcatctacaatgtatcatcataaaaaatctcaaaaacagtagtgagtaaagacatcaagttgaagaatgacataaacaatatgacagtattaatcaaaggtttaaaaatatacaaacaatgctataaactgtgtatagatttacacataggcaagtaataaaaacaaggtcaagaagcataaatctcaactgtaaagaggtgagagagggagaagaacaggattagggaaaggcacaaagggggcttgacatgcatttgtaatgttgtttttaagagctgtggacaaatataataacttctctgcaatctgggtatggtacatatgtgttaattacatactctgtaactttcaatatttaaaatgtctcttaatttaaaaatctaacatatatataaagccgattcaaaataagtttggtctgaggctatagttggaggggaaaatgtttaaaataatgtcattcatatcaataagtgtttacaggagatgacccttggagttaatcaaattagatgaatgatccaaaatgtcattttggaacttttgttcatccttacagactagagagcatctggttattttcctggtatgactttttaggagtggaattactcattgttaaaaggttcaatctctcaatatagttttctcaacatccttcgagaaacatcagatttatagtcccactagcagtgtctgagctgctcacgctttggctatgtttctagagacagtagtctaattccctacatagagagtattccctatgtcctcattttcttttctgcaaaggcattcataacatataatcccagagacacatttctttctttctcttcagtgcttaatgccgactgctaccttcttgaaactcttccttcagtctgttaaactctgtcttctggtttctcccatctctgtatgaaaggtccatatcagaattcttgtccttaaatacatgctatcttagagtcatatccttggccccctgttttttcactctaaaactctctacagataatctaatctaaatctgtggctttcatctaccactatgtatggctgactaccaaatttctatcttcaattaagtagcaatccattttctactgggtagatacaattgactgtcatatatttatcttgaactcaaagtcctgtgcttaattcatcatctcgtaccctttcccaaattttctccttcaacctacataaattataccatccagtcacccatgctggaaatctagaagttatctaggatgtttctttcttggttatccccatactcaattaccaaggactggagcttttattgtctaaatagctctcacatccattccgtcctgatcatccctacctctcaacattttccacctggtttactgcattggtctcctaattggtctcactctttccaacaggcagccaacaaattctgttactctttcctgcttaaaatcctttatttgctccccacaagacttttagcttcatacccaagtttctcacttcatagccaaggcccatcagagcatagctgggcctacctctctagtctcatcttcttgctgaagtaggtagccttcattccagccaccaaatttcttttagcttctataaacggtcactgttattttacatgctcctgctttgcacatgtttgtccctctgctcagaacatccttttctttccctttcttcaaactccagcgcatgtttcataagtcacttgaacagcgtctccttcagaaatcttctgtatctcacataactcccagtctaatttgatagctcttcagtatcttatcaaagtaattgctcaagcttcgatcacttaccccactctatagtaatgactgatttattttatctcacttctagtaaaccagaggttggcaagtaagacctgcagccaaatctagatcatttcctgtttctgtaaatctagtttattggaacagagcatgcccatttatctatgtaatgtctatgactacttttttgctataatagcagagttgaatcattgtgacagagaccatatggcccacaaaaccaaaaatatatactatatgaccctttacagaaaaagtttgcaaatctgtactaggctgtaaattcctagaggacaaagttcattccttgttcattatctttgagtctgtaacacctggtatacagtaagtgctaaataaatgcataacaaataaatgaatacgtgggtaaatataatgttagacttgaggtaaaagaggtgaaaagagaacctaaaacatgaaaactttaatgccatttctcctgtactttttgcacacttcattttgcaatcacaaattaaaacaaaacaagttgatatcattaggtttttaaatatcttctagtatatatgtatgaaaggaaaataaaaacttgggaccctaaattcactatgccaaaagaaaaaaaaattaagctgaaagctgagtcatgcaagaagctgcctttccttttgttccaaagaagatagctacagataaaaagttaaatatctccacaggtagctactctatgttcaccttatcttatttaaagtgccaatttactgagcaccaggcgtatatgtaattgactattcccctacctgctccttttctcttgcaatatatgaattcagtaaggtgaccataccctccctctttccccccaggctgctgtttccctttaaatactgaaggcttcaaaatccatgcacgcttaaccttggcaaaataaacttctaaattgattgagacctgtctcagatactttttggtttatatatgctgagctccataccattcaagtcagtaatctaaactttctatataaatagatattaattatgatgctcaactcttcataattgcctggggtgattaattaaaatattttgatgcttatgctccatggcccatgcaactacatcagaatggtgggggtgggggactgggaaatgggagaggggaaggcagcatcagtatttgttaaaaggcttcctaagtagttcagagaacttctgtcctatatcaacagtcctaaggaatgagggttttcaggacactcaggagtcttagtgatcaaaaacaaacaaggctgggtgcagtggctcatgcctgttattccagcattttgggaggccgaggcaggaggattgcttgagctcaggagtttgagaccagcctgggcaacatggcaagaccccatctccacaaaaaatacaaacattagctgggtatggtggcatatgcctgtagtcccggctacttgggaggctgaggtgagaggatcatttgagcccaggaggtggaagctgcagtgagccctcattgtgccattgcactccaacctgggcgaaagaatgagactgtctcaaaaaccaacaaacaaaaaaaccgagccatgcacagtggctcatgcctataatcacagcagtttgggagcccaaggcgggcagatcatttgaggccaaaattcaagaccagcctggccaacacggtgaaaccccatctctactaacaatacaaaaaaaaaaaatagccagatgtggtggcacacacctgcaaccccagctactcaggaggctgaggcagtggattgcttgaacctaagatgcagaggctgcagtgagttgagatcgcgcctctgcactccagcctgggtgacaaaccatattgtggtcatttaggtacttgcaagataaaataaaatagattattttgaaaaaaatcctctatagaagtaggaaaacaaaaggattcctctggaatttaagctccccaaggatggagaattttgtctattttcttcactgttgtattcccaataccaagaatgatacctggcatataataggtacttggtaaataaataataaatgaatagcaatttcttcttttgcttttgatcaaccagaagcccatgattccaaatattccacttaactgaaattttacaaaagaagaaggcaacctggcagatacagtattcagtgaatcaacagataactttctttaggggcataaaaattatattctacaattgaaaatggagttttaatgttaaaaagggaaaccagagagacactgctatggataaatgcacctcagcccctttttaaaattcagcttttaatttaaaaaaggtcagctgtagtctggaaacacatgtgataataacatgaagagttatgaaggaaagggaaaatcaattccaacattacctaaacaaacaaacaaaatgccatatgacatgcatctgaaggaattaactgaattcatcttggctcctcccactgtcttaaagcactcaccaagtctgccaaagtaattaacatcctacactggcatgacgttgagcccatgcattcgttctctctcttactctgtcactctgcatttctaataaaacattctgctagaaatgatgaaactattggtctaattctcatatctgaaaaaacgcttttggttgtggttaccaacttgaaaaaaatacagaaaaataggaaagacaaaacaaaaatcaagattgaaagaaagaataaacattttaagtcacctaatttatattataaagattatttttgaaatgtcaagcctaatggaatattgaaatataagctttttcaatggggaaaagactccctggtcaataaatgatgctgagataagtggctagctataagtagaagaatgaaactgtccccttacttatcaccatatacaaaaattaactcaagatggattgaagccttaagtagaagacccacagctataaaaatcctagtagaaaacctaggaaatactcttctgaacattggccttggaaaagaatacatgactaagtcctcaaaagcaattgcaacaaaaataaaaattgacaagtgggacctaattaaacaaaagagctgctgcacagcaaaagaaactatcaactgagtaaacagacagcctacagaatgggagaaaatattcacaaactatgcatccaacaatggtgtaatatccacaatctataaggagcttaaatcagtgagcaaaaaacaaataacttcattaaataatgggcaaaggacatgaacagacacttctcaaaagaagacacgcaagtggccaacaaacatgaaaaaatgctcaacatcactaatcatcagagaaatgcaaatcaaaaccacagtgaggtaccatctcacactagtcagaatggttattgttaaaacgtcaaaaaataacatttgtcagtgaggctgtggagaaaggggaatgcttgtgcactgttggtgggaatgtaaattagttcagccactgtggaaagcagtttggagatttctcaaagaactaaacatggaactattcgacccagcaatcctattactgggtatatacccaaaggaatataaatcattctaccaaaaagacacgtgcacttgtatgctaatcacagcactattcacaatagcaaagacatggaatcaacctaggtactcatcagtgatggattggataaagaaaatgcacatatataccatggaataccatgcagccataaaacagaatgaaatcatgtcctttgcagcaacatgaatgtagccagaggccattaacccaagtgaattaacacaagaacagaaaaccaaataccacatgttctcacttataagtaggagctaaacaatgggtacacatgcacataaagatggcaacgatagacacttgggagctactacatgggagagggaggaaggagatcaaaggttgaaaaattattgggtactatgttcactatctgggtcatgggttcaattgtatcccaaaactcagcatcacgcaatatacccatgtaagcttttttgtaaaactaggatttccaataagcaactttctcaatattctttattttgaaacctatttcaatttattttgaagtctattttaaccctgggaattagtatttgtagtcttgaactgtactgttcaatatggcagccactagtcacaggtggctgtttaagtttacatttaaattaattaaaatgaaatataattaaaaattcagttcctcagttgtactagatcaacagccacatttcagatgctcaggagccacactggacagcacaagtatagaatatgttttgttcatcacagaaagttctaacactggaaaaaataaaatagtctacaatatcttcaaatagcttcaggcaatagtatcagttaaggaaggagattatttaaaatgtcagttattggccaggtgcggtggctcacgcctgtaatcccagcactttgggaggccgaggcaggcggatcacgagatcaggagattgagaccatcctggctaacaaggtgaaaccctgtctctactaaaaatacaaaaaattagccgggcgtggtggcaggcacctgtagtcccagctacttgggaggctgaggcagaagaatggagtgaacccgggaggtggagcttgcagtgagcagagattgtgccactgcactccagcctggccgacagagcaagactctgtctcaaaaaaataaataaataaataaaagtcagttattattaaggttatttactaagttattattctaagtaaataaggaaaatagaagcttttttcccctcagaacataaaaacactattataaatttgttagtattttgcagctgattttctaattttggattcatttctacttatggaacatataaaaactactcactttttgattaaggaaatcagattcaaattcatgtccaaatcaccatccccttatgaaaacattttggttgaaagatttataggacttctggggcaagcagaagggtaaggatgtttcctagagaaagcaccagctttgccttcttagatttgagttactgcaatactaattccttctgatgtttggcctgaactttctaagaggtcacagaaataatgaatagctaagatcattcactggcatgatagtttcccctttccaggtgaaacgtcaagaatgactaaaagccaacattcaagaagacagcatctgcaaacaagtgaagtattatgtttacatgtttttttaacagctttttattctatagttcttttacatgtgactgtttcctaatattcttactctttattgttttggccctctccttttttactttttttttttttttttttttttttttgagatggagtcttactgtgtcgcccaggctggagtgcagtggtgcgatcttggctcactgaaaccttcccctcccgggttcaagtgattctcccgcctcagcctcccgagtagctggaattgcaggcgcccgccactatgcccagctaatttttgtacttttagtagagacagggtttcaccataatggccaggctggtctcaaacttctgacctcaggtcatctgccttcctcggcctcccaaagtgctgggattacaagcgtgagtcaccgcgcatggcctgttttggctctctcttaatttgatgtttcctattgacactgtagtgaaagaaaatactttaatgtatttcccccttggattatttctttaaatcagtaaattaacatttggtattaagcaagactcagcctatcttcacaatgatttgtaaaaacttctcaaaagcagtctctgccattcttggggaaaaatactcattcagaggctatacaaagtattttagatatattttttcatttaattctcacaatagcagatcttattttcattttacagggtctatcagtgccttgtaaaaggaaatctgtcccaaattcctggcaccatacttggtacacagcaggtacttaaacagcttggtggatgaatgaatgaacaaagagcacctttttgttaatctcagtgacagatgtagaatcttacagtgagcactcagtaaatcctcactaattgaatattctagcaataatggtcagtatgacaaatgagtaagtagctcttaatatatcagtgtccttccaaaaatcccactaaagctaagcaatggaccccagatccaaacattatgtaaggcagtcatgtctgaaagatatagaaagagggaatacttggaagagacctaatacataggttttggggcaataaaattatttgggaaatgaaccactttttaaaaatttatttctaagtgtattttaataatacttccagaatagttattccttcagatcatttcaggtcacactttttatgggaaaattacacacttaacaccattattataaaaagacaattgcacccaatttctttcaccagggtaaaaagatgtatattacaacatgtatttaatatataaaagattcacagtgtactgtgaatgataaacttacaattatgtttattttttccattgtaaaaaaggagtaaaggtagaagataaagcaaaatttttcactaagtgctactcaatagaataaccaagtctaagcaatgttttaggctaggatccaaaggtgtacttgacccctggctctttaaattgaagtggcccatccacagagcctgctaccagccttctcaatcctctgtcccttggtcccattgtctttctcatttagcagccttctcagtatttcttgcttcccacatcatttgaacctgtatgtctgacctccgaacctccagactctgctcacacagttagggactgttgcattcatactgagaatagatgttcccaatgtttattttggctccttgggtcttaccttggcctggacagaaacctaaacctttccctgaggctgagactgtgacatgtgcaaatttccccaggttttcttatttatatatatatatatatattctcctctagaagttaaaaactttatttttgtatttttaaaattttacatatttttaaaattattattactatttttttgagacagggtcttcctctgtcacccaggttggaatgcagtggtgtgatcatagttcactgtaacctcaaactcctgggctcaagcgatcctcctgcctcagcctcccaagtaggtaggactatgggggcacaaaaacacactcagggccgggcgcggtggctcacgcctgtaatcccagcactttgggaggccgaggcgggtggatcacgaggtccggagatcaagaccaccctggctaacacggtggaatcccgtctctactaaaaatacaaaaaattagcccgacgtagtggcaggcgcctgtagtcccagctactccggaggctgaggcaggagaatggcgtgaacccgggaggcggagcttgcagtgagctgagattgcgccactgcactccagcctgggcaacagagccagactccgtctcaaaaaaaaaaaaaaaaaacacactcagctaatttttttaattctgtgtaaagatggggtcttgctatgatggccaggctggtcttgaactcctggcctcaagtgatcctctcagcctcccaaagaggtgggaatacaggtgtgagccactgcacctggcctaccaaaaaatttttaaaacactcagcacatggaggattttttttaatttcaaagtgaccacaataaagttctcctaaatatcttccaaactactttagttttagaaaatggcattaacgcaaaaataatatgggtgaaatgctactttacacttttttaagggttaaaaaatgcaaattgttttcatgtataatattctgtcttattctactcactctctcagattataatcaaaatattatagcacaagaagcaaatgagggcttgtagtctgattacagaaaggagaaggaggagatttaatgcagcataggcagcagcctcaggcaagaaatgttgtcattgtgtctcacatcctcaagtattacatgaagatatcgtccaggctggagggcagtggtgcgatcatagttcactgcagccttgaactccagggttcaagtgatccttctgcctcagccttcacacccagataatttgtttaaaaatttattgtagagacaggtcaatttttaatattagattcaatgctgccaaattgctataaaagatttgaacacttttatgctttcagtgttcaaagactttcatagcaatttggcagcatcttgtacttaccttgctgcagattggcaagaaaagactagtctgtggcccactctgagtagcactgttctagatgtcatgaatatggctaaaactatcccttaccttatagattagagaccagtgtgggaaggaatggcacagaacagcaacaatgccagtattagccatggtagcttgccatcattgtttactttgacgtaccattctaaggaaagtaagtgcacactgtaagaacatttaagtctatttcagtattcgtaaacactgtactggggaaacaactcatagtaatgccatcaacgttttatatttaaaatatacctaagttaaagttaaatcccagaaataaaaaatccttcaactaaccacgatcacatatttaaatgagtactgtgaactaggtgttctacgtaattaaacaaaaggggctcttcatgtttcagaaatttgtagtacaaatcatatcacagattataaagcattcatcacaaggaaggagcttcttctggtttggcctggatctgtagtgttacaatagtggctgagagagaggtggtaaagttccagccggagtaataacaagctgtttggacaagaaggagagaagaggaaggtgggaaatgaaggaggaaaggaagcagcagagggagcgagctgtaagcccccagcgggattgccatcagggagccagacccaggggtgagaatgtgaggtccagttagtggagcggctcaatggtaaagtgatagctacatgacaccaccaacactttggttttaaaaatgtcaaaacttcagtttgtttctttttttctttttttgagacagagtttcactgttgtcacccaggctggagtgcactggtgtgatctcagcatactgcaacctccgcctcccgggttcaagcgattctcctgcctcagcctcctgagtagctgggattacaggcacgggtcatcatgcccagctaatttttgtatttttagtagagatggcatttcaccacattggccaggctagtcttgaactcctgacctcaggtgatctgcccgcctcagactcccaaagtgctgggattacaattgtgagccaccacacccggcccagtttgtttctttatttgagggtgagaagatcccctcctataattttgaagtcaaggaaacctctctaatgtttctttgcactgccaaaattcacagctctgaaacatcaacacttcccttatttccctcatctatgaggaaacacatagagaaataagtctgttttcttaaaagcaatgccctcaaatggctgtaaaagaatacagtggccaggattgtgggaaaatgagtcctggtcacagacagaaagtcaccaatgtaacactgtggccaagttcagaaaaaacgcccaccagtgacaaaggccagatctaggatataaaagcaaaggtcactctcacagcctgctgcaacattcactgcagtttggcagtctttgtcaaaatcaaaattgtacttgcttttcttttggttcagcgattccatttctagaaatgtatcctagggatatgttgatgactgaacagagttattcaatgcagcactatttatattagcagaagactggaaatcatctaaatatccactgatggaggcctggtaaataaattatgctccatctatacaatgccatgaatactaaacagtcttccaaaataacaaagcagctctgtataatggtggcacaacatccaaaatcaatcaagttaaaaaaaaaggcaggtgcagatcagtgcgtgtcatacaatgatacatacaaaagtagtagtaaaatatgtatctgcaggacttgatgtgcacagactacatctggaaggagacctacggagctgttaccagtgactgactgtaaaaagaggaccatgtctggaggacagagatgggacagaagcctactctgccactaacctttttgaacacatttgaatttttattcatatgtatgtttaaggcattttttaaaaagctacataccagctctatagtggcagtcagcatcctgatatctaaaaagcaatgttagagaaaaataagccaaggaacttagctttggcatccagtgccctgccaagaagaaaaccaaatgcctccttacagtagatcagcttacaggttattccagttattatcctgtcaagatattttagtagcttgcaatttacacttggccttgacagtagttcccttcagttgtccaaagtgtatcagttaatcttctgcaggtgacttatgtaataagagcatcagtatataagatatttaagcaggatttaattacctggtagttggagagaatttgaattcttttcactctccaaattttgtaaagataaaaaaggtattaaaatctgccaggcaaggtggtttggtaggaaaaaacagatgaaatatgctgtgggccaggtgtggtggcttatgcctgtaatcccagcactttgggaggcagaggcaggaggatttcttgatgccaggagttcaagactagcctgggcaacatagggagacatccgccccccaaccccgatctctacaattttctttttaaaaattagccaggcgtggtggcatgtgcctgtagtcctagctacttagaaagctaaggtgggaagatcctttgagctcaggaatgcgagcctgcagtgagccatgatggcaccactccactccagcctaggtgatgagcgagaccctatctcaaaaaaaaaagaaaaaagaaaaaaaagttgtagttttgtaccgtaaaaatacttattaatattatttcaagtatttagcatatgtttacatgactacattttccttttgagcatcactctaagattttcaatgcaaagcattattttcctcctgatgatcagaaaatcaaaatgctctctctactccatcccccttctaaataattatgtctcaaaagcggcacaattcaagggctaattacttccaaccaatatataaattaaaagttcacaggttcatcttagaaataacaaccgagaaagaacattcaaacttgttaaaagccttacttcttgcctgcactattgaatgtgcaatttgttcatcctgagaaattatgatgaagttaaacacaaacagcactaagttaattacaaacaaatcttcttctctgtaatttacattctagaatccagctttacaccattttatttccttccagctgaaggaaagacattgctagcttaagattgtcttggatgagatctctgattttaataaaaaattaaggcagtcacaaattcacttatgccatcgaataataattctagtcccattggagagttatctaaaatgacccaaatcagccacatttctgttggcatataattaactcctgcccgtataaacgtaacgcagattctcctccaggtgaaactgtcctggtcctctgccctctccactgaaccagcaataaaaagagttctctataatcctatttgtagtctacatctatactcactagtgaaagtataattaaaccatcttttttttcaaatcgatctaaatatagctggctattcattcagaataatatttgaaaaacacttttcacttatagaaaagcaaatgaggaacaaactaagaagtaaaagataatgtttacatttgagactttaaagttacacgcaccttacaaagagaatttagagtcactgatatcctaccagcaggttcaaccagaagtcctgcatgcagagaacctcagtgaggtttgcgtggatctccaagaagagatttcaaaggtgggagcaagtgccatccttaggcctgccttaaaggttctacaccccttgagcctggcccatctggctcaatatcaattgtagcagaatagataagtaaataactatttatatacttagtgagaacagatgcagcccctaaatataaatttggaaatcctgggcaacataagaagtgcttataataaactgcttaagataaaaaggcagaaaaaaaattgttatctacagtgcttataactctagagtaagttaaaataattattatttattggacacatactttgtgctcagcaattgacataatcctcttaataaacatgcaaagaggttaagtaacttgccagctataaagcagttgagctgagactgagttcaaaatctagctgatctcaaaggaccgacaggaaatgttaaaaaatgaaaacactttaaggagaaactgggtggtaagtgtattatggcattaggcagagtggaaagcattctttatgctcagatagggtgaaatcctacctttgctattttctagatgtatgactgaacctctctcagtctctacaactgcatctgcaaaaactgcaaaaactgggaccatttcctattcaggataatatctgagcaagtggtgagccagtgtctcccctacagcaggctccacagtactgctcctgtactcactccaccaagcatcacctggttaaataattttagacttgcaagttatctctgcattcatttggttaaactccctcatttttaaaaatttttattttgctttgagtcctggaatacatgtgcagaatgtgcaggtttgttacataggtatacgtgtgccatgggggtttgctgcacctatcaacctgtcacctatattttaagccccgcatacattagctatttgtcctgatgctctcccttccctcgcacctctcccatcccaggagcccctgtgtgtgttgttcccctctctgtgtccacgtgtttgcattgttcaactcccacttacgtaaactccctcatttttaagagtaggaatcttgaaatgaaaacttagcccagacactgagttactggctagttagtgccaaaactaggactagaatttaggtctcctaacttctttccacctcattaagaggcctagttagaagaagggaacagaggaaaagcaaagggagatacattaacacaatctcctgatataaccccagcaaacaacctcaaatcatctgaaaggtagatatctttcatacaacctggacagataaggttcctcatctcacttcaaacactttaattagttggtttctcaaagtacaagttgtaccccttaggtctaagatagaggaaggcaaacttctggagcaacaaaaataaacttaacatatatagttttgccctgtgtctcagttttcctgaattctatctctggcatacacatgacactaatttccatgtttgttctattttcaaaagaaaaaagagggaagggaaagatgttctgggatcaaatacgagatctttttcttggagatacaacatgtactgtattatattaaacactacaaactttaaaggaaacttgttaaattcttttcagcccaatctttacctgacaatgaattatcctcactggcctgttgagtgtgaaacaaatgctccacagaatatacctagcgctgaggttcttaaaatgtagtcgtgagaccagcagcatcagcatgacctgggaactggttagaaatatgagctctcaggtccaaacccagacctactgaatgagactcctgaagtgtttcccaagttctccagggtttcgattagagctaaaggttgataaccacaaatgtagacaaatcatcaaggtggttttatcatgaatattggttgttttgggggttctcctaggggtagtgctttcaaactgctccttaggactgagtagagcaagggagcaggagatggatgaacatgtaccaggcttcagggcagatggcctagcctgtccctaccatgtttgtctgtttcatatataaggctacagactaagtaaggctttatttgaatgaagttttcacagcttaaacaaaagtttgaaactcactgtttagagattttaagcagcttaggacgtggatcaattttagtgcctgctaaagagtaataaatgccaatttatcagtcagaggatcctttggtgcctttaggctggaatagaaggaccaggggccctgaagcaacacagagatcgagattcccactgcattaccctatatttgtctttctcctctgcacttaaaaatgtaaaatgcatattagcacttgtctggaatgtggctaactataaaagacatttcgggaaatgtactctgattttcatttccagaccttcttaacataaattgaagtcttatcacaaaagccccattctcataaacaacaaaaacgcaacatccacagattctattaataacactgttaaatactttttttttttagacagggtcttgctctgttgtccagcctggagtgcagtggtgtgatcacggctcactgcagccttgatctccttggatcaagaaatcctcctgccttagcctcccaattagctggaaccacacgtgtgcaccaacacacctggctaatttttaaatttcttgtaaagatggggtctcactatgtagcccaggctgctcttgaactcctgagctcaagcaaacctcctgccttggcctcccaaagtggtgggattacaggcatgagccagtgtgcctgccttaaatatttgaatgttacacataaaccattaggataattcttaccaattaagatttagtaattttaaagaaaaataagaatcatgtactctctcattcccaccccactccaatactaagggcaatttatgcatcagatagtgaggacaaggatatttagtctctgtcccttcctagactcgagactacggtctcacattttgtggtcaaaaataaaacatatgctcactataaaattttattttaataaggaaaataggaaaagcaaagaaaaattatttataatcatattttccattaaaaacttgtatattcttaaagacactgttccagggaaatatctatatattgatagatacagaaatatagttctacacttatgtgtgtggatctgtctatgtaacggaatttatttctcaaatgacatacctatgtctctgtctccgtataacttcccccaacgggatcttgctgaacatactgttttataactagtgtactccatgtagcaaaaaatcataaaaacctttccgtgttaagaaatatggttctgcgtatggatatgctatacctatacaagggataccttgtggatatccattatggatttttatatccatttaacatcatattatgttgtatctatacaatggatacaatggatatccacaaggtatccactatatagatataacataatatgattttaaaatttatttaattggtaacttccatcatgtatttcttataaaagtgctgtgataaacattgttgaacacttgtctgatcaattcggtaggttaaattcttagagttcacgagtcaaaaaaattattcttggctgggcgtggtgggtcatgtctgtgattccagggctttggaaggctgaggtttaaatatctgacactgcgggatagtaaaatgaattgtgctacatctgcataatgaattattatgcaactcttatttttaaattatactttaagttatgaggtacatgtgcacaacgtgcaggttacataggtatacatgtgccatgtcggattgctgcacccattgagacgtcatttacattaggtgtttctcccagtgctatccctcccccaacgctccaccctacaacaggccctggtgtgcgatgttccctgccctgtgtccatgtgttctcgttgttcaattcccacctatgagtgagaacacatggtgtttggttttctgtccgtgtgatagtttgctcagaatgatggtttccagcttcatccatgtccctgcataggacatgaactcatccttttttatggctgcatagtattccatggtgtatatgtgccacattttcttaatccagtctatcattgatggacatataggttggttccaagtctttgctattgtgaatagtgccacaataaacatacatgtgcatgtgtcttcatagcagcatgatttatcatcctttcggtatataaccagtaatgggattgctgggtcaaatggtatttctagctctagatccttgaggaattgccacactgtcttccacaatggttgaactattttacactcccaccaacagagtaaaaatgtttcaatttctccatatcctctccagcatctgttgtttcctgcctttttaatgattgccattctaactggtgtgagatggtatctcactgtggttttgatttgcatttctctgatgaccagtgatgatgagcattttttcatgtgtctgttggctgcatacatgtcttcttttgagaagtgtctgttcatatcctttgcccacttgttgatggggttatctgcttttttcttgtaaatttgtgtaagttctttgtagattctggatattagacatttgtcagataaggtaaaaagcatgcattctctctaagtttcaggagcgattttttttttcaggagtaattcttaactccaaccacctacaatgtcacccacaatctataatcagagatttttacactttaattaaaagattcataaaaacagctaacctttaaaaagaaaaaagcaaaataaaaaaaaattttctcccattctgtaggttgcctgttcactctgatggtagtttcttttgctgtgcagaagctctttagtttaattagatcccatttgtctattttggcttttgttgccattgctttcggtgttttagtcatgaagtccttgcctatgcctatgtcctgaatggtattccctgggttttcttctagggtttttatagtttttggtctaacatttaagtctttaatccatcttgaattaatttttgtaaaaggtgtaaggaagggatccagtttcagctttctacatatggctagccagttttcccagcaccattcattaaatacaaaatcctttccccatttcttgtttttgtcaggtttatcaaagatcagatagttgtagatgtgtggtgttatttctgaggcctctggtctgttccattgatctatatctctgttttggtagcagtaccatgctattttggttactgtagccttatagtatagtttgaagtcaggtagcgtgatgcctctagctttgttctttttgcttaggattgtcctgacaatgcaggctcttttttggttccatatgaactttaaagtagttttttccagttctgtgaagaaagtcattggtagcttgatggggatggcattgaatctataaattaccttgggcagtatggtcattttcacaatattgattcttcctatccatgagcatggaatgtttttccatttgtttgtgtcctcctttatttcgttgagcatggtttgtagttctccttgaagaggtccttcacatcccttgtaagttggattcctaggtattttattccctttgtagcaattgtgaatgggagttcactcataatttggctctctgtttgtctgttattggtgtataggaatgcttgtgatttttgcacactgattttgtatactgagacgttgctgaagttgcttatcagctaaaggagattttgggctgagatgatggggttttctaaatatgcaatcatgtcatctgtaaacagggacaatttgacttcctcttttcctaattgaataccatttatttctttctcttgcctgactgccctggccagaatttcaaacactatgttgaataggagtggtgagagaggacaacacagtgttgtgccagttttcaaagggaatgcttccaggtttgtccattcagtatgatattggctgtgggtttgtcataaatagctcttattattttgagatacgtcccatcaatacctagcttattgagagtttttagcatgaagagttgttgaattttgtcaaaggccttttctgcatctattgagataagcatgtggtttttgtcgttggttctgttcatgtgatggattacgttgattgatttgcgtacgttgaaccagccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctctgccagcctttgatatcagaatgatgctgtcctcataaaatgagttaggcaggattccctctttttctattgattggaatagtttcagaaggaatggtaccagctcctctttgtacctctggtagaatttggctgtgaatccatctggtcctggactttttttggttggtaggctattgattattgcctcaatttcagagcctgttattggtctcttcagagattcaacttcttcctggtttagtcttgggaaggtgtatgtgtccaggaatttatctatttgttctagcttttctagtttatttgcatagaggtgtttatagtattctctgatggtagtttgtatttctgtgggatcggtagtgatatcccctttatcattttttattgcatctatttgaatcttctctcttttcttctttattagtcttgctagcagcctatcaattttgttgatcttttcaaaaaaccagctcttggattcactgatttttgaagggtttttttgtgtctctatctccttcagttctgctctgatcttagttatttcttggcttctgctagcttttgaatttgtttgttcttacttctctagttcttttaattgtgatggtagggtgtcaattttagatctttcctgctttctcttgtaggcatttagtgctataaatttccctctacacactgctttaaatgtgtcccagagattcttgtatgttgtgtctttgttctcattggtttcaaagaacatctttatttctgccttcattttgttatttacctagtagtcattcaggagcaggttgttcagtttccatgtagttgtgcggttttgagtgtgtttcttaatcctgagttctaatttgattgcactgtggtctgagagacagtttgttgtgatttctgttcttttacatttacatatgctttacttccaactatgtggtcaattttggaataagtgcgatttggtgctgagaaggatgtatattctgttgattcggggtggagagttctgtagatgtctattaggtccacttggtgcagagctgagttcaagtcctgaatatccttgttaaccttctgtctcattgatctgtctaacattgacagtggggtgtcaaagtctcccattattattgtgtgagagtctaagtctctttgtaggtctctaaggacttgctttatgaatctgggtgttcctgtattgagtgcatatatatttaggacagttagctcttcttgttgaattgatccctttaccattatgtaatggcctttgtctcttttaatctttgttggtttaaagtccgttttatcagagactagaattgcaacccctgctttttttttgcttccatttgcttggtagatcttcctccatccctttattttgagcctatgtgtgtctccgcacatgagatgggtctcctgaatataggacactgatgggtcttgactctttatccaatttgccagtctgtgtcttttaattggggcattttagcccacttacatttaaggttaatattgttatgtgtgaatgtgatcctcacattatgatgtcagttgcttattttgcccgttagttgatgcagtttcttcctagcatagttggtctttacagtttgtcatgtttttgcagtggctggtaccagttgttcctttctttctttagtgcttccttcaggagctcttgtaaggcaggcctggtggtgacaaaatctatcagcatttgcttgtctgtaaaggattttatttctccttcacttatgaagcttagtttggctggatataaaattctgggttgaaaattcttttctttaagaatgttgaatattggcccccactctcttctggcttgtagagtttctgccgagagatctgctgttagtctgatgggcttccctttgtgggtaacccgacccttctctctggctgcccttaacattttttccttcatttcaactttggtgaatctgacaattatgtgtcttggggttgcttttctcgaggagtatctttgtggtgttctctgtatttcctgaatttgaatgttggcctgccttgctaggttggggaagctctcctggataatatcctgaagaatgttttccaacttggttccattctcctcgtcactttcaggtacaccaatcaaatgtagatttggtcttttcacatagtcccgtatttcttggaggctttgttcgtttctttttatgcttttttctctaaccttctcttcttgctttatttcattaatttgatcttcaatcactgataccctttcttccacttgatcgaattggctattaaatcttgtgcatgcgtcacgtagttctcgtgccatggttttcagctccatcaggtcatttaaggtctcctctacactgtttattctatttagccattggtctaatcttttttcaaggcttttagcttccttgtgatgggttcgaacatcctcctttagcttggagaagtttgttattaccgaccttctgaagcctacttctgtcagcttgtcaaagtcattctccgtccagctttgttccattgctggcgaggagctgtgatcctttggaggagaaaaggcgctctggtttttagaattttcaccttttctgctctggtttctccccatctttgtggttttatctacctttggtctttgatgttggtgacctacagatggggttttggtgaggctgtcctttttgttgatgttgatgctattccctgttgtttgttagtttccttctaacagtcaggtccctaagctgcaggtctgttggtgtttgctggaggtctactccagaccctgtttgcctggatatcaccagcagaggctcagttggaaatgcagaaatcacccgtcttctgcattgatcacgctgggaggtgcagaccagagctgttcctattcggccatcttggaatggacctatgcaactcttaaaaagaataaggtcccgacttttctgtatgcttaaaaatgttcatttaaacaatgttggagagctgggtgtgctggcacacacctgtagtctcatctactcaggagactgaaacaggaggattgcttgagcacaggagtttgaggttgtagtgtgctatgatcacacctgtgaatagcccctgcactccagcctgggcaacaagagatcccatctcttaaaaaaaaaagtggcagggggagcaggtggctaaataacatggcagctatatatgtattgatatggaaaagtttctaataataattgttatgtaaaaatgcaaggtacagagtgtttacagtatattctacatacatatatatctatacataaatgcatgtatatgtatacacatacgcatgttcatggacaaccattaaaagggttcataagaaacaggtaatggtagatgcccttggacagttagatgaagtggctagaaaacaaaatagcatgagaggagagaaatatactttccattttaaataatttttcattctggaattttgtaccacatacatatattacttcttcaataataaacagataaaattgatatctcattttattttacatttttgacaattaaaataaatcgtcaaatataatgacaattatttttgtcaacaatttgcaaattattgacaaaattggtcaataattttatttacgtattggatttacatattggtcattgctgtttcttaccatgtgaattgcctttttttttttttttttttgagacggagtcttgctctgttgccaggctggagtgcagtggcacgatctcggctcactgcaacctatttctcccaggttcaagtgattcccctgcctcagcctcccaagtagctgggactacagacgcatgccaccacgcctggctaatctttcgtattttaggagagactgggtttcaccatgttggccaggatagtctcaatctcctgacctcatgatccgcccacctaggcctcccaaagtgctgggattacaggcgtgagccaccgcacccagcagtgaattgcttttttatgctcctgcctaatatatacctttccaaaatgcctacaattgttttaaaatctacaggcattttaggaaaagtcccatacttcataaagcagagctgcttgttactaagctaccagtggccatgctttcatttcgggaaatgctgttatggctttaaccattgttgcctaagaggtcagtgatttccctgtgcaccagtgcagcaaaggaggtccactgaggcaccaaatagtttcccatttgaaaagccacaaccatgacaaacttggaaagaacttttcatcttggagttctaaaagccaatgacattaaagtgcatttttctagatttcttatgcacaggtgtaagggacaacattaaaatatcatacaaggccaggcacgcctgtaattctagcactttgggaggccgaggcagggggattgcttgatgtcaggagtttgagaccagcctgggcaacatggtgaaaccctgtctctacaaaaaatacaaaaataagccaggtatagtggtacacgcctgtagtcctagctactcaggaggctgaggtaggaggatcactcacttgagtccgggagatcaaggctacagtgagctgagatagtgctactgcactccagcctgggtgacagagtgagacactatttccaaaaaaaaaaaaaagtcatacaaaagtgaaaataagaaataattttcctagtgtcacttataaaggatatgagacttaaatactacagaatttagaaggtgactgcatactgtttgcagtcatttcctccctcatgtcttttttggagatacagcatctaaagctacatgttggatttgtctaaggcctacttcttttttcccttctatttgatagaggcttcaggtatgatctcaattttcaaattcagcagcacaaactcaaatctaatgaaccccgtttaaataggggtacacgttgtgcacatgtaccctaaaacttaaaagtataataataaaataaaacaaaaataaaaataaaaaagaaagaaaagaaaaaaaggtgaaatatgttatatgaattatatctcaattgaaataaaaaatgaattcattcattgtgccaaagtttacctaaatcttatatttaagattaaatataagattaaatatacatatgtttaaatagacatatgttcatctttccaagcagtgggagaccccagcttagcacaccttccttcttttctgccaacctccagccatgtgaaatttctttacccagttaagccttggtttgggcaagtgaaaaagggattaaaaatatccacctcagaagtgtattgtgaagattaaagaaatactgtatgtaaagcttttagtgcagtgcctggaacctagaaagcacctaacaagtggcaaaatcttcatcattattatcatcatcatcatcatcatcatcaagatgagtacaagaaagtagccatttagcaaagtgaaagcagaacagacagaaaacgtatatgaatctattaccacaattaggggtaaaaagggcctttaattatttcctgacaagttgcagacaaaaccaatcaaaaagcaatgagtttccatgctgcatcaagcagcaccgcatcacagagctcctcttcgtgtctctcccagaacatcacaaaaggcacaaccaaccaaagagggatgcgtacttgcaggagaactgaacaattaagggtatgcaactaacagaaatgaattcattgggaaaaagtttggcaattcctaagaacgttaaacacagaattaccatgtgacccagcaatgacactcctaggtatacatatatccaagaacacgtatctgctaataggtatgaggtttcttttgaaggtgataggaatattcttttttttctttcttttttttttttttgacacagtcttgctctgccactcaggctggagtgtggagtgcagcggcgctatcatagctcacttcagccttcaactcctgggctcaagggatcctcccaccttggcctcccaagtagctgggaccataggtgcatgccacaacacctagctaattttttacttattcttcttctttttttcttttttttttcttggtagagatgggtctcgttatgtgcccaggctggtctcaaactcctggactcaagcaatcctcccacctcaagctcccaaagtgctgggattacgggtgtaagccaccataccccgttgtgataggaacagtctgaaatttgataatggtggtgactgcataacacagtaaatatattaaaaaccactgaattgtgtactttaaaaatggtgaaatacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagcaaactatctcagggacaaaaaaccaaacaccgcatgttctcactcataggtgggaattgaacaatgagaacacatggacacaacaaggggaacatcacacaccggggactgttgtggggtggggggaggggggagggatagcattaggagatatacctaatgctaaatgacgagttaatgggtgcagcacaccaacatggcacatgtatacatatgtaacaaacctgcacgttgtgcacatgtaccctaaaacttaaaagtataataataaaataaaataaaaataaaaataaaaaagaaaagaaaaaaaggtgaaatatgttatatgaattatatctcaattgaaataaaaaaagaattcattcattgtgccaaagtttacttaaatcttatacttaagattaaatataagattaaatataaaaatcttatattaagattaaatcttaaatataagattaggcaaagtaatttagaaaaattattttatgctatccatagaagaaaaaaagcaagtgcaacaacaacagcaccaaaaacaagttagacgcaaagaataacaattaaaaggaaaaaagaaatctgacagcatttgccacttgtaaaaatttctgttatatgaagattatatcaaacaactcaggacaaacatttttgccttatcccttgagcaactttataaggttttttagtttacttcaagggataacacttcattcaagcagggatcatctctatgaaataaattttaatatacaaacctgacagtaattcttcttctctgaaagacacactacagattcccaaaactgaagtttggaaccaaaactaagaatccacgtgacagcaggcccagaggtggaccttccactgcacaccagtgtgcttataaataggaagaagtattattctattttataaatataaaggacatgctagtctattttcccaagggtctctcaaatcgggcctgccattaagcctattaacccagttttttcataccaatgatagtaggcagggaggacggcagcacaactattttctgtttttcctcctacactgacttttttcctgcttaactgcctttccggggatatatcaggcagttagctctttttgctatttggaatcaaaggattctaagcactaatgttaaatataatatattcaagcttctaaaatactcactgactttacattataaatcagtaatttgaactttataaaagtttacaattagtggaaattccgcaaaagaattttatttatttattttttttttgagatggagtctcactctgttgcctaggctggagtacagtggcacgatatcagctcactgcaacctctgtctcccaggttcaagcgagtctcctgcctcagcctcctcaagtagctgagactacaggcacgcgccaccatgcccagctaatttttgtattttttagtagaaacggggtttctccaggttgttcaggctggtcctgaactcctgacctcatgtgatctgcccgcctggactcccaaagtgctgggattacaggtgtgagccactgcacccggcctctgcaaaagaattttaaatatgacctttacccccactggattttcctggaataattatttcagcaaacttccctagacttactgctcagagaaaataaaactctttaatttcataacatttctaactggtcagagaaataacatattaatggtccatcctctgttattcacacatattaagactttcctaggcagtacgattctaataaggcatcaatactttttgtatccccatctgttaactataaaaacttcacttttccaagctcacatttacaagaccctttcgctcatctgggtcagactgtctgcaacagtaggaaggacccagactctcttcctgtgactctgttctaccagttttcacttcattttccccactatttctgctaaataaacatccacggagctaatgtatatccttggatctagctgctgactccttccccattgcctttgtcagttaatttctattttcactcaattccacgctccatgaggctctggagtccttgaaatagtcaatttcctaggatccaggggtgatttgctattttcttcaccacttcccagttccctggggtccttccattgctaatgctagtgacagtataaataagactatgatagtaagattgcttcatataaatgtttttgccactttttcagcttttactgaggtatttgaaggccagagaagacagaatataaattagtgaatccctaacagcagcaataaaattatagttaattcagtcagtgctgtgttggtgaaggtttaacaataggctctctggggagaaaaagccttgatttggagcatttgctgatttccatggtaaatacactccggccatggttgatttgaagctatcattgtcacatcactgaaaatcacatctagtgaggagactgattagagatgtgctgtaccacaccatgatacagtattccaccatacagatacaagagatataaacagccccaagagcatggataactgtaaatatagtaaaataaatagtaagtgatgagtttgagcatttattatatttgttgttcatgtaatttatttgtttacaagcttctatgatttaattttaagttatttttgtctttttaattgactttatgatttagtttttaacaatggttatgtttaataatggctcacaaaattcctgaaaatttagcaatttgcttttgcaagcaagtacgagccagctccagtgcatcattgattataggatataggaaagacctacacataaccttcaggatgttgtggcattatcaggtatggcccagcttgttgcagcaggcctgggtgacttgaagagccgtggaatctggacctggatgagcccagtggagatgcaaaaggatgtaagaggcagagtgagctggaggagctagaagaaatctgacatggcatcggagataaataggaattagtggatcctctaaaaaatgactgggatgacagagacttctagttatacttggtagatttaatatacttagttactttccttgttccctttcaatgcctcctgaaaccatcctaaaaggataaaagaataaaaaagcacaaaactacaggagatccccatgactcatggattctgtgtttgcaaacttgcctactcagtaaaacttatttgtagccccaaatcaatactcatcgtgttttccacaattatttgtgaatgtggtcagagtggtgaaaaatttgagtcgtccaacacacaagttcccagcagaggctgaacaaagcaacactctgcctttgttctggatctcatactgtaaacatcatccttttcatggtctatttagtgtcacgtttttcataccttcgtgctttttgttgataactttgctgtctaaagtggcccccaagcacagtgctgaagggctgtctggtttcctaagtgccttgcaaagaatatacatgttagataagctttgttcaggcatgagtgacagtgctgttggccatgagctcaatgttaatgaatcaacaatctatattaaacagggtgtctttaaaaagaacctatacataacacaaagctatgtgttgatcctgggctcacaagaatctaaccctgtgtttcccctagaagcaacaattcaatatttacgaattcagtgtttgctgcaactttctagaacataattactgtgaataatgagaattaactggtataataacgaggagaacagaagtgatgattagaacaactaaatttcaaaagttacaaggcatatagatgagtggaatcagctcaccagagaaagccagactgaagcaagtattggccaggctcagaaataggagagccagtgaatgcaggtgacgttcataacaggagaatgagttgaaggtgtgtgtaagaagccattagatctctatttcccacccccaacccggcacagtcaagttttctcaacccgggcagaaaactaatttattttctatagtggctgatccccacttgcttctggactcagggttaccactcgtaggataaggttatcatcctgaaattggggaattcaggcgaagtcctcacggagaatggtaaaactgtttttcccttttcctccactcagctctgacaaccctggctactagctttataccaaccagatggcagactgaaggacatccctctggggatactgcctgggccaaaagaaaatatctgtgtgtattaggaaggggagggaagaatctctcagtgaaacagccctcttagatcatcctacggttaatcccactggtcaaaaagtcatcctctacacacacacacacacacacacacacacacacacacacacacacacacacacattctaatcagctttgttatgcctcgcccttaaatatcaggaacaactgaagactaataggtatttgaagagggcatctaatataaaagagacaaaaaaaattaaaaatataaaaaagaactcataggaaacagaaataatgctggaagattagataacttccaaaaacctatcatggacatcagtatatagttaaacaatgacataattttcacagaacaataataagttttaaaaaagaacactcagtccaggtgtgatggctcacacctgtaatcccagcactttgggaggccaaggcgggtggatcacttgaggttaggagtttgagaccagcctcaccatcatggtgaaacaccatctctactaaaaatacaaaaattagctgggtgtggtggcaggtgtctgtaatgccagctacttggaggctaggcaggagaattccttgaacctgggaggcaaaggtgacagtgagctgagattgtgccattgtactccagcctgggtaatagagtgagactccatctcaaaaaaattttttttaaattaaaaaattagaaagcacacccagagaataacattaacaaaaaactcttaaaaattaaaagcagaaactgaaattttaatatacaaattgaaaagtaaaattgagaaaatctcccagaaaatagaacagcaatgctaggagtgaaaaaaaaagaactagaaaatatgaaagaaagggtcaaaaaataagctcactttgcaatatctgacatccaaattacattggatgaattacagaaagaatgacaaagaagaccgaggggaggaaactatcacacatataattaagaaatttcctagaacttaagaatatcagtttccatgagatagggtccacaaaggaccacagaaacaattttttttaaagacatgaaatatcagaacattgggcaaagagagaatcccaaaagctttcagaagagaaaaagagaaacaacaacaggtcttataaaaggattgggaatcacagcacctacttttcatagcaatactgagtgctaggataaacaatcacttcaaaattccaagagaaaacaatttctaatctcaaattctatgcccagtaaaacaatcaatcaaatgaaagggcagaatcaagacatttctcaaaacattagctgtcacatatgcttctcaggaagctactgggagagggacaccaccaaaaggaggatgttcacaagaaagagaaacacagtatattgggcttgggtgcatataaccaattaccaagtaaaagtggcataaacaagaaacaattctatttctctcctatgtgacaagaagtgagactattgatctaatcaaacattatgattaggagaataggtaaaggggaagtgggtgcatatttggagggaggccttaaatccacatattccttggtgtaaaatcaatacacaatatctacaattgaagaaaacttgaagaaacagtaatataagcaaattattataaattatagaagcaaacgtgagaagaatcagctaaaagcgtcatcagtgttacaaagaattggcctagggtaggtggacagacgagtgttgtttttcattagggattttgaatatctagtatctatctgacttcttaagccatgtataacctcgttcaccatgctgggggtggtggaagtggatggagggaagatgggtggggagaggccaaggatctatgtcatgggagttggcaatactctgaagccatggcaataagacatcatcaagtgagtctggcagccgagggcggaacccaggcagaagctcaaagagaatttcccttcctggagggagcagacaagaaccaggcaggccaggtcctcaagggactgagggctggtaggtttccaaggcaggcagccaggcccaggaaataaggcaaagtggggacatgggtttcagaactgagacaccaggccagaacctgtctggatgccaatgcaagcagatgctgggccccagggtgcttggaactcactccttatctccctctggcctgagataaggatcacgctcaggttgaggctggcagatgagggccacaagggaagcaaaactagaaacatgggaggcttgacaaacagtaagtcaacactggatctgagagctataggtcgttgtcatccttcaaaatgtctgttagtccaagactgggtgccataaacagcccctcaaaatctatccccaggactagttagttatgctgtatccacacaatgtaatagtatgcagccaacgaaacaaaccctgaaggttctgggaaagtttttcttttttgaattaggtgtcatcatttcctactttctctttctatgttcttcatgcccgaaacatggtacctggcaatgcagcaacacctgcgtgggtagaatcatcttgtgaccctggggcaatatgcatgtgaacatgcctatattctaagaatggcaaaatgtgaagatgaacaaagaaaaggaaaaggttcactgaagacatcattaagccacccaccccagaattcgtgatgtctcaaataaaataactaaacacatgcctaaccaatgggccttcctaatgtgatggggatggatttaattggaaactaaaacttctagtctttctaatatttcagaaacttaaaattcactcctctataatgcgatgggagtgcaaaatgagttcaaaactctccctcagtactcctgtttggagtaactacctctccacaaacaaaatccacaaaactcatcctcaaaatagcctttgaggactctggagaactcaaggtatatgaatttaatcatgtcttgtcttatcacatcctaattgatatattttttctatccctatgttgcaggtggggactctgagggacacatcttcttcaggtctagccaatttgttaggataataaattacaaaacacatttatcatcctcaaaagtttgctcaaaataattttgaatgtatcatataaaggatatttataccagcttaaaagcccttagcccatttaaatgaattgcttactttgaaaaagctataataagaagttggtcatttccctaatatgcaattaaagcaattaaaaacatttcccaaatgcttatgtggactgctgctgatacaaactgctgttgtttgggagttgactggaaaggtcccactgatttctgtacatggaagaaacatactgttgacttgtaagaaaatcaagttattcaacttaatggatcagtacaggaaacaaaactctgtttgccaagcagaatatttcactgtgtttatgtttctcctgatctaaatgtgctagctttgaatactgcttttaaactaacatgcacaagtggcatttgatatggtctactttattcattaaaacaaagtgaagattattatggagtcactttgaaaggtagtttgggctttcttatttaattaatccattacacttaaccttcccgtattttactccctgcaagtcttgcaaccattattaacactacacaaatatgttttgcattattaaatttaagaatttagtactcagtaaaattctctgcaggaatattgttattaaatgagttcattaaacctaaccacactaattaacagccaagtgatgaggaacattcatacaaaagtgaactatattccatcttcataacctctctgctaattctagcaaatgaacataagcaatctcaggaaaaaaaatccaggaaggttatagaaaccacacatacctcagtggaaaccagctcctccaaaataaatgtccaggcttgtctgaaacttgctcctcatcacatcatctatcagtaattttcaattaagtgtacaatggggtctagctccaccctcccttatgcctgtaatgacatgactggaaacgtagggcattttaattctacaactattaaccagtcccagctggccacagctcagcattttcaggggctcctacatataaaatcttcaacctctagtacaaggatgatctcttaaccacaagaaaaacaaatgaatcccaagtagaagaacgtcaatagattttaatgtataactaatatctacagacccctgccctcacccttattccctgtagtggatgctgggatgcagcaccacacccctctttaccgactgaagcatgtgttctctcagctgccagcagggttggctgcagaaggcttatgactgagtcccttcctgggaactgctttctgtggaaggcagacacttatgccccttccccagagacaccccatatccaatgactatatgatatgaggctacaaaggcctagccctcttgcctcaactcttggctatgctgaaggacaatcttatttccagaacttcctgtaagatcagctgagacatctcctgtaagtctgtcacagttcaacttctccatgtgcctaatcctgcttccttcactccctcacaggtgttgatcccaagtgtaatcctagggaacccgacttaaggcctccccatctgaagaacacaatctcaaggaagaatttaaggggaaacctgtctacacagtttgactttctgtaaagaagtaagttaattccaactaaacacagttggactttttagtttaagggttcaattcctcacagtccaaaagacattaaataaaatttagccatcttaatagaactgtctttgaagcccctaggttcacttattttaaaagaacaagatttacttatccagccgaattgtttcccagtctagctaataacctagacctattaaggtaataatgttgggtcagaatttatatctgtaatcacactatatctaagtatcccattatccattagctctccttcaccgaagaaataggacaaaaactttacatatactctttttgagggggagtgttgtatagtgaattgtgttccccttcccaaattcatatgctgaagctctaacctccaatgtgactctatctgaagacagggtctttaggaggtaattaatgtgaaatgtgggtcgtaaaggtggggtcctaatccaattggactgtagccttatatgaagagacagaaagagagagagagagagagatctttctctctgtgccatgtgagggcacagggagaaggtgggtgtctgcaagccaggaaaagagcacattagccagcatcaactagcatcttaatcttggatctcctagcctccagaaccacgaaaaaattaatttctattatttaaaccacctagtctatggtactttgttgtggcggccagggctgactaagatagggggtgaagggacatgtaatgcaagtaaactaaagcacttattcctcacagatgcctcgcttgttttcctctttagctctgcatcactcctttttctcaacctcttttctccaggtcctttttccccctcattcagtgttagtgcctttgactcaagagtggtacacatattttcaggccctggctagatcagttggtggtgttctgttcagggtttcagaggctgctgggtcatggcctaaagtctatccagagaaattctgagggcacttcatatagtgaggagaatttggaaataaggtggctgagagctaaataagcaaacatataaatacatgaatgaacaaagaaaccaacacagtcaatgacattagcaacatatagaagtaaaacgtcctgtgagataatcctgtgggtgggaaaacactgaaacctaatcaaggtcacgtctttgtacattcaggcctgaaatgcaatcacaacagtcactgtgatctaagcaactgccaggagagctcatgagttcacagatggaagaaaccatggggattagccatagatttcccttctatggatccaagcaaccttctcattagaacttggttgcctgtttctcttccccactcaggagtgacaaagtatgtgtgactctgttaatacatgtgttccattgcacttggtagtcattttttcaacactaacttggaaaaatggtagcctgggaggtacaccaatctttcataagttttgttaacatgaattagctccactgagctaggtcatggctgacagaatgctaaaatctaattttggaccatgaagttcctagtagggcagagcactaggtaaagttcttcctatgtagatagttggcctcccttagttattttaggtaagctggagctgtattaaaggggagccttgaatgctagacttaagatgggcctctattctctctgcaacaaaggtccagccctctgagggtagaaacataagtaaaattttatgttgagaagatgacattggcagtgtatgaaagacaggctggaagctagacagagtaaacaggaaggacaattcctcaggacagttgctcagggtgaggatttgaaatgttctagtgggaatcagaaagcatgtatatgagaggtaaggcaaagaaagaatcaagaggtcttgccaactttgtttgtaggagggcatggaaaagtaagttctggggtctggttgaatgtgaaaaatagagatgacagaagctggtacagaggtcagagtgtgctagttggagggtggtcagcgtgaagagactgcagatggaactgatcatgagggcccgtactctgaagagaagctgggttacaggaataagcttcagagttaatagtgcagggtaaacttatggaaatgagtatgaacactgagaggggcacatggagaatggaaaggagagggaccaagccttgttgaaagctaaaatgtgtacggtaggaagagcaatggtctaaaaagaaaaggagccagtggcaacagagaagtatgagggaaattgagagccctcttaagaggtagctatggtgtcagaagagtaggaagtgagattatctgctgagggagaaaggaaggggaggagcttgaggtagtgaaaggattggaggagttttccagtggattatgggagagagttgagaagagatgaagaaatggctaactgaacagtgctaagggcctaaccagattagttgcatatggtaggtgtattagtttgctagggctgctatgacaaagtaccacaaactgaggggcttagacaaaagaaaagtagtgatttacacttctggatgccagaagtctaagatagaggagttggcagggcctttctctctctgagggcactaggaaaggatctgttccaggcctctctcctgggcaccagtcatatttgattagcatctcaccctactccagtatgatcttaactaattacatctgcaatgactctatttccaagcaaggtcacatcttgaggtacaaggggctaggacatctacatataaatggggtgggtgaagggcttcctggggcattagaaagctagaggcagagatgctgttcagggacacctgagtaccgactctggtttcttcctgctcctgcaacaggccatgaggctatcgccttagaggggtataccttgaggctgtagtttaaaagctaacagtgtggccaggcgcggtggctcacgcctgtaatcccagcagtttgggaggccaagggggggggggggtggatcacgaggtcaagagttcaagaccagcctggccaacatgatgaaaccccgtttctactaaaaatacaaaaattagggcggggtacagtggctcacacctgtaatcccagcactttgggaggccgaggtaggcagatcacgaggtcaagagatcaagatcatcctagtcaacttggtgaaacaacgtctctactaaaaatacaaaaattagctgggcatggtggcacacgcctgtagtcccagctacttgggaggctgaggcaggagaattggttgaacccgggaggcggaggttttggtgagccaagatcgtgccactgcactccagcctggagatagagcgagactccgtctcaaaaaacaaataaacaaacaaacaaaaacaaaaattagttgggcatggtggcacgtgcctgtaatcccagctactcaggaggctaaggcaggagaattgcttaacccagaaccgggaggcagaggttgcagtgagccgagatcacaccactgcactccagcctgggctagagcgagactctgtctcaaaaaaaaaaaaaaaaaaaaaaagaaaagaaaaaaaaacagctaacagtgttggctcggagctggagtgtacctgggctttaaccttggctctgccacgtatttatcatgtgctcagagacaagtgacctaaactgactttactcaatttcgtgtctataaaatgggaataataataggacccctcccatagggttatgagaactaaacacattaatgaatagcatgcctaatgaagttgtattattctcattttatagataaagaaactgagacatatagattaaccaacttgcccaagatcatttagtagcagagtcaaattcggtctatagaaatcaaaagttcatgcttttcactattgttacattgtttccagtattagctgattcgtttgtccattaattggatattagcatttaaataaaaagttgataaggaaaaaataaaaataaaacattttcctttgtaaaattttcttctgggggtgctggggagtaaattagctacaaaatcaattacaaggagaatgattaaatataaagagttaaaaacaggaatataatttccaagtgctcttttccaaatattatcgctgcaaggtttgaacaggagaaagccagtagagataagaaaaatcaaaactgaataaacttgatgttaaatcagcttctatttcttcttgtctttcctcccattttctccagttgccatgctactcctgaggatctaggataatactgaaagaagcacatatggggcacaagatttctagcactttaaagcttaatgctttaaaagtatgttttgaggcttctttaaaagtttatggatcttgcccagagctggagtcggagcccccgaggctgccgccgagagtgcccgcgagcccgtggcccagccgaagctctttcccgccgcctctccgcgcctcgtccccgtccagccccacccaacccccaacccagcctggtcccctgaccctcagtctggcccggtctggcctcccagcagggtcacgcaactgccccggggacgatgaaaggaggataaatggtgcccaaggtggacagcggtgccttcctgctgctcttcctgctcttgctgtcactgagccgttgcggccagtggggaccctctgctgagacaggctctgtgtccagcacctgctccgggtcacgctctgggggagtaggagtcgcacgactgtctcagccttggatttgactttggcctcatccacctaggggccacgggagaaccatgtgggttaccaagttcaaggggagagagaagaagctgatgaaaatagaggctcatctgggactgccttccttctctggctccacccttgacttcttcagagcttgggctttaagccgtgagctccatctcattccctgggccgcaagaagctcactgggcccgcgtctctggaggctgttgggggggcccttcctctgtctccatagtcgacggcttgctggggaaacccaggatctccgactgcctggacatttgcattgctgtcccctcgggttttgtctcaggctgtgcctggggctgtgcctctccctcaggctccagcttggtggcagacttcttgtcagagccaggttcgggggtccacaagggttcagttccccgggaactctccccctccttgttgatggccacagagggagatccccgtgccttgggctgcatccagcagtggctgaggatctcgtcgatgtggagccgccggttgacgtcgggctgcagcatgtggtagatgaggtccttgcactcgcctgtcaggtgcttggagcgtgggaagttgacgcggtgctccttctggatacgcagcatcttcttgatgttggagtcgtcgtagggcatggagccgcagaccatgatgtagaggatcacgcctaggctccagatgtcgtacaccttgggctggtagggaatgccctgcagcacctctggggccgcatacgctggtgacccacagaaggtcttgcttaatgccattcgaccactgtcatcccgcaggcagcgcttggagaagctgaagtcggacagcttgatgttgaagtccttgtcaaggagaaggttgtcacacttgaggtcccggtggacgacgtccaggtcgtggcagtacttgatggccaaggaaagctggtggaacttcttgcgagcttcgtcctcatgcagggctccccgggttttgattaactcgaggaggtcgccctggaccgcgagctccatgacgatgtagaccttgccatgtgatgtctcaaagatctcgtaggtcttaatgatggagcagtggtttaacatggccagaatctcaatttcccggggaaggaatttctccaagaagtctgcgggggccttcttgcggtcgatgatcttgatcgccacattgaacttcaggcgctcagagtaagcagattttacttttgcataggagccctctcctaaatttatccccaggaggtagcctcgtcgcttgaggacagcagcgtcatccatggtgccaggaatgcccagtgcctctgaggctgccctctacagccccgaggcgcatgggccagcagtgtgctcatttacatcctggatagagagtcctttgggctggccaggcctgctgttcctgcctcctagaggccaagactctggagtggaacatttggcactgtctcccagatgacttcagcgagtgaagtcacaaaggaggagtgccctgggggaatgagaccctggcctgaggcacttggacttggaatcctggaaggctggccagtaggctggagcagacaagatgagcagaaagtggcctcgtgtcttgctgggacctgaggtagaaggggactgtgtgggacacatgggcctgcccatgcttccaaacccagagccaggcatacttgtgcagaattgaggccaattcttgcaaaccagggcatctgaggaggatttaataaagggacaattaataaaggtgggagcagagtgtagggaaccctgagggtcacacaattaccccaagatagtagcagacccctggcctgcatagaaaagggtgggaatggtccctggaacccagaaagagtagtgtagacaggaccaccttgagagaggcagtggccttcaggggagaaaaagccagcctcagtgaccctacaggctggcaggggatgggaggaagtcccatccctgacttctttttctccccttcagcccttgatgctgtccacacaggtgaccctcaggagtgcagagcagggccaagaagagtggtgtgtcaagaaggtagacagcttcctggccccggagtcacgcagtttgagatgcctggattctgccgcctccctatacatctcttcccttgtctgagcctttgctggcttcttacagcagctctgtaggaggacagctggcaggagttctgctcttggctgtgagctccctcctggggacctgcccagctcacggccctggctgggctcccagggcatatctggggctgggggctgaaggtggggcctggatgccaccctgagcactggcagctgctctgaggacattacaagcagcaggggaagcactggacagcaaccatcatttcttctggcagtggagcctctgctgtgactggttctgtgtccagcacctgctctgggccacaccgtcaggaagaaggagttgcatgactgtcctagccttggatttgactttggcctcatccacctagagggagtgagaactccttcctcacatgagccaggtggaaccctgggcccttcaggagtgagttagtagagctggatgtcgctcaggctgggttgggtcaccaccagctgtggcccttctcccttttctctgctccttcaccttgttccccaactctgactgcccactgccagtcctttgtgcgtggttggtgctccttcctccagacagcctccttctccttcctgctggggaaaccccaagtgctgtctcttggaaaccaaaaataaaattctaatctccccagccatctgaatggacccctcttctcagccaaggccattccaaaattaatctgaaaaactagttcaggccatgatagaaagtaggggtcaggcaggcctcatcatccctcctcccttcaggtttcaggcacagctgagcagcagtaacatcgacacagagacctgaagactgacaacagactctggcagtaagatacagcaggctctgaaagaaactgaagtattttactatcaaacagatttctttgacatattttgaaatagctctgcaaagctgtctcttatgaggaaaatctacattctgtgaagaatccccttccctttctagctcttttctcctgagataattaactagagtctgataagaaacatttaacagtgtgttttttctgaagcctgatacctggaggcttcatctgcctaagaaccttggtctctacaacctcttaccccagagacagtcccttctattgattccaggtctttagataaactctctgagccaattgccaatcagaaaatctttgaatccacatgacccagaagcccgcctcccactttcaagttgtccctccttttctgactgaaccaatgtataccttacatacactgattgatgtctcgtgcctccctaaaatgtataaaaccaagttgcagccctatccctttgggcacttgttgtcaggatcttctggggctgtcctgggccattagtcacatattggctcagaagaaatctcttcaaaaaaaaaaaaagtttatctatattgctgtctacaatgaaaaatatccaatgttatgtttactctttgtaattaaatgctaaaaaatttattttggtcccaatgctgttttctttattgagttatcctacaaaggcaatagggaaagataagcagaggcaaatgcaagagagagcagggaagacagcttcttgcaaattgggctttctcatttgtgtgtcccctggctgccctcagcacagagctttacacacagtcataaacactggctgagtgatcatcgcaaagaaagggagagaaaaaaaattcattttcctccattgctcctttacccctgttatgttctatgtcttccaaggataaagacaatgaggtatgaggtattcactcaaaatgataattaccttgggattatgtagaaatattgtatctaaaatcctaaactgacaggatcatttatttgcattttacaaaaatctgggcaacagatgatacacatacactcacacatagacatacaaaacacctggagatgaaggagaaatagtgctgcacttgaattatttctattttggctcaaaattccctgagatatatttctaaaatctactcggcagtttctcccaccccctttttgtcttttgattctttagatgctttaaattcaaaaggctccttatctatatcccagatagttgagttatttgaaagccctgaccaaggcattttattatggatttggttgctcttgggtagagtgaataggtaaatatatgctgtacagggaattttggcaggagtggtaaagggctccagctccctgcttcacatctcaggtctgctccttcagtgccatgtgggattctctttggataccatcccataggttgggaaggcatcctaaaatcgatgctgaagttgtcagtatcaccagtctatgggacctagtgaaagagcaagcagaactctgagaatctgggaagaaaagcagttttctaatgcaaaatgcatgagaggagagccaatccttggtcctagggctctgacaactcattttgtgaccttaggcaagtgacctgtgtttctttcccctaactttccttatttttgggttgtggggggagtctttaactagaaattgttaaggtcctatagaatgacacctaactttttttattctatatctaaagacatgttatcaagggttccatctgccgtacggtgagttgtaggagctgaggcaattaagagcatcagacacggggcagataaatctggttttaaatcccaggggccacatcttattagtacagtgtgactctcggaaagtaacttgatctgtaaaatagatgaagttatctaatttacctagttatcttacagaggcaataggaaaagtatataaggaaaaaaggtatgcaaaataggtatgcactttaaagtgattgtgaggattagacatggtgattcctggtatatcacctcttatgacatcataatggtctaaagcagaggcattctactccattgggcccaagttatgtacaaaataatattcagtataatatagatctattataccttagaatatcccagacgggatcctgtaaactattttctagtatctgttaaatacttttcttaacactactaagcactacagggaagctaaaaacactacgacatggcatcaccttctaaaaatttgttatttagttgaagaaaccactagaatatagatatgaatgtcataatatataaaatatgaaacttaagtagattttttaaagtactgattttgcagtaaattgcctaagcttatgggagagaaaaaaaatcagagggctggggttgcccaggaaggtgttagagcttccttgggcaggatcccctggctgggaggtcacccaggatacggtgttgaggcagtgtcttctaagagcacagttcctgaaaccaaaggacaccaggaacataacaatgcagggtcaaagtctgagctaaggaaacaaattttgaaaaccaggttgaaaattccaagagatcagacagaaatgtttccatggtttaatttggaaaaggtataaggagcctgggttgctgaccagttaggcaggccaaagctggagtgtcggggagcaagtctggtggtaaacagcaggctcagagtgaagtgccagtcaagtcctagacctggttgtggaagcatgctgagtacatttcaagtggctcacaaaggacaattggagggtttcacagaggtgatgagacacacgaggccttgaagcaaaggtagatgtacataggtgatacaggaaagggaaatggcatttgaacaaaacacagagaaatgaatgaatatggccaagaacaaacctttattagatgacaaatgccttggaaaagatagagatgaatataacatggtcagtaccctcagaaggtctctcagtgtcctagcctacctcacaacttgaagcactaggaagcaaaatccaatggccagtcgtaagttttctgctagagactcatgtcactgaagatagctgaggaggcaaaatcctagcctgtggtggttaatcttatgttgtgacagttaataactcattcaatctctttgagcctcagtatgtacatttctaaaatagggactataatagtttctagctcatgggattgttgcaaggatccaaaaagataatgatatataatacttagcaaaaggctagcacacagtggctacttagcaagtgttggcttttattactattattaatggtcattttattttatttttacagacagagttttgctctgttgcccacactggagtgcagtggcatgaccatacctcactatagcctcaacctcctggcctcaagacctcactgtagcctcaacctcctggccttaagggatcctcccacctcagcctcccaaagtattgggattacaggcttgagccactgtgcctgatctattagtggtcattttattacatctgagctatcattgctgctttagtgcataccctcatctcttctcacccagttgctatgaaagtgcccttactggtctctctacttccagtctggcatttctcctcattgcagcccagtgctccttattaaagatcaatcaggatattttattcccctgcttgaaattcttgagtaggctctcatggcccttagaaaaaagtagacgttccttcagaatctgaggctctttatcatctggatcctgctactgtctcctggctccctcagacactctacttcagttacaccctccacccacccccaggcagacccacaacaccttgatctcattttgtcatggacacaccactctatagtgtatttcatttaattccaaccaagtgtttccatggcaaacgttgcatcttattggtctttggattctcaatgcacaatgctctataggtactcaatagatatttatttaaagaaaagaaaaaaataagaaagtaaagaagaaacggaaggagaaagagagggagggaaaggaggagagagaagagggaaggaataaggagggaaggaaaaaacaaagggtgagaaagaaaaacaaagctagaaagagtgatgtctatatcctttaagggaacaggtaagaaactaattttcagtagatctgttggcaaacgaagaaagaagaggaggaagaaggaacaggaaaaagagaagaaaaagaaagaaatcggggattatatcagaagtttaacaatgcatataattactatggctgataatgaaagatccacctgactttttatattaccgctggaatcatagtgtgacagggacaaccattaatgtgtatgtgttcatagcattttctcctcctttctaccccctatactcactgtgtatttgcagattaggttaataaggcagataaataaacagaaaagacagacgcagaattagaaaaaaacaagttctgtcaaggtgtggtggctcacgcctgtaatcccaacactttcggaggctgaggcgggcagatcacttaaggtcatgagtttgagaccagactggccaacatggtgaaaccctgtctctactaaaaatacaaaaattagccaggtttggtggcgggtgcctgtaatcccagctactcaggaggtttaggcaggagaatctcttgaacccaggaggcggaggttacagtgagcccagatggtgccactgcaccatctgttgcctgaacgacagaatgagacactgtctcaaaacaaaacaaaacaaaacaaaaaacaagttctctttatagtagagaaaagagaatggtgtaaaactggggttggaaaacattttctataaagagctaggtaataaatattttaggttctaagggccgcatgtggtctctatcacttattattttttgttttgtacagcacttttttattatactcaagttctggggtacatgtgcggaacgtgcagttttgttacataagtatacctgtgccatggtggtttgctgcacccatcaacccgtcacctacattaggtatttctcctaatactatcccctcctctaaccccctaccctggacaggccccagtgtatgatgttcccctccctgtgtccacatgttctcattgttcaactcccacttatgagtgagaacatgcggagcttggttttctgttcttgtgttcatttgctgagaatgacggtttccagcttcatccatgtccctgcaaagcacatgaactcattcttttttaaggctgtgtagcattccatggtgccacattttctttatccagtctatcattggtggacatttggattggttccaagtctctgctatggtgaatagtgctgcaataaacatacatgtgcatgtgtctttatagaatgatttataatcctttgggtatatacccattaatggaattgctgggtcaaatggtatttctagttctagatccttgaggaatccagaactagaaatacactgtcttccccaatgggtgaactaatttacactcccatcagcagtgtaaaagcttttctatttctccacatcctctctagcatctgttgcttcctgactttttaatgatccccattctaactggcatgagatagtaactcattgtggttttgatctgcatttctctagtgaccagtgatgatgagcattttttcatatgtttgttggctgcataaatgtcttcttttgagaagtgtctgttcatacactttgcctaccttttgatggggttgtttttttcttgtaaatttgtttaagttctttgcagattctggatattagccctttgtcagatagatagattgcaaaaactttctcctattctgtaggttgcctgttcactctgatggcagtttcttttgccctgcagaagctctttagtttaattagatcccatttgtcaattttggcttttgttgccattgcttttcgtgttttagacatgaagtctttacccatgcctatgtcctgaatggtattgcctaggttttcttctaggatttttatgtttttaggtcttacatttaggtctttaatccatcttgagttaatttttgcataaggtgtaaggaagggatccagtttcagttttctgcatatggctagccagttttcccagcaccatttatcaaatagggaatcctttccccattgcttgcttgtgtcaggtttgtcaaagatcagatagttgtagatgtgtgatgttatttctgaggcctctgttctgttccattggtctatatagctgttttggtaccagtaccatgctgttttggttactgtagccttgtagtatagtttgaagtcaggtagcgtgatgcctccagctttgttcttttggcttaggattgttttggctatgcaaggtcttttttggttccaaatgaagtttaaagtagttttttccaattctgtgaagaaagtcaatggtagcttgatggggatggcattgaatctataaattactttgggcagtatggccattttcacgatattgattcttcctatccatgagcatagaatgtttttccatttgtttgtgtcctctcatttccttgagtggtggtttgtagttctccttgaagaggtccttcacattgcttgtaagttggattcctaggtattttattctcttagtagcaattgtgaatgggagttcactcatgatttggctctctgtttgtctgttactggtgtatagaaatgctcgcgatttttgtacactgattttctatcccgagacactgctgaagttcttatcagcttaaggagattttggtctgagatgatggggttttttaaacatacaatcatgtcatctgcaaacaaagacaatttgacttcttcttttcctatttgaatacctttttttctttctcttgcttgattgccctggccagaatttccaacactatgtggaacaggagtggtgagagagggcatccttgtcttatgccggttttcaaagggaatgcttccagtttttgcccattcagtataatattggctgtgggtttgtcataaatagctcttattattttgagatacattccattgatacctagtttattgagagcttttagcatgaaggggtgttgaattttatcgaaggccttttctgtatctcttgagataatcatgtggtttttgtcattggttgtgtttatttgatggataacatttattgatttgcatatgttgaaccagccttgcatcccaggtattgagatggagtcttgctttttcacccaggctggagtgcagtggcatgatctcagctcactgcaacctccacctcctggttcaagcaattctcaagcttcagcctcccaagtagctgggattacaggggcccaccaccatgctcggctaatttgtgtgtgtgtgtgtgtgtgtgtgtgtgtgtttagtagagatggggtttcgccaagttggccaggctgttctcgaactcctgacctcacgtgatctatccgctttggcctcccaaagtgctgggattacaggtgtgcatcaccgtgcccggcctgtacagcatttttaaaatatgaaaaacattcttaccttcaggatggtacaaatacaggttacaggtcaattttaactggccggtcatagtttgcccattcctggaaagaaggggaagaaggaaccaaagagtctgagggcctgcaaaaagttttagttgagagatgaaagtaagggataagaagagacagatactgtagtatctatagggtgaaagacagagattgggattactacatctatagttgtaggttctaaatggatcctccttagatgtccttcaagttactggattgagtttctttgaaggaaaaaaagtgttaaatctgcggtctacatgtcctagtcttagttccttctaaactatatatatccacatgtctaatcttgtttcctcatctaaactatatagccttgagaacaattaagggaagggtagatcgccacctacgtggtatttggccttcagatcaatgcttagtctcattactaggtctcaaaggccatctatttccttttcttattgttgctactggttcctggctctgttatttatgctaatagaaaaggcttgtattgttcatcaattattacagctcttttagtttagtggttcatttaatattacagttctctatattgaaggccttgcatcagtttctgggccaatgacctgatgacgataacaacaacaacaatagtaatttaaaagtgggctttaccactgttccatatcatttattcccacaataaccctataaaggaagtattcctctagatgagaaaagtgaggctcaatgcatttaagtaacttatccaagggcagagctagtaaagggcagaactgtatatttaacagacacaatgcagtctcttaaaaacaaaatcccttaatgctcacaaaccagtaacccagatacagcccagacacttcaattctctccatcttggagtatggtcatggtctcattttccatcctcagtttccaagaaggctgaagtacccttatttatctaagttctgaattgggtttagggcaccagatctagggatgtttgggaacatcatatacttaaaatttcagaagtcctagggagagcaatcaggcaagagaaataagtaaaaggaatccagataggaaaagaagaagtcaaactatctctctttgctgacaatataattctatacataaagaatcctaaagactccaccagaaggctcccagaactgataaacaatttcagtaaagtttcaggctacaaaatcaatgtattaataaaaaaatcagtagcatttttatacagtaataacgttcaagctaagagtcaaatcaagaacacaatcccatttataatagccacacgaaaaataaaataggaatacatctaaccaagaagatgaaagatctctacaaggagcactataaaacactgctgaaagaaatcataggtgacacaaagggaaaaatattccatgctcatggattggaaaaatcggtattgttaaaatggccataaagcccaaagcgatctacagattcaatgctattcctatcaaacaccaaactatcaatgttgtttttcacagaattagaaaaaaactattctaatactcatatagaatgaaaaaataccccacatagccaaagcattcctaagcaaaaagaagaaagctagaggcatcacattacctgacttcaaactatgttataaagctacagtaaccaaaacagcatggtactggtacaaaaccagacacaaagaccaatagaacaaaatacagtaccccaaaataaagctgcacatcaacagtcgtctaatttttgacaaagttgacaaaaataatcaagaggaaaggactctattcaataaatggtgctgggatagctagctagccatatgcagaagaattcaactgaacccctacctttcaccatatataaaaattaactcaagatggattacagttttaaatgtaaaacctcaaactataagaatagaatcttagaagaaaacttaggcaacaccattctgaacaatgaccttgggaaataatttacaactaagttctcaatagcaattacaacaaaaaaattgacaagcatgacataattaaactaaagagcttttgtgcagcaaaagaaactctcaacagagtaaagagacaacctacagaatggaaaataaatatctgtaaactatgcctctgatgacagtctaatatccaggatctataaggaactgaaatcaacaagcaaaaaatatataaccttgttaaaaagtgggcaaaagacagaaacagacttttctcaaaagaagacatataagtggctgataaacatgaaaaaactgctcaacatcgctaatcatcagagagatgcaaatcaaaaccacaatgagataccatctcacaccagtcagaatggttattatcaaaaagtcaaaaaatgacagatgctggtgaggctgtagagaaaaggggatgctaatgcactgttagttcagtcactgtggaaagcagtttggagacttcccaaagaactaaaaatagacccagcaatcccattacatgccacatgttctcacctataagtggagctaaacatagtgtactcacggacataaagatggcaacaatagacactggggactactggcagggagggagagggcaagggttgaaaaactaactgttgagtactatgttcactacctgagtaacaatatcaatcataccccaaacctcagtatcacacaatatacccaggtaacaaacctgcacatgtaccccctgaatctaaaataaaagttaaaattattgaaaaaaataagatcatttctagtaactggtccaaccctcccctcatcttcctttcctcatctctaattgaccctttctccctgaggttttgcaggttatctgcacacgtgtgggtttgggaggtagagctggatgaaaaataggcataaatttatctctctgggcacctttgtctaaactgatcttaggaatatcttcaaatcatgacaaataaataaaatgatgatttttaaagtatgtgtattgccagattagaaactctttttcaaatgtaagtcctgcatgagacaaagaaaacacctttctttgggtaggaaggggtgggtggtctcacatttagttgaagcatatggctgcatttggagtataaattttttcaattttaaaatgtttactttttcctttataaaaagaacacatgcttgttatgtacaatttgaaaaatatgctgcaaataatttattgaattttttaaagatataaatttatggatattggaagaatctctccctatacagtgatcccactatgctttttctacagctgaaatcagaactggaagaggtcttagaaatcatctagtccgaccacctcctttgacagatgaggaagaacacatgttccgtatgattacattttgatgttctcttatagttggctcattccctaaggattttttaaaaagatttatctttttttaaaaacttgagatactattaaattggctaaaattcaaataaacacatcctccctacattctctctctccatctctgctctgactctcaaagatgcatatgctgcctcttagactgttcaacatatggggcctctgcattgatgccaaaagtccagcagtgtctggaactgccacagggcggcccaccgagagagagcattttgagacaaaggtccagctgcctcattcttgggcagtcactggaagcaagacagcaaaatagctgtggctttgctgaccttctcaggagacctatgggcttgaatctggcctctatctggggagaggtgtagagggactggaaaaagggaataggagaagggaaaagaaaatgagaactaccttggaaacaacagtattgaaagtggattaaccatcgctataaataaaaaacacataacgcacattaaatctcacaataggatttttctgtcatgtgcctacttttagattccaaaagtttttaagtatgacaagattcagagctctttttcaaaagatggaggatccacaggatgggcaggcaccatgagtggggtcaatcagtctttgcctctccattcttctcctttctggtgcataacctttgaaggaagaacatatgtggaagagctatgagtctggtttagcatacataaattctgaaaatatcgtgcttccagacacaactggcttcacatcagaaaaacctttccagggtaaacactttgtttaaatattaaacttaagtaaagccagacgcaagaatacagtctaaatagcaaagaaaggccataatgaccttaagtggaaaagaattaataaaagattccccaagctgacaagcctttctggcacagaatgacagctgcagataccaatgatccctgaagtttttcatttttcagatttgatgcactgccttcggttgtgacaaatacacactccagtttttttaaaccttagcctttgccttgatcgtaggaataagtactctgtttttgtaccttaagattttcttctctaatattttttcccggaattacaaaatcatcatcttaaaacaccattactatgaagtccttagatttcaatgctaatggggaagaagaaggtgcctaaaaacaaggagggaaaatcattcaagacatctccaggacagctccacaaatagaggtataacatttgattctgacctttttaatcttgtattttatttattcctctcagtaaagaaggtttgaaatgtggattaaattttaatccattttgtgtactatatattgcatgaatcaggtaaaagttaacattgtttgttggatgctccaatttactattaaccttcagtcagtcatcagtgtctgcccagtctctactggtcatcaggaaaatcctacagagggccagctggcctcattactgggaataaaatagcacaaatggctcacgaactaatcaattatgcaaatatccttgggtcagagaagatccttactggaagccaatttgatattcttcagcaccagggatttaagtgaaagaaaaacaactaattcagaaagctggagaacagaacctatgaggaaagctaaaataaacaaattagcctcggaaagataaggttgaagaatgttctgaaaaaggtcttcctgtatatatgaaaagcagaaaaggtggttggggaaaggaagaaagaaaaagaataaaatgagaccaatatggtgatgcaaggaatttaacactataactgggagctgagaaagggtgcattcattcactcatctgacattaccccaagagtgtactctcagccagacactagctgtgtgctgcctcagcggaggccaggtacccaccttcctgtgatgatttctgtgaggacttatctaaacacaaagggattgagagtcagcttatttaaaattatttacttcttttttgagggaagtagggcaaggtagagtggaacaggaaaagagcagtcatggaggaggctcagaggtaaaactgcccatgtgttatagctgttacatcccaggacagtctacatgtgggtttgggaagtggaggaggacaaaaaataggcatgaatttatctcttcgggcacatttgtctaaactgatcttagaagtttcttcaaatcacaacaaataaatgacgatttttaaagatgtgtattgccagatcagaaactctttttcaaatttatagtcctatgtaggtgaagtacacggctgcatttggagtatgattttttccattttaaaatgtttactttttcctttataaagagaacacatgaaattatatacagtttgcacaattgcacaatgtataatttgcagtgtattttacactgcaaataatttattgaattttaaagataaagataagagtttacggacattggaagggtctctccttatgtccacactcccctaagtctctcagaatgaaattctttcatttgactctctcctggagttagggtggaagttcacagttaaaataagaaactgagttggagagaaataacattaaatgttaccttattagcaccttaccttgaattagtttattaatttaagcctagagaatggacttgaggaacctgagaagcctcagaaagactcaggctgcagaagaatctctgggaggacaaaagtgaactccattagctgctgtggagttagctatgggcctcgccttggtggggacccgggagcttgaggtagttctttggcaaatatagctgcctttgactgatgtgatgcccccccaagcctggcagcatcatgaacagaaatgtgtgcgaaccccaggagataaaacattttggccaggaccatttgcttaacatgacccttacaggacccagcatgcttttgaagctatgtaacagatgttctcacagcatatgctacatgtagaaatgcttgtgaggtatttcagaatttccacttccctctttagagctgattttggatttcttttcataagcattttaaaacatgttccactcaaactgcctcttccatggtacacatgtacctacgtgctgagaaagtgtcactctccagagggaacagttctgttaatgcaccatcagcatcttcagtaaggtctccagaaggcaacttcttgaaatgctattacaaagcatttttacctttctattctggaagaggactcttagccttcattttattataaaaatgtattagcagaagggccttgtaggttgtaattcatcctttctgaagacagcccctaccctccttttttttcacccccattctctctctgacccacatcctttctgcttcttttattctaatgcatctttccttttccacaattgcatttttttttcttttctacactgccctaggctgtaactcagtttggtctctgtaagcagaattcaggaagtaaaataagaacccatagctggtggcataccgccaaccacacctataagatgctttatctcagtacaccctttcactacttcttcacactcctgagatgaagcccactacactagaaagctttcccttgctctgtactacaacaaaaggccctcagataaagcaagggatcttttaggaagagatgaagaaagaataacgatttagcaactagcattttaaattaaatctacagtttatccagaccatttgtttttattattgtactggtcaccatgacaaccctgagaggaaagcatgttttgtatcatctccatttcatggattaagaaaactgaggctgggtgcggtgactcatgcctgtaatcccagcactttgggaggccgaggcgggcggatcacctgagttcgggagttcaagaccagcctgaccaacatggagagacctcgtctctactaaaaatacaaaattagccaggcatggtggcgcatgcctgtaatcccagatactcaggaggctgaggcaggagaatcacttgaacctgggaggtggaggttgcacctttgcactccagcctgggcaacaagagtgaaactctgtctcaaaaaaagaaggaaggaaggagggaaggaaggaaaaactgaggcttggaataatcacatcacttgcccaagccacacaccaagtttttcaactatccactgctgtgtaacaaaccaatctaaaatttggtggcttaaaaaatcagtgtgtttaactactcatgattctgtgggttggctgggttagctgagcagtccttttgctctacatcatgtccaactgggagcctgcctaaggctggaatgatcaagatggcttcacccccatgtttggctgtaggcactggctgttggccagggcacttccgttctcctccacatgtcccgtcaatcctccaagagctctttcctcatgatttgtccagcaggatagcctagacttaatatgactggggcttccaagagggtgcaaatggaaactgccaggacactgaagcctcaggcctggaagtcacacaccatcacttccactgccttctattggtcaaggtagggtcaaccagattccagggggaggaaatagatctactttctagacaaggaagccacatgcatatataggaatgggaagaattgtgggcagctatatgctgtggtctcagtgtttgtgtcccccccaaattcatatgttaaaacttaatcaccaatgtgatggtattagaaggtgaggcctttgggaggtgatgaggtcatgagggtagagctctcacaaatgggattagtgcccttataaaggaggccccagagagctgccttgcccttctaccatatgaagagagtgaaagacagcaagccatctatgaaccaggaagcaggcccttaccagagactgaatctgtccacatcttgatcatgggcttcttggcaaccagaactgtgacacatttctgtcttttataagctacctgatttatggtattttgttacagcagcctaaacagactaagacactatatttgcagacaatctattaatgccacaccagaagggcatagttggaactcagaaagatcagtgataagccactattccagtaattctttaatgttcaagtctaagattatgatttcattgcaggtgcatgcacaggtgcaggatgttagttccccatttggtctcaggtgatgttggcaccactgccagtttgcctttatgtgtcctttatttgaaaggaagagattaacttaggcttgtatataattattgttaatttggcttaataatcagccttaataattagcctaaagcaaatgttctcaataagaactttaagagcagggtatgaggtgacaaagtatcaacaactggctgaataatgggtacttgctgattaatgttaatggcaaagaaccacttgtcagcagaaatcatgggaaggaggttgtttatgtgactgtctcagcagtcttattgagttttccagcgtgaacgcatgttcggtggtcacccaattaaaccctgtctttagacagatgcattgttacatctgagattcttttaggtctgaaactcctccaatgcctaactcatctaacacgtccacttctctgggccccagcttgtacacacacacaacacgtacacacacacacgggcacacatacagagagtcctaccaccaagaaatgttgtagaacagcttttttaaacaagtgaaaattaagttcaaaactttgttttccagattctcacaaatctcttgaagtgaccagagccctcctggagtgtcacagcctaggctgctgtcactggggcttcacagtcaccatgacacccatggcttcaactcctcctccacctccctcagcaaaggcaggcgccgtgattccctttctgattttgaaccaccatgaaaggtatttcactgctctgtgaaggcatgcctgctttctaagagactttacagctgactcccagctgtttatgtgtctccccattaagctgaatgggaagaagaaagtcacagaggaaaagatctctggggtaagggtgcagggactaggttcagggagaggacactctaaatcctgtttggtatttagtcactgaggcttaagtttagtttggttgtttaaaaaatgtactcatagtaacttaaaaattaaagtaatagccaggtgtggtggctcacgcctgtaatccctgcactttgggaggctgaggcgtgtggatcacctgaggttgggagttcgagaccaccctgaccaacatggagaaaccccatctctactaaaaatacaaaattagccgggtgtgatggcacatgattgtaatcccagctgttcggcaggctgaggcaggagaattgcttgaacccaggaggcggagtttgcggtggacggaatatcgcgctattgcactccagcctgggcaacaagagcgaaactctgtctcaaaaaaaaaaattaaagtaataaatgtacatttaaaaatatttgaaaaaatcctaagatcatagctcgatgcagccttgatctcctgggcttaagtgatcctcccgtctcagcctccttagtagctgggaccacaggcatttgccaccacatctggctaatttttatattttttgtagagacagggtcttactttgttgcccaggctcgtctacaactcttgggctcaagtgatcctcccgccttggcctcccaaaatgctggaattacaggcttgagccatggtgcctggcctgtgtttttgttttcatataatttagtaagtttgtagcagaattgagagcccaaggcagatggatgattgccttgaaaaggtgtcacttttctagttaaatgtcagtcataataaaaccctaagggaggctaattgggccattaatttttaatatcttaacaatgttaacagacttcaaagggagaatctacaacaaagattctaagaagagtgtataaattcaaaagatgttcccacattatcagcattaactgaaagtacttaatatttgctctataaggacagacttaaagaagtccatcaactataaaatttattagtagaaaaatcatattatatatggaggggaaaatcaatgaatacacatatacatcttgggagttttaaaaatattttgcctattttgttaaacctaatatagtactagaaaatgttcatctgggagaggaaatactacatgcatgcacacacagtcataaactgaataatattaaataaatagtaacagcctgaaatgaataattgcagctgaggagtcatgcacatgcacactcagagatgtcactttcattcttcactatctgaccccaggctccagggtaaaatccaagctctcccccaggacacaccaagcattttatgtgcactccctttccacctgtttgcttatcctcccaccgcaccaaagatccagtccaacctgacttcttgcagttttcaaaagtactgagatcccatttggctcagctgatgccccattcctggtcatcctcaacttggcagacccttcttcatgcccatcactcggctcagctgatgccccattcctggccggctccaggtcccttcttggccagccaaggctgaaaggccacctgcctgctagcccatattttctcatcttcatgtctgtcccttactagagtagggctccctgaagacaagagtggcatcttttatgctgcactcccccccaccatcaccaccaccaccccacctgcacttggcacacggcaggaattcaataaatatttattcagtgaataaggtcacgtctcaggggtctgtaacaactaacagcttatctgataggcatttgcaagagatggacgccatgtcaactcctcacagcagccctctgagatgggacatacaagtctaaagcccttttccaaatctcttggggatatatatgtttaggatttcagaaatttgtgtattttagaaaggcaatatgttgtattaaacagtatacaatagccccagaggaatttggggccataccaataatcaaacatgtataatgaaccaaacataatcagccccaaatatgagcaatcatactaaatggaataaagactataaatagactctggtcagttcaagttttattacctactgagtttgcagaaaacttgtgaaaaagccgtccattttacagctttctgtattcagaattgcagataaagaagaacggacctgcacaattatccctatatattttggaaataaagagaggtgccacagaaagggtaaataaactgaccaagatcatacagctaataaactagaatttaatgccttactccagaactctactcttttaaaaaggttaaattatgtaatatttgatatacacaatatatgtgacacatatgtaggttaatgcatagcaattaaaataataaaataaaaccgtacctgccaccttacttagagatatgagcccctgatcttaactcccaggcacaccacctcaggacaggctaagcctaacctatttatggctatgttacataggctgaattttaatggcttaggaatgccaccttcttaggtgggacccaggagatcacacagctatgacaccagtcagactctaccaggggaaattaaatccttttatatgggtcgagtatcttttatctaaaatgcttgagatcagaagtgtttcagactttgaactttttcagatttttgaacattttacattacatataccagttgagcattccaaatctgaaaatccaaaatccaaaatgctctgatgagcactaccctttttttttgagacagagcctcgctctgttgcccaggctggagtgcagtggtgtgatcttggctcactgcaagctctgcctcccaggttcacgccattctcctgcctcagcctctccaatagctgggactacagtcacccgccaccatgcccagctaatttttttttttttttttttttttttttttagtagagacgaggcttcaccatgttagccaggatggtctcgatctcctgacctcgtgatccacctgcctcggcctcccaaaatgctggtattacaggcgtgagccactgcgcccggccaatgagcactacttttttttttttaattatacttttaagttctagggtacatgtgcacaacgtgcactacttttgagtgtcatgtcagtgctcaaaaagttttagattttggaggatttcagattttcagatttggggtgcctaacctctatctcaaggcatctatgaagcagggaggggatgaaatcataatgagaggtgacagcgtgctggcagtcctcacagccctggctcgctctcaccgcctcctctgcctgggctcccactttggtggcacttgaggagcccttcagcccaccgctgcactgtgggagcccctttctgggctggccaaggccagagcccactccctcagcttgcagggaggtgtggagggagaggcgggagcgggaaccggggctgcctgcagcgcttgcgggccagctggagttccaggtgggcctgggcttggcgggccccacactcggagcagctggctgggcctgcaggccccaggcaatgagggacttagcacccgggccagcggctgcggagggtgtactgggtcccccagcagtgccagcccaccgttgctgctctggatttctcgccgggccttagctgccttcccgcggagcaggcctcgggactgcagcctgccatgcctgagcctacccccgcctccgtgggctcctgtgcagcccgagcctccctgatgagcacagccccctgctccacggcacccagtcccatcgatcacccaagcgctgaggagtgcgagcgcatggcgtgggactggcaggcagctccacctgcagcccaggtgcaggatccactgggtgaagccagctgggctcttgagtctggtggggccttggagaacctttatgtctagctcagggattgtaaatacaccaatcggcactctgtatctagctcaaggtttgtaaacacaccaatcagcaccctgtgtctagctcaggggttgtgagtgcaccaatggacactgtatctagctactctggtggggccttggagaacctttatgtctagctcagggattgtaaatacaccaatcggcactctgtatctagctcaaggtttgtaaacacaccaatcagcaccctgtgtctagctcagggtttgtgaatgcaccaatcgacactctgtatctagctactctggtggggccttgaagaacctttgtgtccacactctgtatctagctaatctagtggggacttggagaacctttgtgtctagctcagggattgtaaacgcaccaatcagcaccctgtcaaaacagaccactcggctctaccaatcagcgggatgtgggtggggccagataagagaataaaagcaggctgcccgagctagcagtggcaacccactacggtccccttccacactgtggaagctttgttcttttgctctttgcaataaatcttgctactgctcactctttgggtccacactgcctttatgagctgtaacactcactgcgaaggtctgcagcttcactcctgaagccagcgagaccatgagcccaccgggaggaaggaacaaactccagacgtgccgccttaagagctgtaacactcatggcgaaggtctgcagcttcactcctgagccagcgggaccacgaacccaccagaaggaagaaactccgaacacatccgaacatcagaaggaacaaactccagacgcgccaccttaagagctgtaacactcaccgcgagggtccatggcttcattcttgaagtcagtgagaccaagaacccaccaattccagacacaataatgcttcccagatgtaaaaatgatgcaaatgtgatataaattaacaagggctcttttaaaagcacaatggataaaaatgtaatagtgtgtaagaccaaaacatactgatgtgtgctgcttgtataggctagcataacaagagcactgggctactgacctgagctgctgagacaattaggagttgggaagaaagtgtgaggggttacacacagaaagagtgcttaaggccctgtatatggcatggttatctgcagataaggacaaaacccaaagtggtctgccttgtttaataagatctcccttttaggggcctccaattgaccagaggaatcttcaactcacctagagcaaaggttcagaagatgaaagggctttcacctcagcaaagtggaactgatattgtgggagagttattgagtaatagaccctcatcctcacatcaaacatccctaaccttgccagacaccagcctctcccagacagctcactgaagaagaggtccaaccaagaccatggctggaacctggatgctctgaacaggtgatggcaacaatgaggtctctggggaggagtaaggatatgtgtgtgtgtgtgtgtgtgtgtgtgtgtgtgtgtgtgtgtgtgtgaagtgggtgggggggggagagagagaatatgaatgaagactctggaaaaatataccttttgaaaaagccacaggccaggtgcggtggctcacacctgtaatcccagcactttgggagggaggccgaggcgggtggatcacgaggtcaggagatcgagaccatcttggctaacatgatgaaatgctgtctctcctaaaaatacaaaaaaattggccgggcgtggttgtgggtgcctgtagtcccagctactcgagaggctgagacaggacaatggcatgaacccaggaggtagagcttgcagtgagccgagatcccaccactgcactccagcttgggcaacagagtgagactccatctcaaaaaaaagaaaaagccagaattctgtgttcacagaatcttattttgcctctgaacactgttattccctgactggtggtggagtggcaatcctgatggaaggacctacaggaccagaaggagccatattcatgtgccacctcagaaacctctgtcgctgctcgcccattctacctttagctctccaatgtgatcactgacttaaaagtcaaagggcagacaaatgcttcaaataaaactagataacagatatcccttgcaaaaaggagtcctagaatcgctatggaaaacacacacacacacacacacacacacacacacaggcatgcatacatatgtgcacaccttagttgtattctgtggatatttagatagatatttaatagatacttaaagaaaggacaagtaaacatcctagggcaaggaatcaagctggaaacttgcttcatccacatgacattcagtgaaagctgagaaaaagggaaaataaactgaagcaacatgaagtaaagaggttgcctaagaagagtcccttgtatgaaaacagatgtttatacctaaacatataaagtgttaatacctaaactataaaaaacccaaaacctcccaagtgtttgcagctgaagtcatttccagcttttcatgactgtcatgggtagctttggggaatatcatacatgaagggaatcctctttccatgggaaattttgacaatttgtggacacaagaaaaagggtgaagcctgaggcatgtgacacatcatctgaggcaccttttcggtggggatttctctcaggaagaggtccagcagctctctgtttggatgtgactttgctcttttattcaactaatatttggattaatacatcttcttctgtgagttttcacatcagtattccctcctctttaccttgtcttttcccccaaacacacaccacacacattgtgagtcagtagctcacccccagtgggtcagagaactaacttccagcaatcatttctccccattacaagctgtggggaactgtgtgggcctgcagattgctcagggctcccctaacagccccacgctgtacgctgtgtgccttgtgctcacagagcatcaaaagatgctcacagagttcaaaagagagcatcatattgaagacctggctccttataaatgcagtctgtcatgtttgagcagagattctgagacagttgtagcttgttgccttatatttggctgctgctaaagtgtggcccatggacctgcagcatctgcaacacctgaccgtttgtcagaaacgtagaacctcaagcccacaacagaactgcagaatctaaatttgcaatttaacaatgtccccaaatgattttagctgcacatcaaaatttgagaagtactggtttatggcactttatcgcatttattttatttaagaaatagttgcattaattactataagccaagcactcttaaaaacacatttttcgactcaggaggctgaagcaggaagatggcttgaggccaggagtttgagaccagcctgggcaaaatagtgagatcccatctctaaaacagtttttaaaaaatcagtcaggcatggtggtgcacacctgcagtctcagctacgcaagaggctgacacaggaggactgcttgagctcaagagttcaaggctgcaatgagccatgatcatgtcactgtactcaagcctaggcaacagaccaagaccctgacttaaaaaaacaaacaataaaaaccacgtttttcaaataactcatttactcctaagaacagccccctttataattgtatggtcaatagatactattaagcttccattttacagatgaggaaaccaaggcatgaaagtgtgaagtttttgcccaaagttacatggccagtatggagtggagaggagattagaactccagaatccattgtatatgccacaactctatgctgcctaccccttggacacatacaagaaataattagaaggtccaggtatggtggctcatgcctgtaatcccagggctttggggaggccgagttgggaggactgcttgagcccaggagtctgagactacagtgagttatgatcatgccactgcactccagcctgagtgacagagtgggaccatgtttcttaaaaaaactgttttaattttttaaaaaagaaataattagaatggattttaaggatgaacaacttgcaccagtaaaaaaaaaaaaaaaaaaaaaaaattctgacaggtgtttacaacaataattgtggaagctacagattatagtagagatgttctactccaaagggactattcactgagggaggcatgtaagaagtgaaaggttttcccatcccatgccatcgagcacccaggaaaagcaggagtgacaatttgctaaatagaggacacactaggttaaaaattattacatatgaatatgtctttaggacactgtgaatgtaagtctgactggtaaagtaaaagggtttaacctgcatgcctgagaaccttagcctgttaatgcccacaaaaaaaattagaaactgaggagaaaagaaagattttaaaaatggtattttcttgctttacttttcaaagtcaggtcaaaatactttaaaactagttgcagaccactggtagagctaggcctctggccttctggaaccatccatgtggggatgtgactctggctaacccagccattcacccactttctacttttgtttctgggccttgcctccttttaaaacacctcatgcacaactctgatctccaatttgtccacagacttggattttccgggctgcttgtttcatagttcccagggcagcattcaacagaaacactgggaaatagcacctcaggctgccatattttcctgaagcctccagaaagtggatttcattccagtcgaaacaacacttttaacacatttagaaatgtcattaacagtattgtatagctatcagcctagaatctgtgaatttactcaatcttgagtccagatggcatgcacaaaggacagagggcagttatatcagattccgacaatgtgagaaaaaccccaacagcaatttgttctccagtaactccagaaaaagcctagaaacccctcaaaaaataactttttatgttcatgaaaatacactgcttctgcaaatttaaagaaatgtactagtaagccaattatgcaaaaaaggcaacattttgggttaattctaagaagcaaaaggacttcattgattctttccacaaatatttactgaatagtaacaatgtgccaggttactgtgctaggcctggggattcaatggtgaataaagagggacacagtctctgctctcatggagctcaaggttgggtgggccaaaaagatattaaccaacaattcccacgaatgaacatatcattacaaatggagataagtaacacaagaaatacttagaagataatattaaaagaaagaagataataataaaagaaagatgagagggccagggaaggctgaaaaagtgtcccctgagctgagtttacagtttgagaacagctggatgtatccagtgcacaggagctagatagggagtgagagcagaacacactggagaaactgaaattcagaaaagaagagagtggttgatgtacagagagcctagaggagagagggcaagatgaggtaggagaggaagcctttttggccctgcatggttaagaattatgactcacttgaagggttgtaagcaggggcaaggtgagcagattagcacttcaaaaagatctctctaggtacagtgtggaggactgcattggagggaggccaaaggagagatgggaaggccagttaggaatatttgaagtgctccaagtgagacaattagggtaatcataagggagatggaaagaagtagacagatttgagagagatttaaaaggtaaaataataggacttggtgatgaaatcaacatgggagttcatggaaaaggagagctcaaggatctttccaagtttgttctggcttcccgtaagtgggtgtacatggtcacattcactgagagagcaagcctggaagattagttttgtgggaagaatcctgaatccattgttggacttgtggagtttaaaatgccttacaaatacctggcaggagatgatttataggcagttgggtcaattagttatgcaagtctgagatgcagaaaagaggaccgagctggacatttactaagggagtcactgtcacatacaaagagaactgaagctgaaacgtaaataagagacgaaacgtaaatacctagagagaatgtctgaggttaaaagagaagtgagcaaaaattgatgccttaaaatattctaacactcaatagctaggtagaggaggataagcctgcaaaggagatagaaaggaatgagccaaagaggtgggagaacagcaagaagactgtggggtcttggcagccaggaaaaggggatgcgtccagaggcaggcaatgggcaacacagtcaatggctgaaaggtgatacaggcaaggggaaaacaccctttttatttactgacaaggtcactagtgaccttagcattgattcaatgaagtgacaatagggcaccatgaagtgacaaatgccagaactcagtgggttgaggagtttatgagaagcaagaaaatggagacagtaaatataggcaatcaaacagaatcaagcaggaaactcaattagactaaaagccaaagtcctcacaataatctgcaaggccataaaatctgccccctcactacttctcttctactactcttcttttctcactccagccacactggcctgcttattctttgaatgcaccagcttccacctcatggcttttgcctttgctgttcctttaatcaggaactttcttccttcacagaaataaatggctgctccctagccctcaggtctttgcccccaaaattattctctcatcaaggtctctcctaactacttcatttaatattaaaattagcctctcacccctgaactcccttcactattcccttccctgcctttatttggtatttcttactctctaacatatcatgctttgtttttgtttatttatctcacctcctgtcccatgtaagtttcttaaggttggctattttgttcactgctatattctcaatgcttagaagagtcactagtacatagtatgcactcaataaatgtatgttgaataaaatatttgaataaattaaataactttaatatatactatcaaatagcaacaagaaaaaaaaaaggctaaaaaagctccactcatggcagcaataaaatgtagggggaaaattagagaaacaaaataaaatgaaaaataaagcataagttgattgtattaggaaaacttcactgactgacataaaaaagacttgaataaatgtagagacatataatccctcttaacaaaaaattggcttgcagagatatcaattctctttacatcaatttagaaacgtatcctatttccaattaaaattcaatggaattttaaagtccttttgggaggaaaaatatgcctgaaaatagccaagatttttttttttgtggggcggagggagacaatgaggaagggaggccacataaaatattaaaccatgttataaagcaacagtattgagctaagaacaggtagatcaagaaaaaaaaaaaagatccataatgagatgcaaatatatgtttttcaaagttgtacacacattaaattatgtattttcaagtcagtagagattcatcacatggaagtaggaaaaatggttaaccatttgggggaaaattatgttttctatcatgtgctaaaaattcatatacacaaaaattcctgaggcattagatatttaactccaaaataaacccataaaatacttataagaaaataatgtcaatatttatctactgagctcagtagagagagttttaacatacgcaaaaggaaaaagtgaagaaaaagattgacagtgatagatttggctgcataaccatataaagcttatattttgcaaaaggtattacaaaatttaaaacaagacgaacattttaggaaaatatttgcaacctgacaaaagattaggatctctaatatacgaagacctcttagaaatcaaaagaaaaatacaaattcctaacagaagaaagtgagcaaaaagaaaattcacaaattagaaatacagatagtcaataaataaatgaaaaagatgtccaaactcactaggattcaaagaattgtaaagttaaataatgttataccatattcagatgttagatgatggagatttagaaaggttataatagttaatgttactgaatagataagaaaatgggcactcttatagactgctgatgttaaactctgaaaagcaattaggaatacattaacccacattttttttttttttagatggagtctcgttccatcgctcaggctggagtgcggtggcgcgatctcggctcactgcaacctctgcctctagggttcaagcgattcccctgcctcagcctcctgggtagatgggactatagggaacagtgtgagccatagctagagtcaatctggctggaagcaaagaaagaggctgagatctaggagggtaggtgaagttgagtagccattcttttttttttttaattttattattattatactttaagttttagggtacatgtgcacaacgtgcaggtttgttacatatgtatacatgtgccatgctggtgtgctgcacccaccaactcgtcatttagcattaggtatatctcctaatgctatccctcccccctccccccaccccacaacacttcccgatgtgtgatgttccccttcctgtgtccatgtgttctcattgttcaattcccacctatgagtgagaacatgtggtgtttggttttttgtccttgccatagtttgctgagaatgatggtttccagtttcatccatgtccctacaaaggacacaaactcatcattttttatggctgcatagtattccatggtgtatatgtgccacattttcttaatccagtctatcattgttggacatttaggttggttccaagtctttgctattgtgaatagtgctgctataaacatacgtgtgcatgtgtctttatagcagcatgatttataatcctttgggtatatacccagtaatggaatggctgggtcaaatggtatttctagttctagatccctgaggaatcgccacactgacttccacaatggttgaacgagtttacagtcccaccaacagtgtaaaagtgttcctatttctccacatcctctccagcacctgttgtttcctgactttttaatgatcgccattctaactggtgtgagatggtatctcactgtggttttgatttgcatttctctgatggccagtgatgatgagcactttttcatgtgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctcttcagtttaattagatcccatttgtcaattttggtttttgttgccattgcttttggtgttttagacatgaagtccttgcccatgcctatgtcctgaatggtattgcctaggttttcttctagggtttttatggttttaggtctaacatgtaagtctttaatccatcctgaattaatttttgtataaggtgtaaggaagggatccagtttcaactttctacatatggctagccagttttcccagcaccatttattaaatagggaatcctttcccattgcttgtttttgtcaggtttatgaaagatcagatagttgtagatatgcagcattatttctgagggctctgttctgttccattggtctatatctctgttttggtaccagtaccacgctgttttggttactgtagccttgtagtatagtttgaagtcaggtagcgtgatgcttccagctttgttcttttggcttaggattgacttggcgacacgggctcttttttgtttccatatgaagtttaaagtagttttttccaattttgtgaagaaagtcattggtagcttgatggggatggcactgaatctataaattaccttgggcagtatggccattttcacgatattgattcttcctacccatgagcatggaatgttcttgcatttctttgtatcctcttttatttcattgagcagtggtttgtagttctccttgaagaggtccttcacatcccttgtaagttggattcctaggtattttattctctttgaagcaattgtgaatgggagttcactcatgatttggctgtttgtctgttattggtgtataggaatgcttgtgattttttgcacattgattttgtatcctgagactttgctgaagttgcttatcagcttgaggagattttgggctgagacaatggggttttctagatatacaatcatgtcatctgcaaacagggacaatctgacttcctcttttcctaattgaatacactttatttccttctcctgcctgactgccctggccagaacttccaacactatgttgaataggagtggtgagagagggcatccctgtcttgtgccagttttcaaagggaatgcttccagtttttgcccattcagtataatattggctgtgggtttgtcatagatagctcttattattttgagatacataccatcaatacctaatttattgagagtttttagcatgaaaggttgttgaactttgtcaaaggccttttctgcatctattgagataagcatgtggtttttgtctttggttctgtttacatgttggattacatttattgatttgcgtatgttgaaccagccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctctgcccggctttggtatcaagatgatgctggcctcataaaatgagttagggaggattccctctttttctattgattggaatagtttcagaaggaatggtaccagctcctctttgtacctctggtagaattcggctgtgaatccttctggtcctggactttttttggttggtaagctattgattattgcctcaatttcagatcctgttattggtctattcagagattcaacttcttcctggtttagtcttgggagggtgtatgtgtcgaggaatttatccatttcttctagattttctagtttatttgcatagaggtgtttatagtactctctgatggtagtttgtacttctgtgggatcggtggtgatatcccctttaacattttttattgtgtctatttgattcttctctcttttcttctttattagtcttgctagaagtctatcaattttgttgaccttttcaaaaaaccagctcctggattcattaattttttgaagggttttttgtgtctctatttccctcagttctgctctgatcttagttatttcttgccttatgctagcttttgaatgtgtttgctcttgcttttctagttcttttaattgtgatgttagggtgtcgattttagatctttcctgctttctcttgtgggcgtttagtgctagaaatttccctctacacactgctttgaatgtgtcccagagattctggtatgttgtgtctttgttctcgttggtttcaaagaacatctttatttctgccttcattttactatttacccagtagtcattcaggagcaggttgttcagtttccatgtagttgtgcggttttgagtgagtttctcaatcctgagttctagtttgattgcactgtggtctgagagacagtttgttataatttctgttcttttacatttgctgaggagtgctttacttccaactatgtggtcaattttggagtaggtgtggtgtggtgctgaaaagaatgtatattctgttgatttggggtggagagttctgtagatgtctattaggtcacttggtgcagagctgagttcaattcctgggtatccttgttaactttctgtctcgttgatctgtctaatgttgacagtggggtgttaaagtctcccattattattgtgtgggagtctaagcctctttgtaggtcactaaggacttgctttatgaatctgggtgctcctgtattgggtgcatatatatttaggatagttagctcttcttgttgaattgatccctttaccattatgtaatggccttctttgtctcttttgatctttgttgtttaaactctgttttatcagagactaggattgcaacctctgcctttttttgttttccatttgcttggtagatcttcctccatccctttattttgagcctatgtgtgtctctgcacatgagatgggtttcctgaatacagcacactgatgggtcttgactctttatccaatttgccagtctgtgtcttttaattggagcatttagcccatttacatttaaagttaatattgttatgtgtgaatttgatcctgtctttatgatgttagctggttattttgctcgttagttgatgcagtttcttcctagccttgatcgtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattcgtccccactctcttctggcttgtagagtttctgccgagagatcagctgttagtctgatgggcttccctttgtgggtaacctgacctttccctctggctgcccttaacattttttccttcatttcaactctggtgaatctgagaattatgtgtcttggagttgctcttctcgaggagtatctttgtggcattctctgtatttcctgaatttgaatattggcctgccttgctagattggggaagttctcctggataatatcctgcagtgttttccaacttggttccattctccctgtcactttcaggtataccaatcagatgtagatttggtcttttcacatagtcccatatttcttggagactttgttcgtttctttttattcttttttctctaaacttctcttctcacttcatttcattcatttcgtcttccatcactgataccctttcttccagttgattgcatcggctactaaggcttctgccttcgtcacgtagctctcgtgccttggttttcagctccatcaggtcttttaaggacttctctgcgttggttattctagttatccattcatctaattttttttcaaagcttttaacttctttgccattggttcgaatttcctcctgtaactcagtcatttgatcgtctgaagccttctctcaactcgtcaaagtcattctctgtccagctttgttccgctgctggtgaggagctgtgttcctttggaggaggagaggcactctgatttttagagtttccagtttttctgctctgtttttttcccatctttgtcattttatctacctttggtctttgatgatggtgacgtacagatgggtttttggtgtggatgtcctgtttgttagttttccttctaacagacaggaccctcaactgcaggtctgttggagttttctagaggtccactccagaccctttctgcctgggtatcggcagcggtggctgcagagcagcggatactggtgaaccacagatgctgctgcctgatcgttcctctggaagttttgtctcagaggagtacctggctgtgtgaggtgtcagtccgcctactggggggtgcctcccagttaggctactcgggggtcagggacccacttgaggaggcagtctgccctttctcagatctcaagctgcatgctgggagaaccactactctcttcaaagctgtcagagagggacatttaagtctgcagaggttactgctgtctttttgtttgtctgtgccctgcccccagagaggcaggcaggcctccttgagctgtggtgggctccacccagttcgagcttcccagccgctttgttttcctaatcaaacaactaactcagtaatggcgggcgcccctcccccagccttgctgccgccttgcagtttgatctcagactgctgtggtagcaatgagtgagactccgtgggcgtgggacccttcgagccaggtgagggatataatctcctggtgtgccgttttttaagcccgttggaaaagtgcagtattagggtcggagtgacccgattttccaggtgccgtctgtcacccctttctttgactaggagagggagttccctgatcccttgcatttcccgggtgaggcaatgccttgctctgctttggctcacgcacggtgcgctgcactcactgtcctgcacctactgtctggcactccccagtgagatgaacccggtacctcagttggaaatgcagaaatcacccgtcttctgtgtcgctcacgctgggagctgtagaccggagctgttcctattcggccatcttctgtgtggccattctgagcatggtgcatacttcttgcaacaaacttacccctgaatagaataatattcaccaataaagcctagttgattgtttattctccttttcctgaaccttcctaagcagtttgcatttttatttgtttatgcatgtgtatacttattgcataagacaaaatactccttaaggtcacaagttataatatattcaactttgtattcctctgtgcctacagtgtacattcaatgaatgtttaacaataataattaatattcttaaatttgttctgctctgacagttatcaaattctgtaagtatggaagatttaggaagtaatctgtaaagtaactattgattgtgaatagcaaattattccttttagagaagctataatttatattaacaaataaggagctttaactaatttacaagatcaaaatgcaatattttttgtgatttcctcatccatattatttcacagatgctaattctggaagcatgtaagcatatggttagagacagattaacatggtacaggagttttcctctattttaggaatgagaaaaatcaaaatgctatttgggagtgtgaagcaccgtattttgtcttaaggtagtattaaactattggttcattcattcaatgttgctttagcatctaatcaacgcatgatgtcaggtagtgtgagagatacaaagacattgttgcattcatgatgcttacagtctagcaggcgaaagaagcagaatagaaattaccataatacaagttagtattgggtaagttcctttatttttattatattattacttctaaatgttagtttactgtgactacccagtaactaaccatagagggatagcttatgaaaagtagactacaaaatattaatttaagaatctctttctaacttttatgtaccttggagtagtcaagataaaactggctgggtgcaggggctcacacctgtaatccgagcactttgggaggacaagacaggaggatcacttgagtacaggagtttgagacgagcctgggaaacacagtaagaccccatctctagaaaaaatgtttaaattagctgggcatgggggtggatgcctctagttccagctacttggaagcctgatgcgggagggttacttgagcccaggagtgtgaggctgctgtgggctataatcacactactatgctctatcctggatgacagagcaagaccctttctcaaaacaaaaacaaaaacaaaaacaaaacaaaacaaaacaaaatactgtgtgggcaactgtccatcaacttttcagtaacaactataatacaaaattatgagtagtttttaggtttactccatctcataaccttcacttaggaattgacaaaaaatcctaaccaagaattcaatgcttttgaaaatactattactgcatggaattaaaggaactggataataacaactacaaataaagagaaactatggatttatcagggttagttcataaacaaccagacagctgcccaatagagactaacttaaacagcatgcctttccataagaatatgctaccactaaaatcctgagctggtacctacaatccataaaaatcaaagtatttcaggcctgaaaagctgacagaaaaaatcccagaagaagaaaatgatactgattagaaagtgatgtgagacttatctaaagttacacgaccagttagtagcaggggcactgaattttggtcacactgatcttttagattaggtaaaatgcacctaatatgtattttcaaaatataaactcctcagctaaattggacaaaaagttgataaacttttttctaaaaattatcaagcatttgaagtgtttctattaagagttgggcactgaggttacaaaggcaaaagaaaagaaagcatggtctctgccttgagtatggggagaaaggaaatgaaaactatgagaatatccagtgtgagcagtgctggtgtaggagtatgtgcaaggtactagggcatcaggaaagtgtccagaggggaggagctatatggaaacagcctagaaaaaaatgagagggtgctcaccagacaggtaagggcgagagaaaggcacttactgggagctgcatgtgcacagcaccgatgcttggagcagcctgggacgctgcagtgaaagaggaatgcagcaagagataatgctggagggggagtggagtcaccgtgccagacaggcagggccttaaattaaatgcccctagaaggagtctgaacttatctgtaaggaacaggcaactgttgaaggattttaggaagagctgcctgctcagttctgtgttatagaaaaatgacttcagtgtcagtgccgagagtcctggagggggcaagcctgcagattagaatactaggataataatcctggttagagatgaagtagcttaggaaaccaaaaagggagagagggataagccgcactgatttcatcctttgcctataataaatataaaattgccaacacattttcagaagaggaaacacctccccaacaattttatcagtgactttcatcctgtttattactgtgaagtaaagtcagcttaagactacatcacataagattgaacaaataaagccctctcttgaaagcatcaacctctaatgtagaatattttgttaagcttctcatttctcagaaagaagttctgaaattttataaataaatgcagaattctgatatttaaaggaaatgcagccacatcgttatgaaaatgcttcccttcaccccatctactttctcacttccttcatttatactacaaatttggacctgtggatgttttaaataatagacaacaggtgtactaaacaatgtcacttgccataatattgaatagatgcccaattaacaccaacattaagtataaatgctctttcaagtatctggtatatcactgatgtgaatgttttaaataattaaacacaaagctcatctatctagaattttccaagcaacagtttcacaagtaaatattcaactgagagttacatcagacaaacatttaatgcttattagtcaatctagaaacttgttcaatttactttttcactttattaggtgacagggatccaaatgtttgaaaaagtaataggtccaaagagtccttctacctacccatctttttttctcccatcagttagagtcatcgataatcaatggcataaatttagtaatgactcatttacatatttaaactggcattttgaaatgacaatgagaagctgacagttaactgttctctaaggaaatgccctttctctccatatggcttccactctgagactaagaattaaagagatttttcaatttatggaacaagagagagtctctccagctgagactcccatgtcatttcatttagaatgcaaatctcaacattttaaatgtcattcctactgatgctaagaaggcagttataaaatgaaaaatcaccctcaccatagagctttggtaaattaaaaagtaaaggactttaagactttaagggaaaataagttttctcatgttagctaggccgcatgtatggtgggaaataccctcaagaagctatgttaccttagctcctcaccttaaaatgaaaatactaattcctgttgcaaagattacataaaataatgcatggtctgattgtaaactataaaggtttgtgtaaacatatgccattattactttagacttccactgatatgttgactcaaaataaaaagactgtaaaatgatcctgtgggccagaggaaaaatcaaaagtaccctgaaaaacatagttactaaaaatgcacgtgaacgaattagtttacagattcaacacaatccttataaaactctcagctgtgttttttgaaaagatcgaaaactaatcctaaaattcacatgaatactcaagggaccaaccacagactaaaaaccttggaaaagaagaacaaagttggacaattcgtacttcccgatttcaaaacttagaacacagcaacagtaatcaagacagtatggtactagtataaggataggcacacagagcaatggaaaggacttgagagttcagaaatatattcttacatttatggtctattgatttttgacaagggtgtcaagaaaatgggaaaacagacgagtgctttcaacaaatggctgttgacaactgaatatccacattcaaaagaatgaagctggatcctttcttcacaccatacacaaaaattaactcaagtggatcatagacttaaatataagagctaaaactataaaactcttagaagaaaacatttaaattatttctgacctttggttagacaaagactttttagcgacaatatcaaaacacaagcaataaaaggccacagaatgtacaatatccatagcaggcaagtctagagaggcagcaaactagtggttgcctagggccggagtggttaggggaaatgaggatgactgctaatgggtacagggtttctttttgaggtgatgaaactattctaaaattggttgcaatgattgttacacgactctgaatatataagaccattgaattgtatgctttaaatgggttaattatgtagtacgtcaattatatctcaataaagctagttaaatataacttaaagaaatgtatgtgaaaagccgcattgagtagtggtcatgaccttcatttgttaaacatgagtttgaattcaggtcctactaactgtggaatcttgagcaaataacaataattctgagcctgtttttctcatcttcaaattctataataaaaattcctttctcaaaggaatgagtattaaatgagatcatgcagactaagtgcttacttggcacagcctagtatacagtaagcactcaataatattagctattaaaagaagagatatgtgggcctagactgtaggtagttgctaaaaacaaaacaagacaaaaaccagtaagttggttgaggcatttctgtaaatgttattttttaaattatatataaacttaataacaaacagggtgcttccaaataggcaggctcactttgaaatactcagtacaaagcgaaagaaggtcataatcataggtcacagaggctggatttaccgtttcacctaaaacagctagaaatccaaatacatgaaataatgattttcagacatcatataacagcataagaatacaatccatgagtaaagggcaacaagcaaggtgagcctacatttacaccaacttgctgcctggaggcagtctatatgctgcagaacaggagggaaaatccaaactgcacccagtggtctcaccgagttgaggagagagagaacaaaattcagggaagccaaggcagattaaatttgtggtgcagagggaagaggaaggaatgctttagataaaaggagctccagagatgtgaagagtaggctaatttaaattagccctagtctaaagactcctctagtcatgccaaacaaagaaagcttaaaggcaagcttccaaaagagccaaactcaactgcaagccacaacaaagtataggaaaacaatacagaaaccagtaccgaacaagtttatatatctggcatccaattaaatgtaactaggcttgcaaagaagcagaaaacagttccataaccatgagaaaaatcaatcaataaacccagaaatgacagagatgatggaattggcagataagaattttaaaagttataaatatgctccatgtgttaaaatggaacttctagaggtgaaaaatacagtacgaatacaatatgaaaaatgcaataccactccactttttggtgatgacactaagacagaggcaaggtttggtgccaactcacatagtggcagagcctagagggaacccaactttcctggctctgatccagggctctttccactatgctgcagagaaataacacaatctgacagacactttagttggttactggctgctgtatgcctgggccttaggtggaatgtagaggcagcaagagtagaagtaggagtctgttataatagacatggtgataaacaagtgatggtttggacctcagtggtagaaaggaagatggtaagaaacggttggatattaggtatattttaaagagttggtagggttgccaatgggttggatgtagcatttgaaaagaggaaaatgcaggaagacttcaagtttctgacttgaacctctagcaagggagtagccatttactgtaatggagaaaactaagggaggagcagcctggggagaggagtcaggaattcggttctgtatgtgataagcttgggatgccatcagacatggaagtcaagtatgcagttactgcatatagctgtctgaaattcaagggagacattgaggtcagagatatggaaagagtaaagatggtggacaaatgactaaaatttggaagctctgggctttaagggtctttagataagaggaatctgtgatccaataatgtggcatcatgttcctcaggcaaagcagtctcttgccagtctcacagagagtccttcttatcattatggcttctcacactatttgtcaggattatccactttctttccctgtgtttctgcattatctatctcgcatagctactgtgagcattacataagcgatatgaatatctggtaagcactccatacgtgttagctgtatcttatctgaaacagataatcctgtttctcaaaagtaatatggtttcacttgtatgtgaatgttcataatgcctttacttacaatagcctcaaactagatacaacctaaatgtccatcaattaatgaacggataaacaaattgtggcaccttcatacaatgaaatgttagtaataaaaaggaactactgatatatgtaaaagtatgcatgaatttcacatgcatgacattgctcaaaaaatgtcagatgcaaaaataatacatgttgtatgattccatttatgtgaaatactaaaagacaaatctaatctgcagtgacagaaagcagatcagtggttgcaggggactgggtctggggtagcaattgactaggaaggggcacaggaaacttgtgttatgaaaatcaatcctgattttggtggtggttaaaggggtatataaatttgtcaaaactcattgaaatatacactttaaatgggttccttttattgcatgtcagtaaatcagagaatactgcatatcggttagctcttctcaaaagtaatatggcttcacttgtatgtgaatgttcataacgccaatgtgtcctcttccaaattgtctcccatgttactttacaatcctaagtagggctctactttttatcttgagctacctcaaggggagttctgtagggtgtttttttaatctaattaaaatatgaaataggatcatatttttgacttatcttggtaggctgattgctttatggctggtcttaggattttaatggtttttcttttttcttctttattctcccacttaggttcagattatatatttcttagtgacactatggtttcattgtagctttgaggctttcagtgctattcagtttctttaatgcttggctttggttatgctgccatttcaatctcacaaaggctctctttcaaaaattgtgttccagagttactgtttccaagaagaataaatatattgcaggttttatgcttatgtcatgagaatctactttgctatgagacaaggaatctagaggtcatagtctttctgttccatttacctttggttcaagtgactctttcaaccctttaaaagttagatgacttttctctcttgcctctccaagttcaatttctgctaacactgaataagggagaatagtagattatgtttaagatgtatataaatttgtagttctttagataagcaaactaccatattctccattaaatctgacaaccttttgttgtttatagttgttgctgctgttgcttaaggacgactgagcaaagcgcctgcaagcaattttaggtcatacatttcactgataacttcagttttgactaattctctaataacacagtacatggaacaatgaaggtgtttattctagcattatataaaataccatatttcaaaacttctaagatgcacagtttaacattgtgaaatctgaatgtttcttaaaatttattggccttgtgccaacacagttaccattgcttgttctgtgtgaatcaggttgttattccttctaaaatggactaaataactgcaaacctcgatgcttcctcaagaataaaagtcgtggttattgtctgagaaacttccatcaacgtcttccattaagatcaggagtgtcaacatcaatacttgcagaaagggtgtaggcatcttagaagaaaatactatagaaaatagtttgctgcatccctaaatattttgatgtcacagaggttgatgtgaaacacaacatcagtactctaaatcaaaaggtgatttggaagatttggatgtcattatttttatttattttattttattttcagacagtgtcttgctctgttgcccaggctgagtgcagtgggtattcacaactcactgcagccttgacctcccaggctcaactgatcctccctcctcagcctcctgagtagccagtactacaggtgcaagctgccatgcctgggtaatttttgtaatttttttgtagagacagggtttctccatgttgctcaggctcgtcttgaactcctaggttcaagagatccacctgcctcagcctcccaaagtgcagggattacaggcgtgagccattgcagctggccaagacttggattttaaatatgaagaagttttagaattattttaaacaatttgaatatgaagaagttttagaattattttaaacaatttgattagcctatttccctttttatatatgtacaagagtgcaatatgataaaaatctataactcaacaattttaagggagtcctttcaggaagaattttaaaattctaagtggtaagaattattttgccatagtttaattggtacataaagtaatggtttgtcttagtctttggcaacttagatttaatgaaattctaaaagaaataattagaaacaatctaaatagtcaacaacagaacaataattaaattaattaaataaataatgagattacaacaaatataaatctttttggccaggcgcggtggctcacacctgtaatcccagcactttgagaggctgaggcgggtggatcacaaggtcaggagttcgagaccagcctggccaacatggtgaaaccccgtctctactaaaaatacaaaaaaattagctgggcgtggtggcgcacacctgtagtcccagctactcaggaggctgaggcagaagaatcgcttgaacccgggaggcggagattgcagtgagccgagattgtgccactttactccagcctgggtgacagagtgggactccatctcaaaaaaataaaaaataaaaaataaatctttttttaacagctttgttgagttatataattcatataccataatgttcacccactgttttttactatattcacagagctgtaaaactatcactacaaccaatgttagaacacttttgtcatttcaaaaaaagaaatcctatactctttagctctcattcatctattcttcccattacccacaaacctgagtaatcactaatccactttctatctctatagacatttcacataaatgaaataatataatatgtggccttttgtgactggcttctttcacttagcattaatgttttcaaggttcatccttgttatagcatgtattagtacctcattcctttttatggttgaaaaatattccactacatggatacatcacatcttgtttattcattcatcagatgatgaacatttgggtacatcttttgactattataaacaatgttgttatgaacattcatttatgtttttgggtggacatatattttcagttctcctagctgtatatctaggagtagcattgctggggtcatacgccaattctatgtttatgttttagaggaattgctagactgttttccaaagtagctgcatcatttcacattgctatcggcaatatagaagggttctgatttctttacatccttgtcaacacttattatctgacttgttgattatagtcttcctagtgggtgtaaagtagaattcccatggtagttttgatttgcatttccctagtggctaatgatgttgagcatcttttcgtgtgcatattggctatgtgtatgtcttccttggagaaatgtctattcagatcctttgtccatttttacattgggttatttgtctttttattattaagtattctttataaattctaaatactagtcctttatcagatgtacaatttgtaaatattttctcccattctgcaggttgtctttcactcttttgatagtgttttttgaagcataaacttaaaaaatttgcggaagcctaatttaacaattttttcttttgtagcttgtgcttttggtgtcacatataagaatccattgccaaatcgaagttcacaaagatttagctctattttttcttctaaaagtttaatagttatagttcttacatttaagtttttgatacattttgaggtaatttttgtagatggtgtgaggaaagtgtccaacttcattcttttatatgtgactatccagttgtccccatatcatttctcaaaaagactattttttcccccattttacccttgaccttggcattcttaatcttggtgctttcgttgaaaatcaattgacatgaatatgtaggtttatccctggactttcaattctattccattgacctatttgtgtatcgttatgctagtaccatagtgtcttaattactgttgctttggagcaagttttgaaattagaaagcatgaatcctccaactttgttctttttcaagattgttttgactcttctgggtcctttaagtttcctcatgaattttaagatcagttcatcaatttctgcaaaaaacagcagctggtattctgagaaggactgcattgattctgtaaatcaatttgggaagtattgccatcttaacaaaaagttttcctgtccatgtacatgtgattttttccatttatccaatcatttttaatgtacccatagaggaatggcatgatgcagatatatcactgggaaaatagaaataatatcccttggttatgggattagagatcattttgatcttatttttgtatatttctatatgtttccaaattttcaacaacaagagtatcttttatataacccaaaagaagttatttttaaagaaaaaatatctttaataaaatatacacatatcctcaaagacctaaagacagaaataccattcaacccagcagtctcattactaggtatatactcaaaggaatataaatcgttgtattataaagacacatgcacctgtatgttcactgcagcactgttcacaatagtaaagacatggactcaacctaaatgcccactgatgatagaccagacaaagaaagtgtggtatgtatatgccatgtgatactacacagtcataaaaaaaaaactagatcgcgtcctttgcaaggacatggatgggactggaggccattacccttagcaaactaacacaagaacagaaaaccaaatatcacatggtctcacatataagcgggagctaaatggtgagaacacatggacacatagaggggaacaacacgcactggggcctatcagagggtggaagttggaaggagggggaggatcaggaaaaataactaatgggtactaggcttagcacccataactagtcggcactaggcttagtatccataactatagtgggcactaggcttagtacccataactaatgggtactaggcatgggtgatgaaataatctgtacaacaaacccccacgacacaagtttacctatggaaaaaatctgcacatgtacccttgaatttaaaataaaagttaaaaatatacatatttaaaatattacataaatatggaaaatatctgaaaatgaaaatgtttgaaacattttccaatatacatgaacataccactgtttattcttggtcacattttcatcagaatttgctgattgtgtgctacatggtagatactgtgctaagtactgagtacactgtttttgagaaaacagatatgatttctgccctcaggaagcctacatttagtgacagaatgacaataaacaggcaaagtagcaaacagaaatggaattataagttgtaaagggcactttgaaagaaagcaatcagtactatgatggacaataacggcaggataaagcaaatctattttgatatagtggtcagggaagctctctctaaggcatcaacatttgagctgagacttgggaactcaaaaatgttaagcactggctttcaatatttgtcaaaggtatgttcaacataagcagtttcttatattgaacggtaaaaacaaaaagctttaaaattccaaagggaaaataatttcaacaaatagagtaacctccaccaccttctataatatggtatgcagggtccaaaaaatccagtaccataaaatatgtggtaaagtcattgtaaggttaatgaaatgcactgaaagagcttacggtggtctcactctgctgcccaaatccagcggggtcccagccgcagtttggagctacttgatcatagctttctgttctaccttaactattgatggggatgattctgggtcccttttataggctaaagttccttggcagaagcagcaattccaagaatctagttagctgatgccttttttgtcagcctgataggaagactgggccaagagaatattgaaagcacaaagcaccaccccttacctccctgacatttcccctcacggcccagtttctcttccacttatccttcccccacacttaagatttccagcctactcctgtttagaatgagggttcagcggaggaccagagcaaatatacttgaatgtggattatcatgggatggggggtttattataggtattaaccgctacttgcccacccaatatctatttcctgctcttagtaacagaacccagattttgtttaggaggtaatgtgcctagttgaattatatgcttcctcggactctactgaagtaggcatggttaagtgatgtagtttgaccaataagatgtcaattaagggatttgggaaagctctgctttaatgatacaggcacaacttatttccacttccttttacatcttcttccctagaatttggggatgaagagggagacagggcaatcacctttggactatgagataaccatgaggatgaatgctttatgtgaaaaatggtgttggagaaaggtagaaggtagctggggactgacaccaccgcagagctgctgccccaacctagatagcctacctccagatttctactaggtgacaaagccaacccttacttgactatggttaggttactgtgatgacatatagtcatctgaaattctaacagatacagctgtctaccaggaacataaatttaacgtctttagatgaatccaaagtttttaaggttttaatgttaaaaagtccaactctcatgtctgatagaacaggaatgcacaaccctccaaaccacatcacccactacagagtggtaagtacaggtcattaaatgaaagcagcacagaaaagtggcttcagagagggaatcatttaatgccccttaccttcattagccccattccccaagtcttaccacataaacgtaaattccaggtaaaactgtgcttaccaggtaaacacacttccagacaagttccttgttgccctagattgccatccctaaacttctcctacatggcaattctgccacagcataattttcagggcagctccacccacagttaaagttatgatttagggttcattactacacataccttgaaacttttaagcagacacattaaagtaatgcagctcaaggaatgttaacaactttttccacttttgccccagccagtttctactctaatccaaaacggcttctttatcaccacccactttactcaaattacgcttacagaattcattatcctcccgggtagaatcaccgaaaataatgtgagcatttatatagaaagtgtagttcagataaagcaatatattaataggccaaattagaaaaggatagcacgctgctagttttctgtatgcactcttgcccgtgtgaaattaaacttttttgcatccatgcggggagcggtggctcaggcctgtaatctcagcgcttcctaaggccgaggcgggcggatcacttagggtcaggaattcgagaccagcctggccaaattgtgaagccccttctctactaaaaatacgaaaattagccgggagtggtagtgggcacctgtaatcccagctactcgggaagctgaggcaggagaatctcttgaaccaggaggcggaggttgcagtgagccaagaccacgccactgtactccagcctgggtgatagagcgagattctgtctaaaaaaaaaaaaaattgtatccaaagttggagtttgcctttattattgcaaatgagataataacctttcaagtaggaaaacaacaaaaaggaaaactatataatgaaatttcttttactcccagaaccaaaataacgagacttccagatagaaatttgcatggagtcaatcagaattacatattattttcatttccgaacagaattactccatcaagttttctgatatcttcctaatgtttctcagtaaaactttagcaaagtaataaaaattcacctaagaatgatcaaaattgcgttgagtcccaaataaataattttttttattttaagggaaaaattccgcactttgctttcttttttttttttttaggtaggcagggacaatcaggaagcagccccggattttcagaaacgatctttagcatcaccaagacatagactaaagaaacatgtaatgcacaacttaggctgctccttcatccaaggcaattcaaatttccacggataccaagtcttcaatggccggtgtcaaccattcaatagaagcataccagaaaatgttgcgattgccttcttcaccacaagagtctaagtgacacaaatttgggcagaagtaattatttggccaagccgggaggcaggaagcttaaataccgcctctgtaggaagtgcgggggatccgaagcaaacaccccaaagtttgtttgtgagtggaggcgcggaggcgcccggagccacgccgaagctcacctggtcagcgcacagagccgggtaggagtcgggtctagccctagtttgctcctgagcgcttcgttcctctcaggctactgcgtttaaatcaatactgggtggcaaacgatacccattctttgggctctgaagtttggaattcatgggttctgcggcacaagaaagtttcttcacaggttatttccctgtccgaggctgtcgcttagctcatctcctcccggtgcggccctggggtgtccaccaagccgccgggcagatcgctgccccgtgctgcggcatcttgatgcccaggaccccgaggctgtggggcagcccctcctacctgggacaagcggccagaactccttttcccacagggaagaacactccaagcccccggaagagtgcgcatcctaaggagatgtctcccaacgcctagacaaagacagcgctgggaaaagttggaccaactggcacccccgcaaggcgaacagagcagtcccctcggccttcgtggccgagccggctacgcgctctcggagtcgcggccaacttttcccgcgagcttctgagcaacttgccgcaagttggggcgagggggcagagcaggggtcaagggcgcgcggagggactgatctcgctcctgtcggtttcctcgtacctccccgcgtacctgctgatgtatccgtccccgtcgccgtcgcacgtctggaagaggcgccgcatcctctcctcctcgccggtgctggacgtgtcgctgctgctgctgctgctgccgctgccgccgccgccgccgccgctgctggagctccccgcagccgctgccgccgcggccgccatcatgcgcccgctccctacttgggaggaggagtacgcgcgaccgcagctggaatccgcgcggcgcgcaagctgcctgcagccccgaacttgcctgacaacggagcatgcccagtggccgccggggcgctccgggcgagggattccacctctccgggttttgcccggactgggaagatgggcgctctggaatcgcccgaggaggcacctcagggaagagggaggaggggaaggtggctggaagagtcagggagctaagggtggcaacgggaacacaagaggaggcagaatacactggaagcccccgggaagggtgtcagcattgtgcatccggcaacgacgcgggcccgggacacttggggacgcttcaggcagagggcaggtgtactcccggcagaccttctccgaccgcccggagtcat

SEQ ID NO: 2600 - DNA, 491967 bp, Homo sapiens
tttgtctaagagtaaacggtgtttattttttgttgatttttttcaatcaaatggaattgcttaattaaaaaaaacttatctcttttctccttaaatactacagacaacctcattttatcgcagcagacacctaggaacaaaacactggacccaccagagaaaactgggcaataaaagcatcagaagttcaagtcaactatggaagaattactgttagctggcagctttcaattctaaacagaagtgtcccaaacctattgggtttgacaaaagtttcttagaactggggagctgggaatgttggactccttttaattctattccaatcatttcctgtatagggaaattaaagtcaatgcatcaaatgaagacccaaagaaacatttaaaaacttgtttgactagtattcagtatgtgagattattaagtaataacttgtccacctagttaaccttgtcctggaatatatataggttatttgtagccgccactgctataatattttctgaaggatgccaagctgtatgcaagatctttttgctaaagtccagactgtcgacactgatctcgtcttttctccgcttgccccccacacacacttttcggggtttgaggatagcccggggcttgctgttttccctcgaagcctcaagggtcacatcacgcttggtgtttctgtcgaacatcctgaagaagttgttgtaggagcctgtcatgatgacactgcaaggcagagagcaaaggcaatgacatatcttcactgtcttttctttttggagcaaatgataccatgttatggccagcttatgacaccataggttttattaaaaacaaaaaccaaaaaatgagaacaggctctgcagtgtgattattggctttttgttttttttttgtgttttttttttttttttttgaatcactgaaagcaataggatttttggctgggtttggaaatgagggatggtgagaactctccttgtaatttgcttttgctcaatagattctttttgcttctttggctcagaaaaggtgtccactggttttaatgatcccagtcctacctacctcccatcaggaatgtgagactagaatgaggtttgtcgaagtagacacacttttgaaaacaataagcagttgtacgtgtttaaggtttggccactgtcaacagggttcctgggccgtctggcctctaaggcttcatggcatcagtgcagtgaggggagagatgctagtggcatcgtgcacgaacccggggcgcgacctctcccctgccgagaactagctctgaattcggcctttttagaaaacttatctacgaaatggatgtcatcatggtcttatctaggaaacaagtaaggaaattcaaattttaaaagaatctgggatggagaaataaaaagattttatatggtttttttcccacacttaatggacagatggtttccacatttttataagttatcccctcttaggcatagctgcaatcgatcaggagagtggcaaacacccaatgtcttccagaggcaaggtactgaatgtttaatggtgacatttcagacacggtgacaagctgaggtggggagggagagattccttgggccagggcaagtaccccaagtgccatcacacggtggttcccctggagtggggggctcctactcatttctgggtggagctctgactggctccttaagatgggagagcaggaactctcgtgtatttctcaaatgatttgggatgtgtagagaggtgaaggaaaaagctgacaagattgggccacagcaagggggatgtgtttttgggcacgttgtcacctgtaccaggtaaattaagcaaaggttagattttgttactctggctcatcaaactgatactgtgaactgtgtctgtgtactcgagtggactgttatcaccttgtcaggcagggcgctgagggctttgcctccatgatctcgtttcaacttctattatcccctaaaagggttttacagagaagtaatttgctcagtgtcacattgctaattggtggtaaagtccaccctcaaacccacatatggttgactctggggcataagtattcagccggttggcctcactgcttcccatactttgacgtttgcttgcccaccatgacccgacttatttttaaacaagtaagagattattttccaaaaaaaaaaaaaaaaagactaccaaccttatctgaaagagaaattaaacttcccagttgtgatgttatagaaagagtgttgatcttaggattcaaactctaaacttgttacttttgtctctactacttactactttatgaggttgggcagattactttatcttgctaagcctcagtttccttaactgtaaaatgagaacgatggaagcaatcttgttagactgtggttgggattaaataaaatgatgtgtacgaatgtgtttggtatatagtaggtgcctaataagtgtaatttttgaatcaaggctaagatagaggaaaaacttgagcaataataacagatatgtaaataataatatatgaataaataaatacctataaataaataataaaatgagagggctggcttctttttcccatggtggattttgttcttatgtcacagttgctttgctctctgtcctataccaactggtcagtgtgacttgggtcctttgccacgtggagactccttccaagcctgctaaggaggggattcattttggatcagtggcaaagaaagccaagaaacaggtggagtgtgagagagagacagttcatattcactgaaagcttgaatctctgaatgtcttgccataacagaatttctatgctttcaaacactattattggtgccaccttcatcaaggaacgaaatcagcccctggtagcttgcacttagttctcatggaaatcagagaatcatttgtatttgtcaaactaaaaatgaactattgggaggtattatgaagcactgttcaaatcaaaggccttaaaatagtaataaatcactttgagggaatgtgataaatgaggttgactagaattcagttaatgaactaccagggccgttggccaggtctccactagcagcttcaagggataatttttgatctggaaagcctacttggcattaatctgaactgttcaggctggaatttgctggtggataagtgatcttcatttaggcatgttgacctagtgctggaggtgtcttgtgtgaaaaagataggactttcttattaacattaaggtgttatctgtgccagttcagaaacaggattcaaaggccttactacatccttctcttctttccagccttgacttcaagggtcactaggggcccacattatgcatttcagccaggttttggggcccaattttgacctccctttggctgtactctacttaggataaattccctgagcctcttcaagacaatctttggaaggttcttcagccacagagcctttcttacctgtctgacccattccacacacactcaaatttatcaaaaatgcagtcattttcatagagggaacacagcttgctgcggaggtagtcatgaacctggagaggaaacatatcgagaaggtcagttattattttaaacagtaattatttctgcaaacacctcctcttctgatgtgagctgttaaatctttcattgtacatgctctttgaatcagatggccttggatctgaacctaggcttggcccttttagctgtaggacattaggatgggttgatgagcttctcatgtagatgatatggattaatcaagcttgcttgtatagacagtggcatccagtaagactaaataagtggtagattctcattttctaagctgatttgctcacaggcattagagatcaccattcatgcagtcttttattcaacaaatatttactgaatacctactacgcacttgagatgcagcagtgagccaaatatccttgcagtgcttttgacccagtgtcaggtgacagattatataaccaagtaaataaataagatgtttagatggtgataaaatcatagaacaaaagtgtatggaaaaagagcctgggagatcttgtcgggggtgtattattttatacagggcaagtagtcagggcttcactggatgaggtagcactggagcagaagcctgcaggagatgaatgagccacagtgatgtctgggtttggggtgaggggaaggctctccaagcataggaaacagcaaacataaaggcctagaggcaggaatcctggagggagtgtggtgggagaggagtgagtaagcagctgggggagaggatgatcagtttacataggccctttattctgaggaagaagagacctcacagaaaggattgctgaatctgctgtgttgcaatggatcctaagggtgcaaaggcaaagggagggagaccagttataacctgagtgatagattctggcctggaccagggcatgagcagtgatggggactggtcagattctccttttgtttagggaaagagcagataggacttgggtcaactctgaggtgtggagagaaaaacaggagtcaaagatgactccctgatctttctcctgagcaagtggaaggagtaggtaccatgttcacttttgggtacaatggtttagagatgtctacatgtggagctgtcgagtagactctgaggtgaaaggtgctgtcctggagtatgtggcgattctttcctggtttctcttttccagtgaaagcagccagcatggttatcaactaagagtgagcaggagagagaaagggttgagaaacagtgtcagatttctggaaggcaccaggggacacttgacgttgttggacatgtatgtcaaataaggctcatcaagcatagttgaatatttttctccagctacattcagcaactcagctgtagatgccaaatagatgaataaggttcagagagtagtagcctgggttctctgttttgaaggtaatccttcctgaacccactagcacggagtggcaataataacgggcatacccaatatgctggcttgtcattattagccaggtgctttatctgtcaaaacctcatttcatctctaaagccatcttatgatgtaggtactttcattctctttactttaatggagcatgaagcacagagatatgacatcatttgtccaagatcacacagaaaaagtgacagaaggggagggaactgagccccggtatcaggctctggagtgcacactctgagctgcactagcaacctgcctccagcttgctctggtgggtcctcagtccttgacaggagctgtgataatgaactcaagtgaggctgagagagaaggagatagaactgtgtgaaagcagagggaggctaccaagggcattggtgtttaagttaagagtgatgattcgatctcttttttcctgcaactgcggctctttctcttccttcgactccaacagttctgctggatgcagagcttcaggctcttagtcttgggcaaaggaacgaggtcaggctcatcctatgttccattagatgttctgggtatttgaaaagctctgagttatttggacagaggaagttatttctaactctgcaaattaattttcccccacctttactctctcacttccaaacagttccaggccttgtcagggtaacagcttcagtgctttggtgacaagggaatacccctacagcagtgctcttggcattgttaggtgcatttgggggctgcaagggtgaggctgtgtcctgcccttacagaggcatctctgctataaactaactcattcaccttcactagggggcacagcagtaaaggtatataaactgggcagtggcaaggtttttaaggtctagttccatatgtctgctttgtgatgaacctttcctcatctgtcaccattcaccttcggcattttgtcttattactcacctgcagtgtttctataagtgtcaaaacatgtgtgctttggaagtcacgcccattagcaggaatgacattgctgagaactctgtaaataattcttgaaagatagaagttgggatagattcaagggaaaacctagtctgaaccattatttctccaccatacctaaggtctgggtagctcctatctgcctccaattgacagcatttaaagaaaaagaatgtctactatgaaggtatgctgtatttatgttttgttgcacagaaaaaaagtcttcttaggcaaaccagagggacctttttctactagaggaaagaataaagtgagatgtatacatgagcaacctctagagcttggagcaagagagaacttaaaactcatcctatttgatgttctttcttcatgttcctagtatgacttttctatgatcctattaatttgtgcatgggattttggacgccagactgagtgtcccagtacagtgtttctcatatttatttgtgggagtccagtgtcatatagttagtggactgctatgaggcaaacaaagagccaactctattggtccgttcttatatttcaagtgttgacaaactttttctccaaagggccggatagtaaatattttaagctctgtgggccgtatggtctctgtgacagctactcaactctgccattgtgcatggaagcagccatagaagatatgtaaatgactgtacatggctgtgtcttaataaaatttacctacaaagacaaatagggggctggtttggaacacacgttgcagtctgccaacccttgttctatggaaaaacttgaaaatagctaatcatacttaagtctgcagccttttattcacggaaatgtgattgagatctgtgaatgcatgtatgaaaatgtataatagtagcattacctgtctccttgcccagggcaggcattattaactgatctttcattaactaatttctttcccactggacctcacaacctattaactaatttctttcccactggacctcacaatctatcatggtgttctggaggctcactgaatcagagtttgtttaccatcatctttaaattacttcacgtaaaagctagctggctgtgttctaaaactagctttgtcctaaatctactcttcctagttaaggctccccagcagccacacatgggtcctagttcccactgccctttcttttgcattaaggattcgaatcctgtaaggtttgtcttatgcagctggaagaggacactgaggtgactctagtcctgggctaaagatgaagggctgcaaatgaaagcttgggggcaagtgatgtggagccaagccctgaagtcgaggtaggattcaggagacaggaacactaaataacagggagtacgatggaccacaggggaaacaaagctatctccactacatatatggctgtgaattctggctcccaaacctttctccagccctgctggaacacagagtcatcaaagtcttcaacctcctctctgaacctttccttcttcttcctctgactggaatttggatctcctctgaagacactcaagtggtagctagaattttgctgtcactccacatgccagtgttgggtagctgggctccttgttgctccagacaactattcctatttaaagtcttcaactcctttgaagtcatgccatcaaactaagcttcctgctacctgtccttctttcagccatcaaaagttctgagtccctaatcctcatcccttgaagcaagtttgtatctctgtctctcttccattactattcctgccactatttttagttattcaggcactctagtctctctcttacatggtctcatctattcaatgtgttttgtcctttgcttccttggtcatattatgaaccttgtcattgctatccctgtacctgtcattgctatccctgttgctgttgttacctcctgtctttttagttcactccttctagtatgttgattctatcaattcttaaaattcattatttccccttttccctaccttcgattcagcagtacatcgttacaatcaatcactcctttagcatatatattcaacaagcttgcctttcttgctctctctttccattgtactcatttggcaaaactccatcactggttaaatcttactttctaccctttgtttacctgtaccaagcaggtgaatgtggctgggaagaaacataaaatcatacaggttaatttccctttaaagcaattatatagatttcaagtggatccctgagcaaccctaccaccctacaacatttctcttagatgagtactttaccacttttcttccttcccattcagctaatgaccttactacttattttactaaagaaaacacctacatgttcccatcacaaaattcacaaacctacttcatctatataagaaaactactctccttcctttgatagatgaattatctttgcatcttaccatctacagccaattctgcaatggactccatcccctctggcttcccccaagggctttgctccttcagcggtctctctctaatggtctctctctctagtggcttattcctatcagcagaaaacatgctgtaataacttccttcagccagaatcccatttcagctacccttccatttctctgttctccttcagagcaaacttgttgaaacagttgtctgtcctcataatgttcccatcttcagtttcttgaactcactccaattggacatttattcacactgctctactgctgttcctctgtcattcaggttactgataatctccacttactaaatccaagttcgtagtcttctgtacttgattcagcaaagcatttggcagttgatgacttatttttccttaagacagtttctctatttggcttcctagtcactcctctcatctcactggctagtttccccaaatctctcttgccaaatcctcttcctattctcaactaggtcatattttctgacctcttctttaattatactaattgtctagaagatctcatccagtcctatggctttaaataccctctacatacttgtgagtgtcagatttatatcttgaagctaaatatatccagactcacattgaagtgtctacctgctgtgtctgtttggatgtttaattggcttaacagagccaaaaccaaactttcgattttctcatctaaataacttggcaactctacttttctaattgctcaggacaaaaattttggagtaatccttgatgcttctttcttttcctgttatatcccgcatcaaatttgtcctcaagccttattgcttttaccttggagatatatcaagaatctggctaccttcattgctaatacactcatctaagctactattgccgcttgccagaatgttataactattctcctgtctcttccaatgtccctcccacagtttctcctccccagcacaaccagaatgttcatttaaaaatgtcaatgatgaaaatgatctggaattagataatggtggtttgtgagtaaactaagatcattgaattgtgcactttgaaaggctgattattatgtacattatatctcaaggaaaaaatgtaagtcaaatccttctgtctagaatcccccacttctttttatctaaccccaaatagcttaaaatagggttagtttatctccagcacttgatctttgctttcattatactcttgcttggacctggattttgcttctttaagtcctctctacttcaaagtctggtcttcctctttcaacaaaaccaccctatacaatgccttttcctttgtttccttgcatttacaccatccacccaacacttaaatccaaaacttccacacagtcttcttgattccctctccctgcacatttgatcagtaagcaaacctcactgactcttcatcctacccatccttccatctgcacgctaccatcaccagaccaaattgccatcatctcctcttatctaaattgtctgtttggcaaactgcaaagtgaaacacacagtaaaaagtaaaactcacaatgttatttcctggtgtaaaactttaatggtcctccattgtacccagtccacaggcaaaacagcctactgtatattaccagggcctagtgatcagccccttgcctctatctccaggctcatccttctgcctttgtgattcatattcaaggtgtaagcaccctgaacacacctcatttctcttgacaccaggcctttgaacacactgtgtttttaattattacactgtaagttctgagatacatgtgcagaacatgcaggtttgttacatatgtatacatgtgccatggtggtttgctgcacccatcaacccgtcatctacattaggtatttctcctaatgctagtcctccctgagccccccaccctctgacaggccccggtgtatgatgttccccttcctgcgtccatgtgaacacactattttaagagcatgcatttcctgactagttcatggcagttaagactcagtttaagggtcacttctttgggaaaacctttctcacctggctggaccatctcttgcagagaggcacactcaattccttgttcatcatctgacttttccaccagatggtaagctgcatgagagcaggaccatttgtttacctctatagtgtccattccacatgaagtgctctgtccatatcaattaaattgaattctagcctctccacatgtaccgttatcttaaatcctgtggcacttatagcctgtaccattttactgaatgtatcaccatgcattgccttccattttgctgcactgtaaacctttggaagcaggggctgacttaaaagctcatgaagggaatgttcaatatacctatgggtgcctggggttctatacctggtaagtctcgatggggcggttttccatgttgagatcccagactttgacggtcaagtagtccctggtcatgatatacctcccactgtggctgaacttcacatccgaaatcgaagagataatttcagagaaaaatgatctgttgcttggatcttccggctcttcaaaaactgcagaacaaaagcaaaacaagacaaatttagcaatccttatcaactgactctaacatgtttggactggctaggaagctgacagtgtaactgagagtcttaagtagggctggtgtctgcagaatgtaagttgctaatagagaactgtcatctctctggtagcggaaaaagctgtcattagtttctggattttaattctcatggaaggactggcatgggacccgtcccatcatagatctggcactgacagatctatgtatctaactctgtttctgtttcccttggtatctgggtgtcactgcacaaaatctggagtcatgttaagatagttaaaaaaatttgttttacagctttagtgagatacaattcacataccacaaaatgtagagttcagtagtttttagtataatcacaaaatcattgctataatctaaatttagaatatgttctttacctccccccaaaaactccatatccattggcagttactttccattccctgctcctatagtactaggtaaacaccatctactttctgattctcattctggaaatttcacataaatagaatcatagaatatatggtcatttgggactggctccttttacttggcataaaattttcaaggttcatccatgtcgtagcatgtatcaggtcttcattcttcctatggctgaatagtattccattgtatgaatataccacattttgtttatccattttatgagcatttgagttgtttccactttttagctgctaggaataacactgctatgattatacatgtataagtttttgtctggtcatatgttttcatttctcttgttggctcacggtgtttaatagtgaaactttggccaggtgtggtggctcatgcctgtattcagcactttgggaggcctaggcgggaagatcacttaaacccaagatttcaagaccagcctggataacataggaagattctattgctataaaaagttagccaggcatggtggggcatgcctgtggtcccagctacttgggtggatgagctactattgggccactgcaccccagcctgggcaacagatcgagatcctgtcttcagaaaaggaagaaataaaaaaagtggtgctttcttactggactgccttgggtctaagcctgtcatttacttgttgtgtgaccttaggcaagatacttctctgtgccttaggtttccttatatgtaaactgtaactatgatgtctttttaaaattaacaaaatttctaaatttgtataaacttaatgggtacaagtgtggttttgttacatagatatattgcatagtggtgaggtctggacttctagtgtaaccattagccaaatagtgtacattgaacccacaatgtcttttgtgtggattgtctatttgcactgatatccaggttcttattatctctctcaatagcttcagctgatttccacttacaggaaaaaggcatggcttctcagtatgttattggagcccatcacaaactgcctctaattctttctaccttgattttaagttggatgtatagagtatatctcgatatttcccacttctattcattgcctgattctttcttcactgatccaaatactctttgatgcatatacctcatctactacatattatttcaccccaaatgatcttttcttttctctgaagccctatcatgcttggtctggtcatttatttagtatttgctcaggtactctcttacaatggaactatcatttttcacattattattattattttaacaactgatgagtttgttttatctcttcaactaggacataagcttcctgagaacaggattttggtcttattttcgtattcagagtcttactcacaaatgttcaatgaatatttgttgcttcactggagccaaagccagataaattaacagattctttgccttctgggtgcttagcatgtatagtattcagctgaaacatatgcatttgctgacattcaattatttttgacctacaaagatggcaattgtgtatggctaaaccgaataagggtttatatcacaattttaggctgaaccaaacactggcctgcaggttgctgagttaacttatcctccaagactacttctttcctgcctgctcaatgcactcgcatagtcagtaatgaattctatataaagaacccaagtatataattaagttgctgaattaaaccgtgaactaagccaaaacgttaattttcacagaaccattgaagagaatagcaacaaaagccctgatcaatcagaattgaaattgcaaaaattttaaaaaaatcattgaaacagaaaaacatggcttattacagcctctgacccaatgtcttagtctctgccctcagcttttgggcttcggctgagtattagtgaaggcccctggattctgattggtatcttcatagttgagaactagataggaagaaaattttcacattagtttcaactaacagctatgtcattagtattggaggtttggaaattccaagtaaaacacctgatccagaggcagtaaagtggatgggcttagtaaattgtgctctggagtcatcaattcctgcctctgtcagttactagccatgatcattttatttactactccagctttagttttcccagctgcaaaaagaggagccacattgcttggcatataagcttggtacgcagtaggtcctcagtatatgccatcactattttcattttcagcatgcactgcttctgtgctggccagtcatatctcattcaacaagactcttgagaatttgggaccaaggagtacagaacctgcggactatttgaaagacataaagaatgtttacattttctcttctttaaactcaaatctattttataatgtttaaattgacaacaaaattgtatatgtttatggtgcctttcaatgttatacataggaatctgtttcccaaatacttggcatattgggaagccagtgcagcaacactgtaaagcctcacaatgacaccttcacaagatggatgtgaaatgaaagatgacaattcttcaatcaacctaccaccatttatttgtggagtgccggctttaggtagcacacagagggcaaggtacagataacataccagcacagcactttgtagttcatgacatatctatgtatattcaagttttaatagcagctccaggaattattttccttccttgggtaatagcatttaatagtattaataattacttttgatgggaagcttataatactgcaggccctgtgctttacatgttttatttcatttagttgttaaaacagcctatgaagtaggaattatgattcttcattttatatatgtggataactaaggcacagagaggttttataaccagtccagggacacactgagatagagctgcattttgaactcacatctatctgacttcaaaatctttgttcttaatcatgatgccatgtagaagaccttgctgagcattcatttataagttaagtgtcttgtatgcacaggcacacacacatgcacaatatagtatattagctagagtccacaagtaaaaagtatttcgatacgtgccaggccctgtaccaaatgctaaagacacaataatgaacaagacagatccagcactactcctagtgagctcacaggatagaggaggggacaaatgtttagcaatcacacaaatgtggttacagttgtgaataagtgtgattttactgtgttatcagacggaaatcatggtgctatggaactggctagtggaaggtaaatggaacaccagtgtgtgttccataaaatttacttctcatgccccctgcaatatcagagatgtgcaaaatttgttgaacaacagtatctggtgcctgagtgatagaacttaggacaaatcaacactagcctttctcctggagacccttggcttggcatgacagtagagaatctgctgacctgcaaggtttccaattagctaccagaaaatagagacattgagaggagagaggaagagaactaagggagagacaagaagagctttgctccctttgtaaggaagcagtcttggtgagaaacctgatagcccagtcctagccactgggggtatgtcaggttcaccaacaggagcgtatgtcttggagaccccaatagtaacagtaacaacaataatgacatttgctaccacttcttggtcctcaagctttaaatacattattgcattttaatgctcaaacttctaaggaaggtactatcactcttctcatttgtagataaggagacagaccaggaggaaaggttcagtaagtcaccaggatcatgcagctaggcagtggtagagatgggctcttgactctgcccatctgtcacaccacctccacaacagggccttgccttgctttgtcaatattgtttccctgttcaaacaagtcaaaccaggattcctcacattctagatataccttgtatagtcccactttggtgcctctgttgctcctcacctcttcctgtgcccatccaggtacactggaaagaacatcagactcagggatgctgggctggaatccaggctgggcacaagtccaggctggcttttgataatacctatcatctactgagcttttgtgctgtgtgctctacatgtattaactcactcactattcataggttttagtacttttccacaaattagtctaatcagtcaactcaggtacaactcacagctagtaggaacagaggcagaatttgaactcagtatacttccagcttatgttcttaacctctgtcctactctctctcatctgtgtggctttcagcaactgtcaactctctgaccctgtttccttctctgtaatatgaaggagtaagtgttgcctaccaggtccctcccagctgttggattctaaaatctatgaaattccactggcttttccatttccctttcctaatccccactactctaggtagcctttccaaagtgacttcagcaaaatgttcaacctgtgatatgtcaggcattccagattccaaagtcaaataagcttgggaaacctcgacaattttgggagttgacaacgcaattaccctattgttggggcattatagaatgttcagcaacatatctggcctctactcactagatctgccctgctgactccatctgcccacatgtggcaaccaaaatgtctctagatattgccaaatgttccccagggggcatgactgcccctggttgagaatcactgctttaatcctacttcagagtattatttgatcatacctttctccccactccattttatttttatttggcaaatcatttgcagctcagtgtttttctagtacaggcttcctcagaatacactttgggttatattgctatagtcaaaacaactgaatactgcctttaaaattccataggctatcttatgtgccttgtgtagacgtgttttctgttataacatgtacagatatgaatagatctccatggagctgtaagtatcttgtgggagccccctgaaagggctcagatgactgggtaaataaataaggttccagaatctggggaaaatcttgaattcagttattcaagaattcaaaaataagagaaagaattaagaagaagactgccaactttagagaaacctaaagtgaaacagcattcattacaactggagcaagggcagaaaggaggcatgcagtgagctggttgtggactctggggataggagaagagagagattaggtaaccacaggtgcaggctgttgctgggtgtggctcctttctcttgaccttacactggaccttcattaatttcacaggaactcatgcccatgtagaggggttaggaggggcccaagaccactaacagctgatcctgaaggcctgttcactctgtcttagatggtgtggtgactaacagtataggtggttccaaacacagtggcctgggttgaaactccagctttgctgcttataaatgatggagctttgaacaagcagcttgactccttccaagcttcatttaatggagataatagtagtacctatgttctagggcggttgtgagaatagacgagatcttgcttgtgaatcacttagcaaagcgtctgtacccaaaacaatagggaaggcagcagtaatgcagaagtaggcattgcttaaggcaagcttggtgtgcaatgagtccaaaagcctagtgtttttccgtttgaggcagatcttaagaaccagttgtggtactgatttctgggttttctgtctgggctgcgacacagacacatactagcttgtttctgaactatcccttgaaatacacctccttggtccaagtgtctctcatttcaatgtcacccccaccctggctgtgatgacgcgggcagatgagagtgagtgtacaggaaacaagccagtgggacatgagggtccgctcacgatgaaaaaggaacgggctcggaatcatgcgcagggctttaaattgctcacttttgctgacatttcttctacagggaagcacggctggcacgttcttccgtttggagacatggttgacaatttctccataatggggacacaactggcaattttcctacagagtgaggcagatggcaattttccttcagagacatgcaggcaacagttttgcccctggagagaaaagcctcgccgattgagatgcagccagtaatttttactatacagaagacacatccaataattttgcccagtgagagaaacggccaacaattttcccacagagggtaagaactccctcggactgacaatactggcctttatccagctgaggacagtgagagaagaggtttaagatttaattagtggctactgtgctaccaggggcctaatgacatagtctccagacacagattggagactgcaaatttagatcgtattaagactcagatgaaggattctgaattgggaaataatgaaaccaagttgcttaacccttgcagtttgcttttcatatagccctccattaattcaacaaacagttgtttgacagtgacactttaacaagacaaggcatacaatgcatagcgtgatgaagaatgaaaagttaatctagaagaaattatattggtccctaagttttacataacttttcaaaataattctgcatctactatacttcttttacaacatgtcttttaacaactaatcattcattcaaagttaagaaataatgaatcaaaaccttttcttttcccagacaggaaaaacagaccaaaaattcatagtggggagaagtgaggagcaaatgggctggtatgaccaagaaagacttaataagaagctgagccttaaatgatcaagaagcactggatagataagaggttagtacatattttagactttgagggccatctggtctccattacaactgtttaactctgcctttgtagtgtgaaagcagcatagacaatatgtaaacagatgagcatgtatcccacatgaaggctttgcatatggacattgaaatttcaattttgtataatttttatgtgtcataaaacactattcttttttgatttcttcaactatttgaaaatgtaaaaatactgttctttgctagagttgtaaaaaagaaaagttgtgagtcagacttggctgtatgccatagtttgctgagccctgataatggtgtttgaggggtaggagggggcatcctatctagacaggggaatcagcatgaataaatgcctggggtgatcaatgcatttttgtgggacagtgggcccctaggactggtagcaccatgagatcatgtagaagggctggaagatgagatttctgcttaaactgcaaatttctttcctaaactacatctctcaggatggtacatggaatgaacttaggagtcagacatattggggctagaacctgggcttcatcatctccaggttggattgtctttgtcagttttccttatcttgttaagacgcaacttatctttaaaatgtagacatcaatatcttatttgcctggttataaaaatgaaaagagataaaagcaaataagacatgtagcacaggacaggcatggtggctcacacctgtaatcccagcactttgggaggccgaggcaggtagatcacgaagtcaggagctcgagaccaacctggccaatatggtgaaaccccatctctactaaaaatacaaaaattagctgggcatagtggcgcatgcctatagtcccagctacctgggagaagaatcgcttgaacccaggaggcggaggttgcagtgagccaagatcatgccactgcactccagcctgggccacagagtaagactctgtctcaaaaacaaacaagacatgtagcacagtgcctggtacactgtcagaagtcaccaagcccatatcgaacatttaaagaagaactaatgtcaattctactccaactgttacaaaaaaatagaggagggaatacttccaaactccttctatgaggccagtattaccctgataccaaaaccggacaaagatatatcaagagaactataagccaatatccctgatgaatatatacaaaaatcctcaaaaaaatactagcaaaccgaattcaacaatacattaaaaagatcattcatcatgaccaagtggaatttatcccagggatgcaagacagttcaccatacgaaaatcaatgtgatatgtcatatcaacagaatgaaggagaaaaaccctcaaaaaactggatatagaagaaacgtaccttaaaataataaaagtcatatatgacagagccaccgctagtatcacgctgaatggggaaaaaactgaaagcctttcctttaagatttggaacacgacaaagatgcccactgtcaccactgttgctcaacatagtactgaaagtcctagatagagcaatcagacaaaggaagaaaaggcatccaaattggaaaagaaaaagtaaaattatccttgtttgccaatgatatgatcttgtatttgaaaaaacttaaatatgccaccaaaaaactattagaactggatgtggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggtggcaacgaggctgggggaggggcgcccgccattgattgcccaggcttgcttaggtaaacaaagcagccgggaagctcgaactgggtggagcccaccacagctcaaggaggcctgcctgcctctgtgggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcaatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaacgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagagctctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcacgaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctccataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgactgtttatctagaaaaccccatcgtctcagcccaaaatctccttaagctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggataggaaggacctcttcaaggagaactacaaaccactgctcaaggaaataaaagaggacacaaacaaatggaagaacattccatgctcatgggtaggaagaatcgatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgtcgcatatctacaactatctgatctttgacaaacctgagaaaaacaagcaatggggaaaggattccctatttaataaatggtactgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtatggcgattcctcagggatctagaactagaaatcccatttgacccagccatcccattactgggtatatacccaaatgactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgttcacatgtaccctaaaacttagagtataataaaaaaaaaaattaaaaaaaaaaaaaaagaaaaaaaaaactattagaactgaaaacaaattcagtaaaactgcaggatacaaaatcaagatacaaaaatgatctcaacagcaaataatctcaagaaattaaacccatttacaacagctacaaattaaaaaccaaggatttaacttacttacccagagaagtaaaaggtctctacaatgaaaattaaaaaacactgatgaaagaaaaggaaggggacacaaaaaatggaaagatattccacattcatgaattggaagaatcaatactgctaaaatgtccatgccacccaaagcagtctacagatttaatggaatccctatcaaaataccaatgactttacagaaatagaaaaaacaatcctaaaatttatatgaaaccacaaaagacccagaatagccaaggctatcttaagcaaaaaacaaaactggaggaatcacattacctgacttcaaattatactacagagttacagtaaccaaaacagcatggtactggcataaaaacagacatatagatcaatggaacacaagaacccagaaacaaatctgtatatctacagtgaactcattttcaacaaaggtgccaagaacatacactgggggaaaagacagtctcttcaactatttgtgctagaaaaactggatatccatatgcaaaagaatgaaactagatcccaatcactcaacatatacaaaagtcaaatcaaaatggattgaagacttaaatctaagaccttagagcatgaaactactacaagaaaacactggggaaagtctccaggacattggactgggcaaatatttcttgagggataccccgcaagcacaagcaaccaaagcaaaaatgaacaaatgggatcaagttaaaacatttctgcacagcaaaggaaacagtcaacaaaatgaaaacccataggatgagggaaaatatttgcaaactacccatctgacaagggattaattaccagaatatagaaggagctcaaacaattctataggaaaaaaatatctaatccatttaaaaaaatgagcaagtgatatgaatagatatttatcaaaagaagacatacacatggcagataggcatacaaaaaagagctcaacatcactgatcattagagaactgcaaatcaaaactacaattagatatcatctgaccctagttaaaatggctttcatctaaaaggcaataatgctgatgaggatgtggagaaaagggaacacttgtacattgttggtgggaatgaaaattcgaaaaaccactatgaataacagtttcgagattcctcaaaaaactaaaaattgagctactatatgatccagcaatcccactccttatgtatataccccaaacaaagaaaatcagtatactgaagaagtatttgcgctcccgtgtttgttgcagcactgttcacaatagccaagatttggaagcaacctaagtgttcaccaactgatgaatggataaagaaaatgtggtacttatatacaatgaagtactattcagccatgaaaaagaatgagatcctgtcacttgcaacaacatggatggaactgcaggtctttatgttaagtgaaatgagccagggacagaaagacaaaccttgcatgttctcacttatttatggaagctaaaaatcaaaacaattgagttcatggagatagagagtagaaggatggttaccagaggttggggggcagggggaagtgggttaatggttaatgggtacaaaaaaatagaaaggatgaataagaactagtatgtgatagcacaacagggtgattatagtcaatattaatttaattgcacatttaaaaataaaggagtataaccagatcgtttgtaacataaagagtacatgcttgaggtgatgaatataccgtttaccccaatgtgattattactcattgcatgtgtgaatcaaaatatctcatgtacctcataaatatatacacctctgtacccataaaaagacgtcaacaagttctagtgtcacacaccatttaaacaacaggtattgagtacccagtgtgtgtaaagcactatgataggtgctagagttacaagagtgagcaagagatataccatgcctacgctccttcaacaaagagtggggcttcttatctaccatggctggggcttcctctcatctctctctctctctctcttttttttttttttgaagcagagtctcgctctgtcaccgaggctggagtgcagtggcgcgatctcagctcactgcaacctctgcctcctgggttcaagcgattcttgtgcctcagcctccccagtagctgggattacagacgtgtgccaccacgcccagctaatttttgtagttttagtagagatggggtttcaccatgttggccaggctgtctccaactcccgacctcaggtgatccacctgccttggcctcccaaagtgctgggattacaggagtgaaccaccatgccagccatctcttgctcaattcccctgtagtaggcagaataatgccattgcccccatccccaaatatgtctacaccctaatccctagaacctgtgaccacgttatgttacatgacaagggggaattaaggttgctaatcagctaaccttaagacagattacgttagattatctgagtgggctcagtgtaatgaccatggtccttataagtgaaataggaaggcaagagggtcaaagtctgaataaccgtatatgagaaagacaagactggtcaccgctgtctttgaagatggaaaggtgccatgagccaagggaggcaggcagcctctcgaagctcaaaaaggcaggtagccattctcccctagagcctccagaaaggagcacagccctgctgacaccttgactttagcccagtgagacccacttctgacttttgacttccagaactgtaaggacgttaatcaatttgtgttattttaagccactaagttcattaagtatgtgataatttgttacagcagtgatagaaaactatcctcctccgtttgtcaacaaagggagggctcaaagttcatgaattcccccttcaactctgcaaagccgctgttattatttccctgcaccccagggccagttccctttcagcagctgcccctatacagctggacagggaaggcaggccagagcgggctgcttctgggcagaggccatgagaggctcactgtccaagggagctggtgaaccccagctcagccactctttcctcccagcattcctgatgctggtgctgtacacccataagccgacacagttcagagaaaccagaacccagcggctgcaaaggcagagcaagccaaactcctcagagacatcagggcttagcagcagaacatgaaacgaccggcaatcctaccatgtgctaaatatttgaatcttcccaaagcaatgccactttgtgctcagacatctacagtgactctgtgtggctgatagccaacagtcctacccccttgtcctggttcaggggctccatatcaagccctaggtcagcattccaatattactctctacttcattctgctgaaatgctccattgaggtctgacccatctactactcatttgcaccagagttgaataactcctacctccagggtccaggcaggtagtgaaatagatgacacattcatgggtagcaatagggaacagtagggactgtggcaaactagagtgtccacaccctataaaaggggcagtttccacctgaggtcagcagttcgaagccagcctggccaacaaggcaaaaccccgtctctactaaaaaaaaaaaaaaaaaaaatacaaacattagctgggtgcagtggtgtgtgcctgtaatcccagctcctccagaggctgaggcaggagaattgcttgaacctggtaggcggagattgcactccagcctgggtgacaaagcaagactctctcaaaaacaaacccaaaatacaaacaaacaaaacaaaaccataaaggggcaatttccactctgctccggctgaatgcagccatgcagaaatggggctccagcacagccagactaatttgtaaggcctaaattttttgaggaactctaattttttcatgttagcaactaactaaagaaacttgagcgtgtgatcaaacatacgtcctctgtaagctatgcaggccacacctgtgacctgattaactccctgcagtgatgatggtgatgtctgtggtgcactggcatgtgctggggctggatccatgctccttccctaacctctccctgctcccctgtttctctggctcctattcaaccttcagggctcactgtctttttctagaaaaacttcctggacaatcttggcccactgcatcctttcttccttactggttaatttggccaccttctaatcttcctcctattatttttaaatattatctgttcaggattcacaatgagttaaaaaattttagttagggaattggccccacagaaaggcaacaccagtgacaacaagagcacctgttacctgccgggcaccatctagggtaagaattatctctatattatggctgaggaaacagaggcttggagagatagggacccaaaggaccatatggtctctgagtgagcccagcattggaaggctcattatctgtggggttagaactttcttacgaaggagactcagctggaatctgatctaaagaaaggggaagcgaaaacctgtgtttggcttagggttcgcctgtcaatctaaagactgaatttgggctaatatgtacagacaagttcattaattgtgggtctgtttgtctttcttttgtgaggaataatcatttattagccaagcgggactggtgcctttttgagaactgtcattctggaaagatattgattgaaggaggcctctgagcacattctctccagcaggcagccgtaagggaggcggctgcagtccagacaagatgatgagttggcagtgagcatctcgacaggagcctaatgaagaaatctggtaacagcgagggctggctttatgagcgctcatatttggtctttcactctctgcaaggttggtgagtggcaaaagtgtccatgggcctctacctcccactgtggaattacacattcctacagccagtgggctccgggaacccaatggcagcatccccaggcccctgggcccactccacacatcacaggctagagacttcttgtctgcctcctttctcacgtctctccccctgagatagcatgctctcccctccctccttccctctcataatttgttcccaacaggtagctttgtgcagttactccaagagaagcccgaactccctggggagcctctgcccaggtggaagagctctcgagtggctattattaggggtgattgctgggaagctggttgccatggcaccgcagaggccagtgctgaactcccaagctgccccgtttccaaggctgtctacataatcactgcaatgagaggcacaggcacagaaagggagagaggagcagctccccactgacagtgatctccctgcagagcaaggtgagcagttcacagctgagtacgacagcccatcttggcatgggccaagcactgcctggagggaccctggtgtgagctggtcactgcttcactgtcttctcatggatcaggcagtctgcctctgtgttcccagtactggttttctacaggaaaacactgctcctaatccactgatccatttcttaaaggttcctggagtttgcaaacatcgagtagtgatagtcttccatctgccaggcactgcgctaaactctttatggagacaaagaaatgatgctcagagagtcatttgcccttggtcacaggctaagaagaggcagagctaggacgtaaacccaactctggctctatggcatctcatatagcatcatttttcctccagtcctctgactagaaagggtggccccttcaacctggtgctgagaacagacactggcggccccacacctctgaaggcatggttccagcaaatagaaattggactggcaaggattaaaccgctggtttgggcttcattagctatgtgatctcaccaaccacagagaattaaccagagtggagccatctctttacagacttaacacaatgtaccgaggcaatgtggagaacagtcactgaatttattgagcacctactacctgctccagacatgccattaacacgtgggctatccttcccttccacagtcactctagaacttgaggccactgtcctctgatgcagagagaagaaacattttataatcactgtagacaataaaggctttatctgttagcaagcacttttgcttaatgacttggtcatggggaaggagagacaggttgtacttggtcctcattttgcacttggttagagagtaagaggcctttccatctccactgctgctcaggtacttcctcccagtgtactctagcactcccccagcaggttctgtagaaacacagaccccaaggcctgggcagactctaccagaaaaatacttgtgttcctctgtgctctgcctagtacatggcttccctggctacctctcctacaggcctggggaggcaaagatgggaagtgtttgtaggtattatctactgacaacattcaactttagacctcggttcaagccccctctacctttgcctagatctttgactttgtgtaaacaacatgctttttctgggcccaattttctcatctgtaactccaagtttatgaattgttttgataataaaatactaaaaaatattgagtgtttgctgtggaccagacatttcattgaatctgcacaacaatccagtaatgcatgtgccattattgtccccattttatagaggtggatacttagctgtacagagggtaaatccaaggagttaagtccaagttacccacacctgggcttgtctgaccccagaaccagcactattgaccactatgatatacagcctctttctatcttcattaaagccaagtttccaagccacaggaatctcacaaatacctataaccggcctttataatttatgaacctcaacagagtatctgaaagccacctagtggctggaagttgctcagtaggatttgaaattctctaaaaggcaaaattgttcccatattccaggctctgctccctctcccccttccaccaccccttgatattctttctgaaaagttgagttggaaacaatcactttcttctctgaacttctatagagcaaggttcccaagttgtgatcaagacacaaaagtcatggggcagagcaccataaaatattgtgacattatctttaaagtagcttatatataactcagtataccattttgtactggggtctattatatagatcatacaaatttcaggaatacttccaggagaaaagtttaacattgagacaattctgagttttagcttataattcatagccttagtgtattctgagatacatatcaccttttatctgatgttagatctcatctcattcactcatacattcaataactacaatttagtatccatgaaatgtcagggatggcccttggaatcttccggtacttaataacctccctaggggcaagcaacagtacgttggattaacacaaatttgtggttttgtggccccacagtgacacgaacacaaaagattctcaataaacagaaactgaaaaatgctacgcgtcagaacttttgggtacacataggatatgctgaggataagaacatttgaaatcactatttcaactgtctaaaacaatattcagcataaacactttttagtcagcattttctctttctgattatgggaatctaaatttcatattcaattgaaaatgaactttatattagaaacatttcataattttatattctcttgtcccaccacgataagtgtacaaaggcagtaattgcataagtctgtctatccattgtgcttagcacaatactttgttaacacttattgaccaattcattgctttgtttgatttcagtctttttcctaagcttgatgattctatttttctcatatgtaactcttcaatgacaatttcactgcattacagacattttcaaatggcacaaaaaatgtcagaatatgctatttgaccctgggattaaggatgcccatacatgagatcaatcctatttaaatccttatgctcaggttaaaaagagaagataaaggcaagtatcattatgagcttcgtggggatagcattcccctgacctctgctgtctccagtctgtgcttgataatgatggaaggccagcaggtgctttgagtaattcagcagataaagagacttgcactgatggggctggaagctgcttgagtggacagcagatctcacaattcagttactgatgctacctactgagctgtcaaaatagaattatgagaactgcatggggggcttgaattaaccgatatacttaaacatgagtcaattacacacacgagagatccccccttctccatcttacagggccatgcaagtcgtgaggatggttgtattcattatatgatgtaagaaaaaaaaccaatcattgtcagtgtttcagacttaatgttttctaaaccctgatttcctcagctgcaaaaaggaagagatactgcaaacttactgggttttcaggaggatcaatgaagataaatcaatgagaaggggctctataaatagcaaagggctaaacagcaaaaggtatcaacttttatcattttatgcctttttaaaaacataaatctgagagtccacagaatttgtaaatttcccctgcaaactgttgttgtgaactcgctctatggcaccttcatctaggtgtgtgctcaggccaaaaagctgggagctgtccttggtgctttcctttacttcaccctctacatcttttttttaaaaaaacagttctattaactttacactcaaagtacggcccaaatcaattcaatctcaccatttccactgtcaccatcttagtctaagccatgctcatctcttacctggagcactttgatagctttctgactcttctcccagcatctactcttcctcctgaggcttcattcttaaatagccacagagtgacatattaaaagtataatcaatcatcctctttacaccaagccctcctggattttctcttaatacagcaatatccaaactccttaccattgcctacaggtctaccgtgtggcccagcccttcaagtcctttgcacagaagacaatgtgaatgggggctgtgtggtgcaaggggactgccctgtatgtagctcttcctgcctcctctcatgctattcctccttatggtactgtacacagcccagctggtcatctttctgccctgtgacctgccaagcactgtccagattcagagccactccatttgctgttgcttcttcccctgaaacattttcactaaatctcaatcttatttatgtgtgtgttgttagattccttctccttcaataaagtgctgcaagggcagggggcatgattttcctagtgcctggaacagtgcctgggacatgtgaagcaacaataaacattcgttgaataaataagtagcagttgattacctttacttcatggacttctctttcttttactttgcctgcaaacaccaaaacttatgttctagttttccaatttgtaaaaatattgcaacttttaaaatcttattttgtgcttttttattgccattttcccacttgtggtgcctaggaatgcgatttaattttaatgttcatgtaagttaaatataacaaggtaggtattttattatactgtgtgtgtgtgtaatgtattcttaatgctagaaatgagcaaacagtgggtcaactactctttactgttggcttttacatatgtgtaaagagaagtatcagatgcaaatttatcagattgaatgactatagttgtttacctctaaaagcatttctttagcactttcactgtcctaaatgctgagggggtttgagaaaagagtctagccataataatggtcccatctagtgagagagaccaaaatagaaagaggtaattaaatgtatggtattaagtgctctgagacagggcatttaatcctatttgggggtccaggaagtcttcctggaggaatgtgccttaactgaaacctgaagaatgtgtaggcagaatgatggctccccaaggatgtcaaaatcctaatgcccggaacctgggaatatcttaccttacatggcaaaatggaataaagattgtggatagaattatgatgctaatcagctgaccttaaggtggggagagtatcttggattacccaggtgggcccagcgtaatcacaaaggtccttaaaagtggaagagagaggcaggagagagacagagagatgtgatatgagaaggactcatcttcctgctgctagctttgacaatggaagaaggggccattagccatggaatgtgggcagcctctgaaagctgaagaaattgaggaaacattcccccctagagcctctagcagggaacacaacttgatcaacaccttgattttagacagtgagaccaatgtcagacttctgacctgcagaactgcaggatggtaagttagtgttgttttaagccactacatttgtgagaatttgttacagcagccataggaagctaatacagagagaaagaggtgaactttgatttcactgtggaggggaaaaacgggcagctaatacagagagaaagaggtgaactttgatttcactgtggaggggaaaaacgggctgttggaagatctattatatataaagattgtatgataaaattcccaccttgttatgatacttatatgaatgttaaaagattaattccttggcaccacaaatggaaaaatggtcataaaacacagacttagattttaaaagttgcaacatatttataaattgaaaaaatggaagataatttttggtttttgcaggcaaaatacagggaataggaggccagtgccctccctaggctctaacaggccaatgcctctttctggggaaaatatttctgggcatttccttgactgggttctcctgaacctagaattcaggatgcccccaggtgcttgtggctgctttgctagtgatagcttgttacagggcatgacgacaggtaagttggcctaaaatgtcccaaggccagagccatctataaccctatggccaatctttcccattctgcatgtcttgggggctgcagccatgtgtgggagccaattttgaccttcactgctgtctcattcaagaccccaagtgagggagagggcaagacctgggaaggtgttaactactaatgaataacactcacttccaaaattaataagccttctggttcttagcaaaatccactcaactggattctccaggatgactaattgacagaactggttaaattaatcaaaaatggaaatgaggatggaagaagggggaagggattctatttttattcgatggcttgggcactgcctgctctgttaattgctgctaagcttgaatgggatagagcagcttcagacatgggggtgaggtgggggtggtggtggtatcagtgaattctgctccttgcagcaaggcttttggcttttctccagagtgggaagtgtgtgtctgtgtgtgtgtttgcaatcctgccatcaggcaaaagcattttaataaaggaccttgtctttttaacctaaccaagctcccctgaaataaatactgttaattatacctcagatcaatactgaaccccttttggaagatatgccaaatctcaggggctttaagattcattgcagttgctgtctcagctgatgtctttggacacattccatcagggacctggggaatgagccacaggtttattagggagctctagtggcttacttaccaggggttggcaattaagtttgtagatgagggtgaagaatgagagtggattttatgttctgtgtaatggcagaattaattctatggttgaaaatggtcaggctggggaatccagccagatggggattgtataaaatggactcttgtgaaattatccttctggattttagaaaaacatcatgctctttatcctgtcagatgcccagcagaggaataaatcttctggaagcagacctacatgggttcaaatcttaggtcctccactgtgatctggggcaagtttcctcacctctctgtgcctcatctataaattagaggtactaataccaatcttcatgggttgttgtgagaattaaatgagatacagaaatgttcaaaaatagtaccctccccctctactacacccacctttggaggacaatgaaatttctgatttgcattgttggactgggcatcaaactttgccttcttctcattggaactcgggctgtttctccaatgactacactgttcacagaaacatctcagatttttttttttttgagatggagtctcgctctattgcccaggctggagtgcagtggcacaatctcagctcaccgcaacctccacctcctgggctcaagtgattctcctgcctcagcctcctgagtagtggggattacaggtgtgcgctaccatgcccagctaatttttatatttttagtagagacagggtttcaccttgttggccaggctggtctcgaactcctgacttaaagtgatctgcccgcctcagcctcctaaagttctgggattataggtgtaagccactgcacctggcctaacatctcagattttaaggtctaaagtgcttatgccatttccccctcagcatgaaaaagtcagactgcccctggacaggaaggctgctttggtgtcatccgaaggaggggatttctgtggccaatccttgggctgcagacttgccaatgcagaagggccttgctgctagaagagagtgtctacaggcagtggacttgctggtagagccagtgcaaggattggtgctgcagggcagccccatcgctactgctgaggtgaaccctggctcctcaccctggccctcaagaccttctctggccagattcagcttctgcaattccccagcactagacattacctctcaataagatggaagctcgaggggcaggtgaggaagaaggaaggtctgcccaaaccacaatggaattaagatgctactgcagaacctaccctgtgccaccacacacaagattgattgcattcagcaaatgtgtactgggaacctactatgtgtcaggcagtgtgctaactgcttttacttaaagtaactaattaatggacaaagacttccataagcccacatcccatgatcacttcacccctctcatctttcttgccctctcagaagcatttgacataattgatcctaatgtatttctaaatcactgtcttctctcagcttacatgtgttggttttctgctcacttccctggtagctcatacttgatcatctgtaaaaagccacctcctcctttcccctaccccattggtaaatgtcggtgtggccttcacctcattcctgggccctcagttattctctatccataccttctgccctaattgacattatcccatcccatggcttaaaatagctatgacatgctcgtgattcctaaatttatacctacagctcagacctctccccagacttccagactcatgttatctaattgtctgccagacttctctaattggatgaatcacagacatctcaatctggacacatccaaaagagaatgcttggtctttccatgccaaaactgttccttccccagtctcctcgtttcagtgtatggtaccgtacagtaactcaagcaccaaacctacgagttatcttagattctcccttttccatcacctcttcactgccaatctctcagcaagtcctcttagcctcacctcctaaggtgatcctgaatctgcccacttaccactacttcactgtgcccaccctggtcaaagccattatcatgtctcctccagacagtggcaacaacctctaaatggtctctctgctttccaggcctggcaccccttgtctgagaactcttttaagatcataaacagtattcacttccttcttagcaccatctcatggtttcccatctcacttagagtgaaatgcaagtgctctgctctggcccataaagctctcaatgatctagacccagcctacctctctggcttcactttccttttcccctccctctctttctccctccctctcttcctcccttcctccctccctccccttttcttccttttctttcctttcccctttcccctttctcctttctttccttcccctctccctctccctctcccttgccctctcgtcttgctctgttgcctaggctagagtgcagtggcacaatcttggctcactgcaacctctgcctcccaggttcaagcgattctcctacctcagcctcctgagtagctgggattataggtgtgtgcaaccacacccagataatttttgtatttgtagtagagatggggttttgccatgttggccaggctggtctcgaacctcctggcctcaagcaacccacctgcctcagcctcccaaagtgctgggatcacaggcataagccaccatgcctggctgtggcctcactttctatactgtccctagcctacttgtatccatccactgatcttttttctctattctttgaacacacaagtttcctcctctgttagggccttcacacttagatgttggctttctctttggatccgtctgataacaggtcttaattcaaaggctttgccacataccactacttcctgaccctgctaattttcttacagcttttttatcatgtctgaaatgacctcggttatttgtacatttgtgttttctctcatccctccccacaagaaagtatggtccttaaaggcagaaaccagcaggtgtttaatcaatcttagttgaataagtagtttttggtgttctcttgaagagctacaggtggtctggctcaaacctcaacttcatcacttgctctttggtggccataagtgtatctttcccccttttagctagttgcctcatctctaagatgtgaataatggcagtatgtacctcatagggttgttatcaggattaaatgagctcatgcatgtatacttggcttacttcctggacacagtaaaatgtcatggaagttagctgtgaatacggctgttgacattactacttttatgattgcttctgctcttcctgctcccacacttaaaagacacatgtggtagggaagcaagacaccatcttcactccaaccataacacgatgcttatactatgtgccaggcatcattctaaggctccacgggtgttatttaatcctcacaagcaccctataaggtaaatactttcatgacccatattttataggtgagtaagttgaagcacagaggttaggtaacctgctcaagatcaccaattaggccatggatacaagctgatagtggctgctcaactatgttgatttgcctcccctgttttgacccagtccctgaattcactcactactgtcagtttggtttgacagaggggaagaaacaaaacaaaattgtcctgggctgtgcttacagggaacatcatgctgggctcctcaccgccttgcctcatcccagtacctatgacaggggctgctggggtgggcagggagttttgatctttcctgctgtctccaccctggaggtaaggcacccggtggggctcttcagtcattcatcaactttcttcaagttatagaagtaaaacaacaaccttggagagaatctagaaaataagagaactgcccacatttcatggcccctgacctcatccctttcatatagcctctgctagtctttgtccacatatacttatcctgaccttgctgcattcatggtgagattatcatttcgcatgctgctttaacattcataaacatctctccacttgctccatctctgtgtccccaggtctttggcaagtcaagtctctgtggcctttcaaggtatcacttttactattcccagtcccacttgaggatttcacctgctgcttttatgctgctaaaccacaccctacttattggggaacctctcccttcaagactggcttttgaataggaatcaggtacctcaatgcctctaaaatcaattaaagtctgctttgttcagaaagaaagtgttctagctccacaggaaagcctccaggcatcactgtcctaacacacacggacaacctgcctggtgaaactgtcgagacccaatgcacaggtttctatcatcctggtcctttggtcctttgtctagtttctctcctgcctttaataaaagttatgctcattgtgtgcttccaatgtgtcaggggctgtgcaagagccctgtgtccatgacctctttccactcttacctcctggaggaaggtgtcaacatcagcacctgcccaggcttctggcggcaatgaggcctggaaacaatgtctggaactgctggctccagggcttgtgttcttgatgacttttatgtctttcctcctactatgggctgagttgtgcccccccccccgcccattcatatattgaagtcctaactcccagtactgcaaaatataactgtatttggagatagagcctttcaacaggtaattaaaataaggtaatcagggtgggtcttgatctaataggactggtgtcctcataagaagaggaattttggacacagacactgatggaaggcagtgtaaagacacagggagaagacagccatctacaagccaaggagagcagtgtggaactgatccttctttcgtagcctccagaagaaaccaaccctgccaacacttcatcttgggcttccagcctccagaactttgaaaaaatagttgaattgtttaagcagtgtagtccatggtactttgttgcagcagccctggtaaaccaatatgtcttttttcacctgtcttttcctatctgcctgcctttccaccacagatgttctatgaagccccaccaggtgctatgtaagtattgtacaaattcagtaattagtgagataaagtccctgtcttcataaagattgtattccagtcagcaagacagaggctaagtaaagcaaacaactataatggaggctatgaaagaaataaagaaatagagtgatgagattgagagatggtaggtgcagatggggtggacagagaagttaactcttaggaagtgacattttctcagaaacttaaaaagtcagtacaggccagacaggtagagtgtgtggggggcagggagaattccaggcagaaaagcatgtgcaaaggccctgaggtgggaaagggctggatgtattggaggtgtaggaagcaagccagtgtggccaggctacagggagctgagcctggaaatgttggcagagaccagatttacggggcacgttggaaaggagttcaggcttaattcctttcattccccaggttggtgtccattacacctggccagtttcttcacccagccaccgatactcatgcgtggaaaggggaaagaataatccactctagctaagtactgctgccatcagcaccctattgtttcagacatctaaactgcaaacaaagccctgtcactaccgccagaagtggtagaaaaaaataggcgagggagaaaaggaatcatcctttccaacccctgctgagtatgcagagtgagggacatatggaaattaataaatgcagctctgataacacggttctcctcggcattttgattaaatgctgttggttattaaatactctccttctcagagctcatctccaaaagccaatgttgcttttcattttgaactctgatgaactgtctcaattccgatcacacacctcggctgaactgcggttgactgcaggctgccgtttgaggaggatggagaaaatcaatatgaaatgtcaggcgaggggtcagattgaacttgttttcccagctggcaggagctggggctcgtagccgcagcagctgaacaaagggagatgtgcactgaagaaggttggttctttgaaggagtcaggaaaatgaatttcatttgcttcttaattagattagcaggctggcagcttgcaattcagaactctgttggtgttggaatagggagtgggaggacagggctgggcagaggcctgaaggccagtagctggctcctccgcctccttcaggacagtcaccagggctttgcttctctggggctgtgtggggctgaggctggagggagaagcagcttctggggctccctgggtgtgtggcttgaccggcttcctgcttctgtatgactgcatgattcttccctgggctctccccgtctgcttctccatccttaggtctcagctcagcagtcactgtcttgtagagtcctcaacacctctacttgtaccagcacatgcctctcttttatacatgtattgcagttgcgatgctatatttgtttctgttctctaactaatgcatcttctctccttagacagtgtggttaatgttatgtattagcttgactgagccatgggctgcccagatatttggctagaaattctgggtgtttctgtaaaggtgtttttggaatagtttaacatttacattaatagactgagtaaaagagattgtactgcctattgtcaatgggcctcatctcatcagttgaaggcctgaagagaataaaaacgctgaccctcctgcaagggaaagagaactcctctgccagactgccttcgagctggaacattgtatttttccccccttgcttctggaattgaatggaaacactggtttttcctgggtcttcagcctgagggttttgtttatttatttttttgagatagagtcttgctctgtcgccaaggctggggtgcagtggggcaatctcagctcactgcaacctctgtatcccaggttcaagcgatgctcctgcctcagcctcctgagtaactgggactacaggtgtgtgtcaccacacctggctaatttttgtatttttagtagagacggggtttcaccatgttgcccaggctgttctcagactcccagccttgggtgatctgcccgcctcagcctcctaaagtgctgggattacctgtgtgagccactgaggccggtctctgatggcttttagattagaacaccaccatcggctctcctgggtcttcagcttgctggctgcagagcttgggacttgtcagccttcataaccatgtgatctcattccttatgataaatctcttaacttacacacacacacacacacaccccctactggttctgtttgtctggagaaccctaatacagagagtaagctctaagagggaggaaaccaggtctgtttttgcttacccttctgtctccagagtctgatacagtacctgacataaagtatgtgattaacaaatattgattaaataaatgaataatgaggcctcctatatctggcaagagggttggggtttcgaacatcttatgtctgcaggcctagaaccggaggaatccagggtgaataattgtgataactgctgccgtcatttattgactcctttgtgcctggcagagggctaggatctcacacacatgaaatttagttcttgtgaacaacctgccctatgatgctgtccttaatatttctactttcaaatgaggaatctggggctcaaaatgattaaataacttgcttgaggtcatgcaggtactgagtatcagagctgagttctgattccaaagcatctgctctaaatcactctagttttttttttttttaacttttaagttcagtggtacatgtgcaggtttattacatagctaaacatgtgtcatgggtttttttttgtgtgtttatttcatcatccaggtattaagcctagtaccaattagttatttaccattctagttttgaaagcttctaaggccttgccctttttctatcttgtgttcagttcatcaagcttcccagtcagttgattccccaatatccagaatgcatgtggatctgtctgactccaaagctgaggctagtgtcagccacactgggctatggggatgccagggcttcccgtgccatccctggcctccaccctgggttggtggcccagaaagcccggttctgccttcactcactagagaggccctgcctccttagacagctcatgtcacctcacccacagcatgtccggtactgagtcccaacccttcactctctgggagagagttagagactttccatccatccccattcccacttgttatttatgtcaacccttaggcacacatttattaaatatttcctgacctctgcttatgtgtcaggggttcatataatgtgaccaagtcagattcagttcttatcctcaaggcatttactatctacaggggaatgacattgaacaattcatatcacgtccatgtatgacgaatgccaacctttaatatcactaatgtcacttataacacccatagttattttaaaagaaaatgttcattttcccccttctctttctttggatttctatagccaccattcttgatctaggttccaaattatccttgcattgagactaaagcaaaaccttctaactttcctacctttattcacatgaccactgtgttaatcttccataaaacacaatttttattaactctgctgtccagcgaaatgctctcaaattacctcccacatactagaaactgtgcttctccaaccggggtacctgtatatatccttgggcgttaggaagaggggaggatatgggggtatactaaaaagtacaggaagccataggataaatgttacatcttttggaaacaccagttttgtttaaaatttgggagtgggggtagaaacataattattaaattaaagtgaaaatagattttatatgggttaaaatgtaaaattcacatgaatttttagaaagaaaaataaggcttcaaagaaaatctgttgtggtcagcacctcccccagggtcgctggtctctgccaggcatgggctgttttgcctttgctggtaggttgggccaacccagagcacatgggaggaactggattcctctctgtgccctccttccatggcagcagggttcatggcttggccccaccagaactgtatttggtggaacagcttaagaaggactggatactatgggaaccagactctgggtataatataagtactcactgaatgcatgaatacatgacagcataaactttggaatctgatcttcaaggatcaacctgatatgaaccatcattgctatttaacctcattaacccaagattcccctttcccccaagcctgacactttttatttaacacccttcaaatgttccattactttagtaacttcagaattttgcccattctgtggttgctgccaacaatactcttctttctgtttcccacctaaccaaatcctacttgtacttcaacactcaactgctcagcctctgccttccctgtgaggtctgtttcaaatgtctcaaccgtctctgaatggcctaacccataattatctccatcattcacttgagtattaaaactaaactgccttatacattgttcctgaaatgcttcctgggtgcatcttgcctcattagccaaattttaaattccttgagtataggagataagtcttacctttccattgtacccctcagagttctttattgtaacaaatacattgtagatacaagaatatcatgcagtatctgtgactgaatgaattgtagtctagatcagtggttctcaactgggagcaatgttttcaccaagagggtatttcacagtgtctggagacatttttggttatacaactgggcttgggttattggcatctagtgggtaaggccacagatgctgctaaacatcctacaatgtataggacagccccttccccgaaacaaaaatctatgtagcgcaagattcaatggtgtactgttaagaaatgcttatctatattatagtggcttcctaacctgtctccttgtttctttgttctctcagccagaatttaacctttatccttctgccttccatctgaacaatttccctaacaactaattctgatcatactactcctctggttacttttgtggctgttcactcactttgatgaaaaaaatttgggttttaaaaatcatggtcattatgacatggctctggcatcctatagtcacaatctctccaagaagccaccagctccttcccccagctgctgttctagatggcttttatgttctcagcctcccatgcagttcagcaagtcctgttaattttattgccaagatctgtgcagtactgtgcaggttacatggattaaaaaaaaagatgtgtccagaacccatctgccctctcaatttccactcacctctttgtccaggccacccttcaacggtctcctaactggtccccctgctattcctcaaagtcattctccccatggcagcaagcatgatttccttaacacataatttggatcacatcacactgttatttaaacccttttctgatgagggtcatgtcttatttattttcatctctggatgttttggaatcgaacacaaatgttcatctttactgaaatataaaatacggagctgactcccacttgtagtttctttactcctagtgtgtctggtgtagaaagggagatcataagcttccaggctctcccccagcacattggggccagtggccatgccccccacctcccttcagttgctactcacatttggtgtgcctgtcacacagggcagatgcccgcatgtcacacagccggattgtccctttgctgctgctgtacacgaaggtgttgcaatgatgggggtggaactcggctgctgtgatcacctccgtgagctcctccatgttggctggcttaatgtccacaatatctggcacagacgagtcaaggaaggaaccaggagaaggaggcaggaacttggggaaggggagaattagcaatggcaccatcttatattagtaaaatatgtcaacatttgctatgcacatggtagatcctcatcataaacttgtcccaggcagatgaggctcaggaactttaagaaaatagcccagggttacccagtagtcagaggcagcattagaactcaggtctcttgactcctcatttgtgttttatcctctataaacatgtaaaagacatccactcatgaccaaagttaactgcttgtgcaatcaggctaaaatgtaccaagttgcaaagattttgcttctcattttataataatgattaaggtactggtcctattataaccaaataattcattttatctgattccttaatggattattgggctgataagtgatatctataataatagagtgcatatcttctttcatgaaatccctaagcccttctttataatatgttgatgataataataatagctgccaccaataatggagcactagctataggccattcactgtacaaagcatatcatgtactttatctcatttaatccttacaagaactctatataattagcgttttccttatcctcattttttcaggggtggaaacggatgctccatgtgcataaagaaacttgcttcaagtcacatggctaagtgacaacactaggatttcatcccaggtgcaaagtctgtgctctttcataattatgcaaaatttctctcatgtatgatatataagacttctagtctctgtaagttgtgatctgcttttcagcttgtgagggagtttttaagtatcagaaacaagccatccagttggaaagttttagggtcccgtggaaaatatccttagttttatcatctgggtttttttttctcagtatttccctttctgatcaagaattatacctctattttttaaagaccatatccttgtatattggaatgaaacatttagtcttttatttatgaaggtgactcaatgaaaataaaccccttcactgggatgtctggcatgagtgaaggagtgggtttgtacagatctcttcacacctccacccagagcttgggggatcaggacacagaggggccgaggtactgtctgaggacccagcaacatcctgcaaagaacaagccttgtgatgtggatgctgttacacagtaaagctgaccaacaggactcccacttttcctagattttcctactcgtgagccacctttgtgatttttgccctatctgtgcatcatcagatagtactttttacttaacatttttctttcagatcaactttaaattgattcacttttttctttacttagctttatctaaacagtaacccaatgttcataaaatcatgggtttaataaggtagctacattttaagtaatatgcataaaaattgacatgtgataactgcaaatgcgtgtgccaggagtttatgcaccacattttggacaacaatgtattgaatcaacaagcaataacttgatataactgccccattagactgagatggatgaaagtcttgtatgcttttcattaagctagtagcatagtcccctccttagagtttagatgcggtacaagcaaatgcactgatatttttagtcccgctagcactaacaaagtaatcatctatgatcaaacatcactatgctcctgctacaacattccaacatgcaatttgttgcaacaatggctttgtatttggttgtgcctctttccccttcattatctcttataaaccctattgggttctttctaaaattggcatgagactgagctaacagtacatgttactacaatttctcctaccaaacccagatgcaaatattacttgggtctccggggcatgtgagtctcctggattcacaaaatactacccttcaactcaacttctgccagagttataaatatgattgcagttagcatcacatgctgtggagcaagagcctgtgcccctcaggaggaggctctaggctgcagctccggtgctctctcagccactgacccatgccctgggctttatggccatgacgtggcgttgggtaaacggaggttagttttcagctgctgttagatttcctcatcctccagagcaagccttgatatcccactgtgcctgtgaacatgtttctcttttctccaaatagggaaagaaaatctggtgtcagctttctcaacctctaccagtatagctctgaaaacaagctgaactggaagggatcttcgctgtgtgggagggggaggtgctacagctacagttattttttcccacctaaaaataaagccccaaagtaagaatgtgcaaaaacaaagtgcctaaacatgtctatgaaaccaggcacatcctccaccatcaaggatgccagtggggctgtgcccacgagatctgcccagagctgccatctctggatctttccttccttcactggaccttccaagcctacccaccacccagccctcatccccaagccattggcttcctatccccagcaggtctcagtcttcctttttgagtagagggcttgtttagtttgactcaaaggggttccagggataaaccatgattatccctctttttaatcactgggatgatgaagttaagaggaagatatggccagttgctaatgctgatcaggggccaggcctgccctgtgctaacactttccatgtgttgtcccccttgcccctcatctcagccttatgagggcaggattattaacaggtccattttacagccgagggaactcagataaattactcaaggttatgtgacacagtgggcagagctgggatttgaacccaagcttgtctgactccagagcccgggttctttctcaccatgccactctgcctcccttgaggaatggcctcacaaagctggccaaaatgtgacaattttggttcctttgaaaagacccccagctaatctgagagggcagccccatctcttctggctttaggcttgtgctctcttaatttacctaccactttggtgactgcattttccagaatcagaatttttatgtgctctaagattttttttttttttttttttttttttgaagcagaatttgggacacaagcctgataagggattatttggatttttacctgctggaggatttggtgagttctagaaacatttgagagaagtctagttgctaaaaattaagtgacttatggggatgatgggagaggatattcaacatctgtatcctctagaaacccaggcattttcccctgcacaactctaaagggcgatccatgttttcagcatatgtaattttgcccttcatgttgggagggaaggagaaagaagatgagcaattcgtggctccacgtataatcttgaaaatggaatgatgcattttgacagtcacttttattttttttaatcctttagagctctctatccaaattatttccctgttgtcccaaataactagatggcaaaagcaaaacagagcattgaattcatggctaatatacaaccccgacagccaacagattgccattaaattaaccctggggcttgacagatctgttcttcttgacctgactgcttacggcatttcttattaatgctgagcccaggcaaattacatctgctaacaaaaggggttaatctggctctctgctgggactctggaggcagctctgaggacaggagggggcatagccagcttggcagctgagctccatgcttggaaggcagaagaggggaaggtgagggcaccgctgtgccaggcagtggcctaaggcatcatttaaaataataattgaagacaccaggaggtcactccttaagggatccacttcaaacaaatgggaagccagagccacaaatggttcatcagtgtgggatgagggaatggagagggtcatggcaggatggtaagaggtagcatgggggccattcaaacatcatttcctaatcccaagtttagaaaaagctttttatgaaaacaaaagtccagcatgatattagaaaaagattgacaacttaaataaatatacagaacaaggaagtgattagatgaatttttatatatctcattaaattgtttttgcagtgaaatttccaagtctgtaaaaaccatagtgcacaaaattctaacaacagtttgatgatgtcatttaaaacttatactctgaaaatgatgagctaaatgggaagacactaaaacattagtgatagttctatcagggtgggtttacgaatggtttttcttttgatttcaatgatcagcacaatttccacattttcttttaataaagttgtatttcaggctggaaaaaatcttagggccacgcatggtggctcgcacctgcaatcccaacaagttgggagtccaagatgcgtggatcatttgagcctgggaatttgagaccagcctgggcaacgtggtgaaaccctatctctaccaaacatacaaaaattagccaggtgtggtggcatgcacctgtagttccagctactggggaggctgaggcaggaggattgattgagcctgggaggttgaggctgcagtgagtggtaattgtgccactgcactccagcctgggtaacacagccagaccctgtattgaaaaacaaaacaaaaacttaggatactttccatacttatgatgtgtactattttgggtaaggaaagttaggtacaaagtatatacagtctgaccaagaccacgtaaaagatattacacacacacacgagagagagagagagagagagagggagacagacaagggcccattcactcatttctttctttgtgtattctataagtgtttccaaagaatctataccctgccagtactcttctgggtgcaggagatacagtagtgaccaaagcaggccccaagcccccctgatccatggagcctatattctagtagggaacagtcaataaacaaggtaaatgagtattatacacagtatattaggcagtgataactactaagcagtaaaagcaggaaagggagagagaaattatgtctctatatgtcctagattgaatagaaggaaggttcttggcattgtatgttcccactcataagtggaagctaagaggatgcaaaggcataagaatgacacaatggactttggggactcagggggaaagggtgggaaggaggtgagggataaaagactacaaattgggttcagtgtatactgcttaggagatgggtgcaccaaattctcacaaatcaccactaaagaacttactcatgtaaccaaataccacctgttccttaaaacctgtggaaataaaaaattgttttaaaaagaaaaaggcatatggtataatcccaactatatacaaaataaaatagtctgtgaatatgcctgatatataaatggatagaaaaaagtgtgagtccatatcctaaactaggcgagcttccataaggaccatgcagcaagtattttcagccttttgggcctttgccaccgctattcaactttgcagttgcagcaggaaagcagccatagataatatgtaactgaaagggtgtggctgtgttccaacaaaactttacttacaaaaacactttgggatagatctggtctgtgggcagtttgccaacctgttctaaccttttagcagagtaagaggtgaattgtttattgctaaagtaatttaccaaaaaataacttgtattcatgtattatttgtattaaaaataatatcaataaaagaatatcgtaatgcaaaaaaaagtggattaggaacctgaacttcttcccttaggaaagtttcaaaaaaaaaaaaaaaaaaaaaaaaaaaaagaagaagaaagattcttgggtaaatcaggagttttaaattgtttttggctttggcttttaaaatttcttttatttccccctgaacccacattgttgaattagctagcattaagttaaaactgtgatgcgaatccaatgtatagacagcaaaattggtagtaagatttttggtcattttattttccccaaatctctacaatgaatacatattaaacaaagaaaacaataagcattaaaaaatagcagtttccctggcttaaaatcatctgtgagagagctgcgagaccaggaacctcatctcgatgggtaaagtttgagataatattgtgaaaaatacagtgattgtaacaaaatggggaccagagattgggattcagttttgattctatctccattttgctaagagaatttgggaaagtcattttatctctctgggtttccatttctttgcctataaatgggtgtaaccctatcagcctctaagaattttgattattaaacaagataatggaaaagataatttaagtggttttacactggagtgaatattccttcttctgaaggaagcacatatttctccaaggatagggtttatatgcattgcctttgtgaggtgactttcatatgcctctgtccctttgctgctgattttgctaatactgacatgcgtatttccccaattcctgtctaagccaatggaggataagagagccaagtaggacgcttttctgcagggctgagtattataaacattggccaagctgaagagtggaatctatgtttaccagggtaaagtacccacattcaaaagcagctgaggcttttcatatcccacttaaagtctgccagtactgaaggtagaaaatagtaatatctttgtgtgaacacagcgtatttgtttgatgagtgtgatttccttttagggacatgagttgctttgagatctttttccctttccatggtctaaatttaatctttggatattaagcaatgattatgaaacataaagatcttattagctgaaaggacatgttgcttgatgatgagacactggaaatctccaaagaggactccaagggatattcctctcttaagagcttaaaaaaaagtcaatgtgtaaatattcatggagtgtttgccaattcctaggctcaatatgaggagactgacaaagagacacatggtgtcatattaaatatgtattgggcagggtgaaagccactgaagcagcaacaggggagaaacttgtactagaccccacagttcccctggaagcctgcctggcagaatcccactgaattaaaaggaagctgctgtccatggtagtaatgagtgctagaacctggaagccaagagttgaggctacctggtcccttaattagggaatcgactctaacagggcttcagcttggttgacaaataaaatgaagccactgtacagggttgttaggaccaaggtcaaagttgaagtatccctagagtccagctggcttctcccagataagtcctctatctcatattcagagactggacttctgaaaggtgaggcttctgctacccttcccagccttgcttactccatgctccacttcactctctgggcttcaaaaatagtggccttcttagaattcctccaacatgtcatactctctcctgccacaggacctctgtacacactgaacacatgtctccacacctctttgccaagttagttcatagtcttcctctttcagatcttaactaattcttcagcaaagccttccctggtctatagcaggatttttaaaaatgcattcatagaaccatattccctgtcttcacagaaattatctcagtttgtaattatatactcagtgtatttgatgaacattactctgaaagcggcaaatttgttttttcccattttcatgcctggcacaaactaggtgctcaatttatcatcgttgagggctagtctttatttttactcgatatgggcctatttaatagatcccatgttggacaaggtaagaactcaggtcagttcattcttagtcctgcaaaaagagttcaaaggattctaggtataccatagttttcataaagaagcaacatcttttaatataaattttcatttattgctattgtctcttgccctagaaaactactaatctattaatgagttgttatagtcctgatgtagttagcctattaagacgaaagtttgactgcttatgtgggaaactgttacacaagacaaggacagactggctatggatggaagggagagaattcatgaccagttatcatgaggtttagaaatgccttgctctgatctggtgctaaacacaaggccctagacctcagagttcctgaaaacatttagtaactagggggcagcatcttgcaaaggacacccaactgcagaaccaaaggaagagtctagaattgaaaagacaatccagataataaaattagcagaataaaagctaccattctaatgttcaacttttctagtttccttgttctctcaataattatcatgattgtgctagtcctgtttactgagcatttgcttagcaaggcactaccctaaatgtgtgcgtgcgtatgtgtgtgtgtgtgtgtttaattttcataatcctctcgtgatagagctgctttctacagatgaacaaaatgagaaatggaggcttggatagattaagaacatgttaaagcttatacagccagaaaagtggtagggctgggtgagacctctatcacttgttggactctgaagcctgagttctcaaccgtaatgccaaagtcacaccaaatgccagtcacaggaagtcatgactgttttctaaccatatctccagatcccttgtctcactatttacttaatgctttacatacacttactttgtaatctaaatagattttgaatatctatgaaattgtaggatatgatggttatgttttttgacgttcactattgcttagaagcacattgcttaccatccccagtagtagccacactatgctttgggaatcccaaattattctatcctgaaccatgtttcttctgtctcctttgtgaataaggggcattgtggaaatgagacctgcctggtggctggtatttttctgagactgttttgaaagatggccgcttcctaccccagaggtggctatacttcagtgatgagaggctcagtgcttagggcggtctggttgaaaagaactatatagatatcacttatcatcgttctcatgatgacaatgattattttacatatggctgctttaagggtgaatggcacggtctcatttgtatgccagcatctggcagtctgtcacacatctgcagaatataacctaaactgcgctgttaatatttcccctttgcattctccccaaggcatctgtctcccaaaatgcctaaagaaactcccctcccccttgaaggcctagaggcaaaattcagaaaacatgtcacctagactggggaagcagaagctcagagtgacagccagctgagcctgagcagatttctggctcttggaatagatggagagagaaaaagggaaccaccacccacactcattctattagcagctgcactgccaggcaaaatctgtaggcaggcccagacagcatgtggagtctgttccgtgatcaacaaaatatgccaggcatggtcctgatggtcagttctcattgtctccaaatatatctcataattgccactatctgattaaagctgccttccctgaaagcccttggagacggttgagtgctctccatggtggagactagctagctgtgtaccaaaaccgggtctttttatcctgggcacacagccagactacatttcctaggctgccttgcagttaagagttagccatgtggctgaattctagccaatggaatgcatacttttttagggcatggctcagaggaatctcccacttgtgatcttccatgaccttccccttttacagtcctgctataaacatggtaacattggggagctgcaaatgaaagaggcccgagtttctgaattactgattggaggaggctgcctgctgatggggatcatcaatattagacttcatacgaaaataatcttttatttgtttgagccattatggggtctattctataaacgaaccttcagagctttactataactcttaaaattaaatttccaggttagattttatgaactgtctactggatagcgctactttgatgacctactattatttcgaacttgacaggttcaataattttctgtatgtcagagtgttccacgtactggaatacagcaatagttcatacaaggcccttgctcttgtagaatttacatcctaacatgaggaaaccaaaaatacataagtaaaaaaatttcaaatcatggtaagtaccatgacaataacagggatagtgttattggtagctacttaagagttaatgggaaagagtacctctggggcctgaagtgacatgtaactagccatgtgaatgctgtgggcaaaatattctagaaagagggaacagcaaatgcaaagaatggaagaataaggtttacttaggaacagaaaagtgattagttggctgaaatgaagtgaattagggaagcgtgacaagactggataacaaagatggagacaggttccagatcacgcagaatcttataggccaagttaaataacttggattttattctgagtttagtgggaagctactggaatgttttttatcagggaaggaatgatatttgaattacatgttgaagggttcgtactgtataaaagagcaagaatgaatggagaccagatgagattattgcagtcacagtggtgagagacaacagtggcttatgctagtgtaggtaggtagatagggatatatgcgttgatttgacatatattttagaggcagggctcatggatagatggagttagagtaggggaggctggtaagtggaagagaaaactccatattgatacctaggtcaattgttcagttacctgagttgttcagtgccattcctcataaatctcatgccttaggtttgtgagaaatggagcacatgataggtattcaataaatgaccaatttttactatgaaatagagggtcaacatagtgggggtgaaaatactggcccagctattcagcattttttttttttacctttctatatattttttatttttattatttttttgagatggagtctggctctgtcacccagactggagtgcagtggtacgatctcggcttactgcaacctctgcctcctcagttcaagcgattctcctgcctcagcctcccaagtaactgggactacaggcgcccgccaccatgcctggctaatttcttttttgtatttttagtaaagttggggccttgccacgttggctaagctggtcttaaacctctgacctgaagcaatccacctacctaggcctcccaaagtgctgggattataagcataagccactgcggccagccgacttttctatattttaattaaacaggagataatgatacttacattatggggttgttttatcaaatatgtccttgggggtagaaattattaatataaagaggcatgatgggggcttgagaattgttagcaaagttctgtttctggatgtcaatgctggttataggtgagttcaacctctgaaatttcatcaaactgtataattataatatgtatactgtacattttatcaaactgtacaattataatatgtatactatacatttcatcaaactgtacaattataatatgtacttttctatatgcataatatacttcaatgaggtaaaaaatgtaatactataaagttcccattgcaagtgcttggaactcaataaatgtcagtcactattattttcactattatgagacaatggaaaccagtatgtctgtggtccatgctgtccatacagatttatgaatcctttaacagagaaagaacctgaactctagggtcttatcctattgttgataaaatcacctctaattttaattcgtgacatataaatgcctctgtatgaaggaattgattcagagtcccaatccagagctagccctggcctcccacttgtaataacaatatttccctaactttattgttatgattaaagagtctcataggtgccagtgtattttaaaaggggcaagttctccgcaaatgctaggtgttgcatttctattccatattttctcccagcccactcgcacctgaatactcttaattcaggccagttgattcttgatcacaaagaaaggatactaaaactttgattggttatttcaaagttccataggttaatcctcaggtcatcagcggacatgtaggtttcatagtcgctgttgacagatatggagttgatgtgatatgtgtgtgcgttggcaaatactcttcgtggggtggcctccaccatcaggtccatgggtctcaggacaggcacctgggatgcaagagaaacaaatcacttcagaaccaaagatcttccataggaaaagagtgtgcatgctaatatcatttattatcacacacaaaataatagccacattgaagaaactccaagttagagaaagaagaggctaataacgaatcacacactgttcttgttccattctgttcctcctctttcaaaagatatcaccatcacttagccctggtgggaaatttcattctttataaattctaaacatttttctaagcccctccaggtagcctcatctcaggggaacttggcttccattgtggagtcattaccttccagagacattgttctattttttttttaaacatgaaatctatttaaaaaagggagttgtgggaaaattttagaaatgtctagttcaactttaatctaaatttatcttttatgtcttttcatctcatggctttggaagctataccccttcctggctttgtccttaatccttaagggcattttgggaaactttagcatcacccaagactctaatcgtccaaattcagccactaatatatagggaacccaatgacatctgactgagaaaatcttggtttatatttgtcttagagtgcgaaccaggtagtgtccacttttacatgcaaaactgtcccagtttgaacattaatgatatggtcaccttactgatacataaatacttctcagtaagtatttgttgaatgagtaagaatacatgattaaatgatttctttctggtggatcagagaatcggcaactaaatagtttcccacacatgaccgtctttctggcaaatgtgaacaaagacctatcactcttcctcctttgagttctgggtgaactggctacaaagaaagagaataagaacactaatgcctgagagggaacaaactaaaaaaacacccaagacagacaaaaccccacaacacaggtgtggtcacttaatagaaacaagataataaaataaccaaagctattttcttttcaagcaaatcatttcttgcaactgagccccgactgatttgataccaggtggtagattaagacttcaacttctggattggcttcaacccaggtggcgaggagaagaaaaacaaaagttaaattttctgaagtgcagtcacctcaccaacataaccttttagaaaaaagaattctcccagttcagacttgagggactttaactcacctatgcgggagtttttaaatcaaatcaatgattcagaggaaacacagaattctagacagatgtggtacttgataacccagaaaccacaggtgacttgaggtgtggctgtagaagggtcaggggtcctctgaatactaggaaaggaaagggaaggaaagtctttgtggtcccccatcccaattacggataagggcctatagattaagtgtgtgtggcagcgaatgggagaccagggttctgatcagattcaccactaaccaataggctatgaggtctgggcaactaacctgctcctcctaagcttgagctcaattgcactgtctgcaaaacagtgaccatgctccctgtgctctcactatcgcaaagggtggtttggggttttgttgagatgatctgacctccaatgcatcctcctacccactctttcaacaatatttactgagtgccacacaaagtcctggagtgttcaactggtaagcagaaccagacacaggtcctggcatcatatacctgttcttgtcaggggagatagacataattaaaagggctaggtgcgcaaaagagaggatatactgccaagagggatttaacctgctcagggagaactgaagaggcttccctgagaatgtatgtattggaatgtgaaagatgggtagggatttaaccaggccaggaggggagtgaaagggagaatgtgtctgagggatgtgcaaaggtcccgtgatagaggtgaacaaggcaagagtgaaaaactgataggtcactgtagttgagacagaagtagtgaagggagctattgtgggagatgaggtgacaggctaggtaggaggcaacacccccccccaaaaagttttgccattattccaagtgaatagggaaaaaaatgaaaggatttgcaatgattgtgatataatcaaatccaggttttgactagatcagtccagatgtacaatggaaaacaagttagaggaagaatgaggtagaatttttaaagtgaagatcatacacttttggacatcaactaagggcatgcctgagttaaggcattgcgatggataaaaaagtgactttgccctgagaaacactacaccaaaatatttattgggcattttctctgtgtcaagtattcttcatacataatctcaggtaattctttcaaaagctctgtgaaataggtactcatacaaacagaaaactcaggcagagagaggctaagtcactggcccagggttgcccagctacaggaagcatagctaggtttaattcggggactggaaagtgaatgttctttccactgtaccacatcacattgaaatatcacacagggtaggtatgataaatgctctgaaagtgacataaattgccaggagaatttatggaataactagtgttactggtagttataatggtagtggtattcatagtagtgtggtagttaagaaacctcaattaggtgttgtaggtgttcatggtatttgaacagggcatctattttttcagaaatgtgtgccatgcttttatagtttgtcacaaaggagctccccacctgaagcttgtggttgctacctggttcctctgccgtcaagaggtaccagagctcaaagcaggaccccaagggtcacaaaagaaatggaatctgcaggacttcctgtggctcctcctaaactcttccccgggcctcctcagttaccgtgcattgtctgcagagatttcttgtggctgtggcgacatgggagggagcatgcagccaggaacaagaggcattacagagtgggagctgccagcccacagcttcagcttaatgtgatgggcctgcctgctaatttaggctgacatattccatgatgtactacttaatggggaagggctccgtgtaggtatctggggatggagcctctaatgctttgctcagataagacaggggggatggagagctgaatgccgctcgtggtattccaacatcagtcccaggcctacgtcaaggcttgtctgctgcccagtgactcccctcacaaggagaaagagggaagtttggtggttcaagcaggacacgatggaccgattaggaaaccacattgcgactgtgtttttcatctgctctggccacattctccctttaaggccaggcaggaaggagatccggacactattccctgagtcaggtccacagtcaattgttaaggttgtctctggaaacatacacggagagcttcttgtgccagtcactgagtttagaacccctgactccctgccccacccaactccaaggtgttatctcctccagcgccctcagtaaccaaccttccaaggaagattcctctgtttgccccattttacaggggaggtggggggaggtggagtatccagtccaatgtcacacaaagaataagctgggggctaggatctgaagccagttaatttggttcctgaatgagcacacctagccactactgtgaatgaaactattaggttgaaatacaaaactgccatgtttgcaagtcaaaaattgtgaaatatcagcaatctcatgcggtttaacctaacactttggaaaggctctgtggtgtatggatgtgacatcaaatcagggaacattttgccttagagcctcttcctaggacatcatctgtgtgtgtggtgggagtcttacagtgggaggccatagtgtctaggcctctcctccttcattattcttggtattatatgcttgcatcctcaataatatcatgctgaaagaactatttctgtggataagcaaagtatgaaagtgagtagccagggtagttcttgaaatctacagatgaggtcattgaggtctgagaggttaagcaccttgtccatggtcacccttccggggttgcttgcacagcctaggtctctgcttcctgtcccagacttctgctcccacacaccatctgcctgagccatcctccacaggaccagaatgcccttttgccaaatgacaaaagcagagccagacaaaattcagatcaggccaggacgtcttaactcagttcaaaccttgtctgagccatgttggcagagtaattgatggggctaggatcaaggcggagacaagggatgtgctgagtgaacagtggtcagtccttggccctctgagcggtcagtccttggcctgtctgcaggtggttctgtgttgagcagctggaattcagtgatgtcccccgattcaggtgcttcaccctcctctctgaccctggttgagtttcagctcattctcctaggctgctttcaaaggacgcacatcccagcactgtgtcttgcctggacacccagtattatattagaatatcaaccgaataatgtcccaagccccaaaagagcagcctgaatctaatctgcaataaagcttacagagatatatttcagttgtaatattcctgggaagctcttcccccccagagagtggcacggcttccccgctcacttcaatcagtccctgctcaaatgtcaccccctcagggaggccttccgtgaccatcccacctcaaatcgcacagccttcagtctatcctcttccccaactgactgctcagagttttttaaacacttcagcagttcctcagtgaattttcatcgctatcctatgattaacttggtagatgttacaatccctattgcacagatgagaaagctgaggcagaaaggtgaagttgtctgaaggctcacagtgagtctgaggcagggcgagtactcaggcctggcactcctgccactccttgactcaggagtctatacccttagtcgcttaaggcacactcagatgcttgggaggcagacaagtaaatagatctttcagcgagggcgatcacgctgccatggaggtcatcaggcactgcccaggccgtatgaaccaaacgggtcctgcctggggatcccaaggcagacctcagaaaggagaagactaccaagctaggcagggcttgaagggtgggtgggaggtccccaaagagaggtggggggtagggaggggagggaactgggcttcagtcagagggaccagcagtgtgcaaactcagaggagagacagcaaagtatacacataacgatgggtaactgtgcttctggggtgaggtcagtgatttagttattcattcaacaaatacttattaaatccctcctcaatagcagacatattctagggaccggtgccacaacagtgaactctctgtggtacataagttcttgtgtgtatgtgtacatgaggaaaacctgagttgggtaaggggctagcaagcgagaggtatgctctttgaggtggggtggtcatagaaggcctctctgagggagtggggtatgaacagagacctgaatgaagtgagagggggagccatgcagcaatgtggggaggagcattccagccagggggaacaggaaatgcaaaggcactgaggttggagtgtgctcagagtacaggaggaacaatagcaaagagctttttttttttttaagtaagaaatggggtcttgctatgttgcccaggctggagtgcactggtgattcacaggcacgatcccactactgatcaatacgggagttttcacttgttctgtttctgacctgggtaggttaacccctccttaggcagcctggtggtccctcactcccgggaggccaccatattaatgtgaacttagtgtggacatcctaacagcatagggcactacagcccaggactcctaggctccagtgatcttcctgcctcagcctcctgagtagctgactacaggcacgtgccatgtacctgtcagcaaagagcttttatggctggagaggagtgagtaaggaagcatggcagttggagaagatgttggatcagtagtcagggccggatcaccaccttcactgtgcgggtgaggaaagctcagggaggtgtggctacctgtgagtagctgcctgatatgggactctatcctccctcaccattccttctgtctctgctcacccgctttgagtcttcctccctcaggttcttattatctttcccgcctctcctcttgggaaataccagatcatctttaacttcccagaacgcatttactaacaaaatgaatgttgctgtcatttggcttatttggtgaccacaccagcgattcttcacaatcttccatgacacctaagtgggggttggcgggtcacagtgccttgcttcagagacatgcaattaaagcagagtagagccctagaaaacaggaagcccctgaagcctccactttaaaaaacatatgtgaaaaggcacagcaaggggaggccatggggaggactcccctcaatgcgccttcatgagaggagtttttcacagagaaaaaacaacagctgtgtttaccatggcaacctccagtagctcagtaaattgacagattcaaggcaagactcggagaagagagaagagatggccagataggagataaagaacagaaaagatgaagtcatggagaaggaagaaaagagagatgtctgtctgtaggatgtggatggattttagctgtttagtaactctaggtcaaatctcattgaggtgaacagacaaacctttgaataccattgcttgttacgtacaagcataatcaattatgttatggaaggagcatccacattctccttcctaaaatcagatctcaggagtacccacagggtaggttctccttacttttgcaaaagaaagatatagaaaatgtaccttaacttatcctgaatcttactaaggtgtactatgcaattcataaacacttctgagagggacatttgcatgatacttttaatcaaggccccatagacgaccccatccccagctcattatgatacgtacaacataatcaacattatggggtcttttgaaaaaattgctgtcaatttaaatccacacttgctccatatctccttgttagtgttcaacagatgctccccattcccctctccaaataattgagattacatttagactgacagtatatatcaaggtcatggggtttggtgggttctgtatcatcaattaggaagtgcacataggaaggttataaccacacactggccccagataaggccttcaacaaacatttattgagcatctactacatgctgagaagttgccacacagagtatccttgagaagcttagaggaggtaggcaatatgtaaccccctccttcttcttactcaaaccaccccttttgggaaggctgcttgacctagaaaagacaaagatgagagcggaagtcctgggtgtccacctcatcctaggtatacggaaaccctgaccctggtgctctgggaccacaggtttgaggcccagtggagaatctgagggtgaatatgttatcccatcttgaggcactagacggtaaatctctcagaggggcttggaaattccagattccggcctcgcttcaaatttatcaccttgccttttcactgggcttccttcaagaaacagccttcatgactttttagtaacaactgggacccagacttcattttcaaggaagagggagtaagttgtcataaaaatgggagagcattgggtcctcctataaatatcctaattccaaagaatacagctcagtggtacagagcagccgtcttcaatgagaataccattcccctaggaacagcagtggtggatgacttcctaagaactatgtgaaaaagttttaaggaaattcatttcttcgttcctaacttccatgttctccttcctaaaatcagatcttctcaggagtacccacagcctaggttctccttcttcctttttcaaaagaaagatatagaagatgtactttaacttatcctgaatcttaccaaggtgtactatgcaattcataaacattcctgagagggacatttgcatgatacttttaatcaaggccgcatagacgcccccatccccagatcattatgagatgcatttctaataaaatgttactttttatatttattcatcatttgtcagaattatatgtttatgctgttttgatgtattgtgttctattaatagtcaaagcaacaactaaacccagaagataattttaaagtcttacagtcatatattcataaaagaaaaagtctatttacatctatatttgtcatagaaatgatcaaaaaccttttaacatgatttaggggaaatgcaataaaaatagatgtttgaagaagaaaaaataataatatgaagcttttgacttaaaaaaaatttgttcacatattcttttagtgggtattggtgagtatccagtaatgaggtatttaaatcccactggatgcaaccaaaagatgatataaaagctttattttaaactgccaatgtttaaaatactttgaaatcacattttctgcaattatttaacattacaatggaaatgcttagttacctactttaaaaagctcaggaaagtacatagctattcaaaattcttctggaggtacacaagcacacaatttgaatggtataagagggtttttagagttatgtggacttgggcttggatcctggctgtgctaattaccaaccatgtggccttgggtttgctgcttagtctttcttgatatcagtattcccctccttaacgttggggatatgtaacattttcagtagcactgttaggagaacttagcatgacgattgacacataccatctaacgaagaaacatttatggagacatgatttgtgccaggattgtgctaatcatttatgcacatcatgttattgaatcttcacaatggccttatgaagtaggtactaagatcattgtcattttatggatgtaactcctgaagcaacacaggtcatgaagtttgcccaaggtcatattgttgccaaggggtagaattgtccctggatgtcagctgtctggctccagcccctatggtagctattattagcattcttaccattaacttccaattgtagaaaaatggtccattctgaaagattgcttggggaagattttctgacttttctatattgactatgaggttttagcatctcttccatccaccaagggaattcagtcatgattatataatgttaaggttgcttaggaaaagtagccaggggaatgattggtcattggatagagattaactttattgagaatttaaaaagctgaaagctctcctggttaggagttttgcaaatagctccgtcctcattgtcatgaaaatcttgaacaatatggacgctcatccaattatcaaagcaacctggggggcagagtctggcattgtgtgtacccattattgaagggtaattcagtgtaacaaaccaaatagagtatgtacaatgactgtcaaataaaataaaccactaacaaattaaattacttttcattttcagtaggaagaatgccagtcatttttcattttaaaaaatatgcatcttaattccattttttaaaaacgtgaaaagaagcatttaaaggcctcttgtgctatctatactgatgtttattttctatagatatatttctcctggtcctggggcattttccctcaaagaattagtggagcgttaaacctcactttggtcaaaaaacctgtttcttccatggatcaatggtggatggtgttcagaaagcaggagtgataggctggctctggcttacagcgacatatcagagctgttgtttccagaatgaaactgccactcaccagcaccccgccaaaaccccctgggaatcctatccaaataatataattttgagatttccctgctcacacccttcaacagcctcaatatgtccctaatttcttcttttactggctttgtcatacagattgaaataagcctgagaagaaaaacctctttgaaccaagtcaggctttgtgtttcaggtcattaaatatcttagaattatattctttcatttgacaaacatttattaagtgccaatcactgtattaggtagtatgtgtacacagtgaacaaaagagattaaggggtagaatttaaagtctaacagggaagaaagacattaatgtctctaagtaaatacattgttataaactgtcactgatgctacaaagagatgtatattgtttcatgagagaaagaaataggggctctaacttagactgaggaatcagataagttgtttttaaagaaatgacaattcatcccacgaaagcagggccataagcattcaatcctctaaatcagtgtttctcaattaggagcgattttgccactgggcagtgtctggaggtatttttggttgccacaatagaggggatgttactggcatccgtgtgcaggagctagggaggtagctaaactcattttgatgaacaaggtagctcctcctgaaacaaaaaattatctagcttaaaatgtcaacagttccaaggctgaaaaacccaagtcttaaggacactctcctggaacacagtccaaatctagggtgcatagaagaaaccaagtactaacttctacaatagaccagcaataagtttcagttcatgaagacgttttggattaaaaggtacttcatatacaaagatatatacatatatacataaatatataaaatatctatgtttaatatctatatttcaaagacatataaaatatatatttgaaagacttatcccctatggccagctgtaagaataataaatgcataaaagctgcctggggaattaatgtatatattttaaattcagtgcatcaaaaatggtttgcatggcaaaaaatttcatgctctttgtgtcattgacttcttttggcctgactataaaaaggagaggaaagatacctttttctcagaagataaactcgctaattaccaactcatgcagaaacctgtaattctgccagttttatcttattttttccccagacacttactttttatgccaatatcactatttctcaaagtgtgtttccctgttcactgcctttcctgttatttcctttgatgttttacattgtgtaatgccacaagaaaaaaagagacatcttaaaataccccagtagaggaaaatttcaattaacatttatagctggggagagtgggattgggagaggcggtggtttaatttttggttagtttggttaggattaagcacaaaaattgtttttgctgttttttaactgttattgatgaagtattactttttcctactattaggataaatatcactgaatctttgatcaccgaggattgaccaagcctccgaagtatcacactgcattctgtcatttattaccgtggaatatacagaaccaagaagataaatacaaatttgatattaacttcaagaatcttacagctggaagttacctgagaagtcatttacattaaaaaggtctggataaacacaaagatgcatttctaagaatttaaaaaacatggcctttcatagatatccatagaatgtcagttctgcctcccaccaacagatggcagtagtaattactagcaacactttgatttagaaacaaattgacttaagattgacatttcagggttacattgtctgattcccaaccttggctgcacatcagaatcaaataagacctcttgttaaaaactgatgcctgcctccccggggtgctcttttgcccttctgcttctgccatggggtgatgttgcatgaagactctcacaagatgctggcaccttgatattgaactttccagcctctaatactgtgagaaataaatttcttttctttataaattacccagtctgtggtattctattatacaaacacaaaatagactaagactatgggtttaaaatgatttttatagttctatactgattgaaggtttatgttaattttaaaaattctgattatttttataatcataaaaagaaaatcacttatggaagataaaaatgacaggaaaagggttactatttatgatatacaaagagttcatgaaaattagtaaaaagacaaacagctcagtaaaaatatgggcaaaaataggaatgaaaaattcagaaaaagggaaaagaaaatgaccaagacatagatagaaatatgcccaactcattagtaaagagatgtaaattaagatttttaaaatctttaatcttataaaagattaatctgatgaatcttttaatttttaacctttatgcataaagaatttactctatgccagtcactgttataagtcttaaaactattaattcatttacactcataacaattttatgaggtaggtattcatatcatcctctttttacagatcagcatatctgagacacaaagcagtaatgtgtcctagctaaaagtacacaactagtacttgctggagctgagacaggtactcagtatttctagccaagggagtcctaactctaaaccactatactatgctgcctctcagttggaagtataaaaagaaaaatataacattctatcctggagatggaataaacaacaagcatttactcatggaagcataaactacaacaagattttcagaaggtaatctggaagtagctgttaaaataacatatacatcttttaacttagtaaaccttactttaatgaaatccatcctataaaaacatccgtaaataacaatatacaggcatgtcccagagatactgcaagttcagttccagaacaccacaataaagtgaatattgcaataaagttggacaaatttttttggtttcccagtgtatataaagttatgcttatactatactgtagtctattaagtgtacaatagcattatgtttaaaacaacaaggtacatgcctgaagtaaaaaatactttttgctaaataatactaatgatcatctgagccttctgtgaatcataatctttttgcgggtagatggtcttgactcaatgttgatggatgctgattgatcagggtggtagttgctgaaggttgaggtggctgttgcaatttattttattttattatttatttatttattattattttttgagatggaatcttgctctgtcatccaggatggagtatagtggcatgatcttgactcactgcaacctctgcctcccgggtttaagcaattttctgcctcagcctcccgagcagctgggattacaggcacgtgccaccacgcctgggtaatttttgtatttttagtagagatggggtttcaccatcttggccaggctggtcttgaactcctgaacttgtgatccacccaccttggactcccaaagtgctgggattacaggcatgagccaccgcgcctggctggctgttgcaatttttaaaagacaacaatgaagtttgccatatcgatcgactcttcctttcatgaaagatttctctgtagcatattatggtgtttgacagcactttatccacagaacttctttcaaaattagagacaatccgctcaagcactgttgctgctttattaactttattaacacagctttattaatattgacgtgatattctaaatcctttgttgtcatttcaacaagattcacagcatcttcatcagagtagatcccacctcaataaaccactctttgcttatccataagaagcaattcctcatctgttaaaattttaccatgaggctgcagcaattaagacccatcttcaggctccatttttagttctagtttttttttttttctatttccaccacaactgcagtgacttcctccactgaagtcttgagcccctcaaagtcatctacgagagttggaatcaagtgtttccaaactcctattaatgttgatattttgacctccttccttaaatcatgaatgttcttaatggcacctagaatgaatggtgagtgcgtcccagaagatgttcaatttactttgttcagatccatcagaggaactattttttggtagcgatagcctttcaaaacgtatttctcaaataatatttctcaaaaatgactccttaatctgtgggctgcagaatggatgttgttagcaggccggaaaacattaatctccttgtacttctccatcagagctcttgggtgactaggtgcattgtcaatgagcagtaatattttgaaataaatctagttttctaggcagtaggtctcaacagtgggtttaaaatatacagtaaaccatgctgtaaacagatgtgctctattcaggctttgctgttccatttagagcacaggcagaatagatttagtgtaattcttaagggccccaggactttcagaatggtaagtgaacattagcttcaacttaaagtcaccagctgcattagcccctactgaaagggtcagcttatcctttgaagctttgaagatagctattgacttctctccagctatgaaagtcctagattggatcttcttccaacataaggctctcttgtctacactgaagctctgttgtttagtgtagccaccgccacccatgatcttagctagatcttctggatagctttctgcagcttctacatcagcacttgctgcttcatgttgtacttttattttatggagatggcttcttacacctcatgaaccaacctttgctagcttccaaattttttattctgcagcttcctcccctctgtcagccttcatagaacaaaagagagagccttgctctaggttagacttcggcttaaggaaatgttgtggctggtttgatcttctatccataccactcaaaccttctctatgtcagcaagaaggttattttgcattcttatcatttgtgtgctctctgaagtagcatttttaatttcctccaagaacttttcctttgcattcacaacctggctaactctttggcacaagaggcccagtgttgggcctgtgttggctttcgacatgtcttcctcactaagcttaatcatttctagcttttgatttaaaatgagaaacccaaaacaccccataagaattccaacattaacatcagagattaatgatcacagatctctataacaaggataataatgaaaacatttgaaatattacaagaattaccaaaatgtggcacagagacatgaaatgagcacatgctgctcgaaaaatggtgctaatagatttgcttgttgcagtgttgctacaaacctttaacttgtaaaaaacatactatctgtgaagcacaataaagcgaaatgtaataaaacaaggtatggctgtatgtctgagaacacgtattgtagcattgttagttatagcaaaatttagaaacaatgtgaatatctatcaatggagaaatgatttaatgtcatagcttatctatgctttagaatatctgcagctctttcaaggaaggtaaattggcctggagggatgtgtatattactgagtaatatgtctagtgtgatctcagttttgtaaacaaaacaaagtcatatctgttcattcattaatgttaatatatgtattcatagatacagagaaaggtatggaaagacatacaccaaactagcaaccttagttaccctgagatatggaaccgtaaatatagtattatttgactggatgctataaacaagcatttcttttgtaagaaaaggaagggaagacatcatgtttaatgttttgtcagggcaggattcttaagattcttcagtctgcactggactcttcttgggaaaacttaagcatctttaatgagcacaactttctcattcctgtgagcttaatatctgctttactgaactgtccacctgttcccagagtggacagggagtcagcccattccctttctttgcacaacagcacttcagatacttgaggacagctctcaacccatctcctctccactttcatagattataccaagactcagcctccaatcttcacacctcaataatggtgagctcaggccacttggcctccacaaatgctttgcttcactgaacacaatctaccagcacaggcatttattattccaaagaagacatgtgctttctgtttctgtatgttaaaacagacttccctttgtaatcgtccatatcatgtcatcaagtaaaattcccaggtcttttttcaaatgaagtaatataccaagttgaatctattctatactatttgactgttttgaacttgaatgtgatttcctaacctctcctcctagatctgttgctttctcttaaaatgcagaggtaggaaatggtatgtgtgtgaatgtgggagatggtggtaggaatctactgaacagtagattctggataattggatttttctgtctaataaaggctattggtcagaagatgaacaaatgagttagggaggtggagaagacaatggcaatgttctgaattcaggcatgagggtgggagagaccgtaaatcttctcttcctcaatggctgagctgaatttgaatgtagtgattctagaaaataaattgttatatgaagtggatgaagatgaaataactccagagaagaaggtttgctggttccaaggagagacagcaggaataggcgtgcgcgcgcacacacacacacacacacacacacacacacacacacacaaaggagataaaaagtaaacaggatgggatgagcaagagaagagagtatctgagaaaagaagcagaaataagactctatagaataaaaagatgccaagctttcagaaataagaatggagaaaaagaagaaagcagggaggtgaagtaatattctagtctgggctctttagattttaagaacagaaaccttcctaaacttacttaaaaaaaaaacccaaaaggattactgaagtacagaaaaatattacagatcatcgagactgaaatggagcatatgaaatagaacagggacttggcaagctgttaggaacctcgaaaaatgtgctttgtttttctgtttctctctttgtctgtcttgcttaggggccacctggtctcttaaacgccttctctctgcatgtctggccctttctcctctttttaccaatgacttcatctgtttaccagtctgaatatggcctccaatgagtcactccagcccagattttataacactttcagcccaattgctcagtgctatcagaaaggagagaaggaaacaagcaggcagagaaacaaagtgggaagaaggaagcatcagagccctgtaattgggtctcatccttgtcccttggacatcccatattcgtaatcacatccacaccttttcctaggatattcctttgttcacctcacttctatccacccatccatatccctaaatcatcccagaacctgactgctgcagttaacagagctcatctcattcctcctttcttatatgtacccactgtgatgaagaataattggatacatttaagagtcctaaagaaaacgattaattctctagcttccttcttcaacctgtcactattttgacaaccctcctggaatcattttgtaacttgagctcctagtgttttaatctagatttctaacagtgtcttgtataaggagggcaaagcacaagtggtcactattccctagctagaaattttattttgtttggaatgttataattgcctttcaatcttctttaggcaatgaacccatttatgtaattctccctcataatttccccccacttccctgccaatcttagaagtgctatgagcccttttcatggcaatcacattctttttaaaaactagatcctcaaaccatattagagtaagaatttatcctgaactgaagaaaattacgtaattacttcttctggaacaacacactatttggggtgacttatgcctggtctacttttaagtaacactttcatgttattcactaaaaccctgagatcttttttctgcaactttactttggctgtgtttccactttctacacatgaactgttgagttttctccccacatgtcccagcactatgctctgtccttttagaactctgaatcctatctattcccttcaagttttcaaggttgtcatccatttctgtactgctttctgacctctttgcccccaaatgttgtgaactgcattgccatagaatggaaggaagcagggcacgggtggcatggacagaggttattgcctttgaggactgtagactccattaattcattttcttcctgaaggaaggaatataaattattttctccaatagccaaagcagaggacctttttaaaaaaccatcaagctctgaggctaacagaaaggaaaggaaaacctaaaaagaagggaaaactaatcatagagagggaaaagagaacaaatgtgcagttcatttaaaatcactgtagttgaacatcaaattatggtacctgacttccacctattttacattctatttagtatttattttgcctctaatctaggaatacaattatgtactgaattgtatcacatatgcatttaatatgtgaattcaactatatatgcttagaataatatgaaaaaaggaaagaagcaaatttaaataatgggtcagaggtcccagggagtatgagatgggggaggggagttaatctgctctttcttcagaccaatggtctgggtggatctcatctctgagcatcgtgggatgttgaataagttactaaggtttaaggaagtatatttttcacaaatggcccctcatattgtttgcatagtttatattctacattattctttatatcctatatatttatatgtatatattattctatatagagttaataaaaacaaacaaatcttatgggtgatttatgggatttttcaagagtatttttaccaaacctggtgcttgctttatggggcgactttggaacctaacctctgtaaaactgccactttaatgaccctttaaaaagtgcttactgtcccctgtatgctttacatacgttacctcctttaagcttcacaaaaatcctgcatagttgataccatacatattttacagactttaaagagctgaggctcagtgaggttaaatgacataataagtcatgaggtcctcgggatcagcagaactaggattcaaataccatctgaaccttacagagaatggtcaataccatggcatttttttctggtgacgttactatatttccagtataaagaagatttatggattatctagatctttaaacatgaattcctcttgtattagagggaaaataaggctagcttcaggtttctctctgcagtaaactcaatgtcagaatcataaccaaaaaatgttcacaaaattatgacacttttatatctttcaggttgtgattagcataggagtaaagctcataagcaggcaaaaactcagtgaacacagtatctgtattattttccatcatatccttggcatccaggacacaggacattacacagaacaaatattcaacaaatgtttgttgaatgaatttaaaagaatttaaaaacaaaatcagatttttctcattcagagattcctaaactggcttttaaaaaaatcagaatcacctgagagttcttaaagagcaatagaaaatacagacttcgagatgaactcagttggtctgaggtgaggcttaggtatcctgatttttttttaaagctctccaaataattgagggaaaattagaatagtgttttctaaaactcagtccttttagtaccccttcagattttcttatctgttttatgtgtactattatttatttatttatttatttatttatttatttattgagacagaatcttgctctgtgacccaggttgcagtgcagtggcgcaatgtcggctcactgcaacctccgcctcccgagttcaaacaattctcttgttttagccttctgagtagctgggactacatgcatgtgccaccaggcctggctaatttttatatttttagtggagacggggtttcatcatgtcagccaggctggtctcgaactcctgacttcaagcgatccgcatgcctggcctcctaaagtactgggattataggcatgagccactgcacccggcccacttagtattttctttaaactgatttgcttttagttaactaactttattttgatagggaactttacactgtaacacatggaaaaccagttttctatgaattgtcaaaaaagaagaaaattataaaaataaatacaataaaaattgtttttaaattctagccagatagagtcatctgaaaagacagagtgtaaggtcagttctcagtttaaaaaaatcaagatttgtaagtgttatgagagaggttaaaaaatattaacatcaaactgagactttgggcttgatgtcatcagaataatttataaagcaagaaaggagggaataacttcctcaattatgtgattcaatattacttacagttgtgtcttacatcaacagaaacacatatcctagactttgggaaacacaatgatatacaccaaggtagtatgttaggtgattcatgtatgttgattttaagtatttatagaaaatgtactgtgtcaggcaaaatattgggtcttgagaatagaaaaacacgtctctgtccttaggttgtccagtgttatttcacataccttctccccattaagaaccgctaaatggtgggtttgatgagttatttgcataaacaaatagagctgggattcctgtctggacactgaaggcctctgtctctcaaccatatgtaactgcagctttcaaacctggtaaagggtaggattgtcttttacatttgcttcctataatcatgacacagtagtgcctaatacttactgtgggctttctgtgtgccactccatcaaacacattgtgtaatttatcccatctaatcctcacaagtactgcatgaagcagatactataagtgacggctgacttcacttctcagatgagaaaactgaggcacagctgtaaaaggagacattatacatcccagagagcacaaaactacatcctctgttttacctgactggctgaatccctgcctatggcttttcttctattgtattacctgctattgctatttaaatcccatttgcttatcctggtgtgatcagaaaaggagcatgtgactccaagggtggtctcattaacttctggttattaaagaggaaaatgtggaggactcggggacaggtacagatggggatggttggactaagaattaagttaaacgataagcaaaacggagagaataaagggaatatttcactagaggttaagagaaaaataatgagctcttttttaaacacaaaaggagaatataagtggtgaagacggaagccaggctgctggagcttggcagggggtaatttattgatcgacaagtaagaatgtgccaaaaagaaagacatagggaagcaaaattatttgctgctgctttcacaatgggagacatccaaggaggcaagaggagatgtaaatttcccaggggaagaagattatgaagcaacattcttgttttcgagtcctcaaaaggcaaagcattggtttttgatgttgaacaaggatcaaaccacacaattgcccctgggtactgacagacatctgaagctgtttggggtacaggaaacagagactaaatattcctgagtcttgagtagagtcagagaagtcctgaatttgctcagggaaggggctcaaagggtttctgtggattttcctagagaaaggggtagagtctggaattagaggcaaaaaaatagctctcaaggatactgctggagacatgggggtggggggaatgcttgaaagacacataaagggtaagcagactttgttcgcatgtaccagattaaagttacattatctatcccaacacagaaaactgcttgcagaaactgagatggataaagacagctagagaaaatggacaccatagtttggttcagcatgcaaacaaataaagatggcagaccaacctccctccctctataagtagtatatgcagctgttctatttgagtattcatttaacactttcttgttaatttccaagttctataaagactctgactcacaactctctccgacgatttattttttccttcacgagaactctctagtttaaaatgacattctattctagatatatttataggcatgtacatttttttgtcttgaaatatagaaaatgggataaacccagatcctgagatatgacaccaaatatagggaggcatttttattttttaaggttgcagggaagctaagtttacagactgtttggaattttattctctcaacatatatggcacttgcaaatgcttctgttcatacatttttctttctttcctagaagggaccagtgccaataaagctcatctgtctgagttatggttttttccttctgataatcagcaagaattatgcaaaggcacagtgttgttatcaaacagaaatatagagcaatctaattctacctgataatttggcatggcacattgtttttccagaatctatcttaccacagatgctggcgggatgatttttataggaaagcagtccaattaagaggaaaatttctgtaaagtaagtacaaatgtctaatgttgtatcttaatttgcaaacgttaactgggttaataatgaacttgtgctggaagaaaagattatttttttcccttagtggtcaagacaaaggagaaaatatcaacagaactttttttgggtttgtttttatctaaggaaaagtaacctatttagaagattttttttttattgctactagaaaatagacataaagtctaatattcgatagtggatcctttaacctgaggggaaatgcatggcccaggctgagaattctgcatttttggtgactaatgattgaagcagagaatctaaaggaagattcaaaactaagacccttgactttaacagctttccagacaactgtacctgccatcagcccagaggcccctcacatgagacttaactgcagcttcttccctagaaaggagtgactcctgagcatgtaacctttcttagctcagtgagaacttgaaagtttactgagctttcaaaaacaggcattagaggttgaactcacttacctccctttatccacagaatctcaaactgaggatttttttcatcatcatcttatctgcacttgcagtttcccattctcaggggaattttcttccagcaagggatagaaatattcactaagaagtcttacatgttgaggtcagtatgtcttaggcaaataaactctgaccatacgaccaagttagaagtctcttccctcttatctgtccttttataaatgtattcttccatccaaaagtagcaactggagtctcccagttatctctctgttctgagcattcctgatttccatcttggagctagctacatattattgaatggttagtactaaaagccagatactgtgctaatatttttttctgataacaagtcctatgagatactttaaataatattatccctactttgttgatgataaaactgatatggtgagagcttaagtaaaaggctcagagtcatacaaagacagagctaggatatgaacctggagttgtcactctaaagccctagactctctcccatgacgatttcaactatgggatttctgcccctattacacaataagtagaaataagtctgcccaacacttctcctggcagtaagaacattttgctcacaattttgaacaaacaattattctgttttaaagtatccatgtgactcattccctcagctcctacatccctttgtgtactgtcttgatgcactttttgggtctgttcatatatttcccttctggtcctaaggaatgtaattgacagctcatacatcttgggttgtgttgtaattttgagaatatgcttccctttaaaatacaccaaggtggaataaaatgtctcctccatcattggcagcaggaatatctgggctggacaaacatgtggctccctttcaatgtaggtgccaaactccctctcaaaagttctgggaacttagtttacatctattctgaagaatgaaccagtctcccccaaagtgttatccactctgtttagagtagcccagaagaagcacaagacttagtatttcttgagctttgctgtacaagttagtagttactcagtgttggcgcttctccaactaggatctttcaggctttcacattcagctagatacttggtggtattatattattattattgttattattattagagatggagtctcgctctgttgccaggctggagttcagtggcacgatctcagctcactgcaacctccacctcctgggttcaagtgattctcgcacctcagcctccaagtagctgggattacaggcatgcgccaccacacccagctaatttttgtatttttagtagagacgggatttcaccatgttggccaggatggtttcaatctcctgacctcgtgatccacccgcctcagcctcctaaagtgctgtgattacaggtgtgagccactgcaccccgccgatacttggtattttatacaacataaattgtgatgaaaatctgagtattgcccaaacaacttaagcttttgaatctttattgagcatcttctgacttgctatctttcattcaatctttgtttttatgttccccctcaccccgctataaataccctggtatcctggactgtgggatagcaggttagttgcaattggtctgtctcagagatttttgcccagtgaatgaaaggaaaatggcaacaataacaaccatgattgttatggcaattacaaggtagagaaatctaggatgaaacatatagcaagtgcaatattaagcatgctccctgttaaagtctgggaaagccttggtggctgctattgttagattagcagtaaatgctgttagcaaatgccatagaaacaaattgcccctttctggagccagtgggcatttgtctttgtcgttcctctgggcatggggctcagttttctttgcatggacagcagaggaaatcctgctttggaggaaagcagcagctcttttttatggttctgcactgttaaccaacctcagtcacttctctctctctctctctggcccactgcttgcacagaaaattgaggtaatgatttatatgtcgtaagcagttctgacaggtgcactctatcttggcttcctcctgccccaggactaatcggaagcttatcttttcctttgtgtaatagggagctgtcaggttctatgaccctccaaacaattcaatcactcatgggcggattcaccttggagggaggacgccttgatattggagaaacccggtggaggccatgccctgacatgtattgaaacaatggcagctgggggctagagggcaacatggccaaactgacaaaatgtcatttacttcctaaatttaaactcttctgccaggaactatctaggcggcttttccatgttggtgaacatcctgtcttcagtgcagaacatttagctatctgggcaaagtagggctgttccaaaaaatgacctgtacagagaagcgagggcttgcattgctcatggggaaaaaagcgagttccttaacaagacctatggtgcccagcatgatctggccataagctgcctcaccacctgcatcttactggtaccacacatcccctgcactcagcttcagccacctgggccctccttccacactgtgtttttctgtgctacctcctacctgatgggctttgtgcatgtcaccgcctctgcctagaacattctttctgctcctcttcttactttcctcctgctgtggtttaaatattaattgctcaggaaattatcctctgctctccctgaaaagatcaaattctccccatcatctgctctcctgtacaccattcacctttcctctagaggccccattacactgtcggctttacattaggagcattttatgcatgctttttccaacccaaagagatggctagctccatgaaggcaggaaccatatctttcatgttcacttctataactccaggactaatcatagtacctggcttacagtagggacttaataagtgcttgtggaattagtttttaaaatgcatagcaagaaaccgaggtggtgcttatgttcttaattggtttgaccgtcaagtagtgcaacggcatatctaattgggactggtgtggcggtcacctctgagtccatctgcgtaaaggattttagtatgggaaggaataatgataaccaagtgtggctttgttttgtcacttctatcttaatctctaaccttataactcctgaactcctatctttgttgtctgctttgtctgctttgacgatcttatgtttccctcataggatgcttttcttagatgctctttgaatttggagagcctatgatttaaaaattcaagctttcagaagtttctaaacatctgtatatttggttttgaactggcaagataattggacagagttttcgctttgtatctggatgttttcgcattaaatagtcagtgtccttatttaattgaatgttgcagaactctcactccctgaaaataatgagaggaagtgagatcacagagtagagaagaaaatgttgagaaagaactcaggcagtttctaaatacacaatgggattgactgtaatgttaggcaggggcaaatgaagtacatgccgtcaccatttttttttgtttgtttgtttgcggttcaggattgctttatttttcacattaatggtatcatgctatgatcttatactttttaaaaaactcatccctccctccctccctccctccctccctccctctgtctgagacagggtctcactctgtcactcaggctggagtgcagtggcctgatctcggctcactgcaccaggctcaagtagttctcccactgtagcctctcaagtagttgggactgcaagtgtgcaccaccatgcctggctaactattgtattttttgtagagctagggtttcaccatgttgcccaggctagtcttgaactcctgagctcaagcgatccacccaccccagcctcccaaagtgctgggattacaggcgtgtaccaccactcctggcccgctgtgactattttcaaaccaaagattcctagtcactggattacaagccccatgagagcagagaccatacatgtccatcatgactatatgtatggaatcctttttaaataagtggcaggtaagattaatgttaggttagacagaaggaaacatttgtgaacagtgatttgttttggattggctaatggttcttttctgcttcaagaagtctctaaagtaggataaagcccccatggctcagagggttaaaagccattgctgttgggaggccaggtaacatggtggttaagagaacattgatgcaaaaatcctcaataaaatactggcaaaacgaatccagcagcacctcaaaaagcttatccaccatgatcaagtgggcttcatccctgggatgcaaggctggctcaatatacgcaaatcaataaatgtaatccagcatataaacagagccaaagacaaaaaccacatgcttatctcaatagatgcagaaaaagcctttgacaaaattcaacaacacttcatgctaaaaactctcaataaattaggtattgatgggacgtatttcaaaataataagagctatctatgacaaacccacagccaatatcatactgaatgggcaaaaactggaagcattccctttggaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtttcaggacacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttgaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataacgctgcatatctacaactatctgatctttgacaaacctgagaaaaacaagcaatggggaaaggattccctatttaataaatggtgctgggaaaactggctagccatatgcagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaatcccatttgacccagccatcccattactgggtatatacccaaaggactataaatcatgctgctataaagacacatgcacacttatgtttattgtggcattattcacgatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattggacaatgagatcacgtggacacaggaaggggaatatcacactctggggactgttgtggggtggggtggggagggagggatagcattgggagatatacctaatgctagatgacgagttagtgggtgcagcgcaccagcatggcacatgtatacatatgtgactaacctgcacaatgtgcacatgtaccctaaaacttaaagtataataataataataaaaaaaaccacagcgttgcacacacttaaaaaaaaaaagttcccagaaatcctgaagtaaataaatttgcttaactgtgtttaagctagggtttcctatattacttgagccagagacatttgtgtgagacagtgtgtgtatgcatgtgtgtaccactgcttttaacagttttctggtaaaaagaaaataaactcatctgatcacaacaacaaattacaagagcatgacccaccttcttccacccaaacaaacacaaacctaacacctttcaggtagaaaattcctttccttgttgctaaaccattctaaggaaaccagagaataaaatatatttttctgttgaaaacagtctcctttaacatgaaaccacccttgtaagtagttttctccaaccaagatcttgtttttatgcgtcaaagacaagatagtatcttgctatgcacactacccctagggaaatatttaaaatatttttctctggtaaggactggtatttaaaatgcttacatcaatgcatcagtcgaagcccggcttgcaacgtactaggatcaaagtgatcatgtcctctattgagttggattccaaatccatttgcactaattattttctacaaaaatcctaatgcataatgagcagaggccctagaagtcctctactgatttcaaattagttctttgcataacctagtagcaaaaagggatctaggcatgtatttttgatcttctattagtaaagtctagttgaaaaataaataaaagtcagctctttactttgttaacatttttaggattcttgagcaatgccctgcttgggtgttgtatgccatgtacatgcctgcacgcacccacacatgcacgtgtagtttcggggaccggagacacacccattgctctagcaacagtgagctcacacttcagaaatgggacctggtgtgggctgaatgtctttcccattacgcttataattcagataatttcatctgaaaaattcagaaaataaaagtattctctccttcaatcatccaattatccttgatttttcacttcctttgaaaagtatacagagagccctttaaatgaaaagatgggagaatcactctaataacttctcatttgagaaaatcctatctgggtcagtgtgaatcaggtttggaatggtgacaagatccttacttgcaaagccctaaaaaggccagaactctgccctgtcaaccttcccacatctctgaaattcagaccatttaacaaccaaggttagggaaagacaatgtgtcagagcctgtaacactatcaggctttatggccagggaatctcaagataaatggcaccagaggccatggaaacatccagattttcttctgtaatgtgattcttttctttttctgacactagtggacgtctcagcttgccactgccattgagtgtacatatgggaggtgtcctttattagttcctatcacattcaagaagccatggacaccttccaaagggtttgggagcaaaagacaaagagaactcgatcctaaaccaggtatagggttctgcttatatttacgtctatgttggatctaattactacatggtaagtgcagcataacaaaggtacctttgggatgaaagaaaatattttattgtcagtgaatacactctgaatgcaaggcagcgtaggagagtcagtacaaaggcagattcaaagcataatgaattgctagtctctagatgtaatactacttcgaacttttcaatatattcatcatgctttcctgaaactcctagtctctaggtaaaagacaagatgggaaaaaagaggagaaagggattaacataaactaagcgtctattgatggcaagatattatgctaaacacttcaacaagtgactttatcagcccaacctctgtaagaaagtatagttattattctggagtcagcttgaacctggtttaaaaatatggctgtgccacttagtagctatagacatgagcatgtcactatagctctctagatcaaatgtcctcatctgcaaaatgggaataacagtagtacccactccacaggctgccgtctgggcatagtgagatggtacctgcctagcagaaggcctggcacataatacatacttaataaatgtctgcaatagtgttactattatagcacactggcaactaagtaggctgtcccccatgacttgaccaggagtaagaaggggaaagaagttgagttataaaaggcactaacagctcacaatcacagaatcatcatggatgctcattctaaatcaaatcactctcttagtgtaaaggcaaccacattttgataataatgttgtcctcagactgatctatacagaaccttgaggcaggaggagacaagaggaaaaaggaagggattttaaaaatcaaatctgagaatctctacttttgagtagagagatcattatgccaaagggtctcaaacccatctgatcttcaggatggccaagaatatggccgagaaatacgggtgggtgtcttggccacactcctggagattctgagtcacttggttggagatgacttagatgttcccagagtctgatgatcatccagctttggtaagccatgacctagtttcatgtacccttcctaccccgccttttcccaaaattaaacagaaagcccacctgtgcccaaggcaccagtaacttttacaatctccttgaaaagttgttttccagcccctgcttactcatatgtgttttggcttacactgaatattcagatgcatatattaggcattctattttagtacaagaggcaggacagcagcttgggttttagagtcataaagacgtgcactcaagtccaagcattaccacttactagccgtctaacctaaggcaagttccttaacttccctggcttcagctatcacatctctacaataaggataatatcagtgcctatgttataggtttatcttgaagattaaattagccaatgcatgcaaaatgttcttggaacattagcataaatgttagcttctcttttaattccaactgaagtagttcctttggctgacatggaactcaattatcatcatgtctctgaacattagccaaaaatattagccaatgagcagaacagaaacatcccaaactctcatcccccaaaggcgaaacatgtcaaaacacaaaggcttgtcagtgagggtagtggttaaattctcgtggagggctttctgatcccataactgaaaccccatgacactgacagatacaatcagataatgatggcaatcaataatgataacagaaattattatttattttcataaacacagagtatgtgcatcccactgagttacacacatcacatgccagcattcactttcagggcagtcaatcaatgagagatctcaatatccacccgccgaggcaggatggggaggatagagcgaaggttgagaaattacccatactagaatgacacattcacaaagttaatctaatccaggagccgttggtgccattgcaagcctgtgaatatggaataggcttgattgatttttcactgcagtagctaaacacgccattgttatatgcaacaaatgtaaggaaaggaaagatgaaaccataaaaggattggatgtgaagcccccagagcagcaataaatcacaaaatgaagtctaaaaaaattaaaaatggtagaggaaggctgtatctatgtcctaagaggcctcagttatcaaagcatataccgaaaattaaaacctggggcagtaaaggctgatcctgactcaaccaataatttgcactaaatctggcctggggttccccctcctcccagaatgagtattacgacataggtacctcagagggagcaagaaagcctaaaggctatagacagacagaacgtgcttcattcccagttctgcctctttctagctgtgtgatcctgattagatacctggcccctcagagccagttaccctcttttataaatgggataatcacatccacaccactagaaagaaagaaatggcaatgcacatcctgtatgcctcaaaggatccttgggagcatcaaatgagatgcccaacatgaaagcccatctaccctccagatgcatcgtggaaactccttcctaatcccgtctcctccctttgtgcttcttctgaactgccatggttatcttctgtgcttttctcaggacagttatccttctccatgatttctcaaagtgtggtccagggaccacctgcaccagaatcacctgggcattttctgggaggggccttgtcaaagatgtcatttcttagagtccaactcaaaccttctaaaccagcatccctagtgacgaggccagaaattatgttctaggcagagtccccggtgaccatgaggcacacagtcatttaagaaccaatgattgaattcattttatgtttcagccacttgtaacttgtctcctccatgccccctaaggacagagagtgtgtttcattcatctttgtaagagccacactttgtagtgcatgcttagtacagtgtgtagcatagtagacactgagatacaaaatacatggaaaagtcctgtacatcagatgttgtcatcctcactgttgtttaaatcaagtgccatgccataaatagtcctaataatagtgaggaacaggagctctggagtcagacagactctggagctctggactccattcttggctttgctgtttactatttgcaaggccttaagccagtacttacctttctgagcctctgtttatacatctctaaaatgggcaggatgcctaagtcacagaatgatgataaagaaaggacatcaaacaactgcgccccaagcctgtcactaagaaaggctgaatatgcacagttgctactattagtaagcctaaaccaatagtctgtttaatcagttctctaggagacaaatcaagtaaactgtttcactcagaggatctctcttttgggaaaactagctagtcttttcagtcaacttgcctaatctcatgaccttttagcaatggtcctcaggaagtcctcattcaggagtcagagctggtaaaactgaatgccagttggccagtgtcttagacggtacctatggttgtgtccaaattgccaccaatgggatttgctaacatcagggtcattttaagtggaaaaagtttagttctggagattcatgagactgtgagtgtcctgtgctgacaggaggacagaaacagccattgtgtaaaatatgatgtcatttgatctttcctttaaaaatcagtgcatcccttgtgtacccaccctgtggcagaaaaggctctgcagccctcaccccccgccttccaccccaccaaaatctagcttgtatgttaagagagctttgataaaacgttctgagagacatcaatcaataataaaacattcctgccccatggtcaggaatattttcttaaaaagcagagctgtagagaataagatgaaaaacatcagatttggagtcatgcggactaggtttgaattccagctcttccgttttctagccatgagattttgggcaaacttcttggctactctaaaacacggtttccatttctgtgtaatctgttcacttgacagatatttactgaaagtctaccatgtgccatggattgttccaggtgccggagttgcaggagagaacaaaacagagtccctgctttcatggagcttacagtttactgggggtgaagaggaggcagacagcgaagaaaatgctagacagtgacaagagctaagcaaaaaagggcagagagaatgaatgggaaatgtgggtgtgctcttttccataggataccctaggagggcctgataggtagcacttgagcagagactgaaatgaagaggaggctatggcttcagatgatctggagagaaaaatagaacctaaccgagagagatattatgaggactatgtgatattaaggatataaaatctagtacctggcacatagtaagcactcaatagatggttgctataattatttttatttgttgtaaggcatgtttgaataaaatccattcgaaaaattgtattcatcacatcaccttcattttgggaaggttatgaccagtcacagcttgggagctcatatttgtaacaggtaaaaatgccgatttcaacctggcctaggttcccagggcactggcagctgataataatgagaaaaagaatacctccaggcttaccctgcagggagaagtatgctaagtgtgatttctcaccacccaacttccatttcaggctgattaagtcactttaacgatgagctcccattacctagaaagagctctaagggtctgttactcctgggcagcgggaggttggggaagaagggcatggagggtcttctgaagtaaaactgcatagggacctcaaggcctttgtttctccattgctgaggtcagagatctggaaagtcaatgtgtaagtgtgtgtgtatgtgtgtgtgtgtgtggcagggacagtggtagcggggagtggtggggggagggagagagagggagaggaagagagggagagggagagagagggagcgattgatcgattaatcccctcacctggaataataatggcactaattattaagacaaacatttcaaatgcccagatgtatatgtctaagtttaagagcctaactcttgatttttagtcccagtcctggaataaccagttgagggatactgggtaagtcattttccctctctgaggctgcatcggatcgaagggctcaggtcccagagcaaagtagatcaaagcttggttctcagccctgcatgatcttgggtattctacttaactgcttggagcctcatttgttaaatgggcattttaacaccctttgaggtagctagtgcagatagagagtgcagcgtggtgcatggtatatggcaaatgatcaataagtgctagatacccgcattttcacctgctaaatacctgtcctgccctcctcattggctattctgaagatgaatcaagggactaggtgagaaaacgcttgtaatagaaatggtacaactgtaaggcattattattaaattattaccatgattattgctttatgttaagttatgatattgagcaggggatatagttttcatagacatgcttctcatgggctcttttggtaatgagattgattttgaaaggctatcttctatgaaagatatagtcacattcttgctttgaaaagctgagtctctcagcgctgaaacagaacaggttcattacacagtaaggattaattagctgtcgggtattattaaatgttctcactctcaatacccacatagaactggaaactatgaaagtgagcaagaagtaatcatagtacagggaagggaaaaaaagacacaattgctggcaatgcacatttcaagaggagagcgtgttagtaaattatagtctgattaatatcacgtcagctcattctctgtttggagtcattgttctgaatctagtcttcagggttgcctgctttttttttcttctaccactgggatcaaaaagaaaaggaagctggacttttcagtgtttaaagagtgctgtggtgtggatgtttacactgaaatgcaggatatttgagagcctaggaaaggagaggaggtaaatacagatactggtatttataattatatagcaaatataacatgtccctccaaaatataacagaggttatatagcaaatataacatgtctctccaaaaaataacaggttcataaaaatgatagcttgaaaaaaaaaatgatagctcgaatgggccttagggatgatagagtccagtgaccgcagacccccttgtctcagccaccagggtcaagtgttgaaaatgcagattcctctgggcctcctctctggagtgggtctcaggaatttacatttcccagtcctctgcttggcagcttagaaactaagcttggagggaagaagtataattcatcagttaggttgttaggttacacagctggttagtaagaaagcaagaaccagagttggaattttccaactcccagccacacctcagggcctccttctctgtttcatctgaagtccacttcattggcatcactggcttggcatggggaggatctctgctctcgtggaaactgaatagaccttctttgctctttatcatagggatggaattctcccaggggttaagcacagatatatgaaatcccataggatgccatggacagtaggattccacggtggggtctacagatgtcatctgagaaattccatccacatagcaaacaagggcaaggtaaagtctgggcagaagttcacggtataaactctacgtggcacttaatccagttgttttctccataagattgccatgtctcgaggggcaaaagacagtcttattcccaatatattgccagtacggtgtttgccacttagtaaatctcagtgagtagtttgtagaataaatacaacagtataaaaagtataaaaagaaaaataactgaattgtctcatatatataggcccactatcagtagggggtaataatagccatgatgacgatgatgttattaatactaaaacaacagaagggaactaacatcattgagtgctttttgtgagccagcactacacaggctaagctgtttcttacacaaaataacttattgaatcctcacaacaattccaggaagcagtgactatcatcatccccgttatatagatgagacattggaggcacaaggtattcaaatatagccacatgccacatgatgttttggtcaataacactggttccataagattataatactgtatttgtactgtgtcttttctatgcttagatatgtttatatacacaaataccattgtgttataattgcttactattcaacacaggaacaggcgtacaggtttgtagccgaggaccaacaggcaatgtagtctaggtatatagtaggctataccatctaggtttgcataagtatactctatgatgttttcacaacaatgaagtcacccaatgatgcatttctcagaatatattcccatcattaagtgatatatgactgtcatatgcccaaggtcactagcggaaagtaacggagccagaattctaacccaggctggactgactcaacaataatactcttcactacgctactttccagcctccaaaacccctgcacattcagagcatcaagcctggatttatgccaagtccacccagaatgataaggtggacttacatggaggttctccagagctgaaagcataggctgatcagaggaaacagagtcgccaatgcttgtgagctcagaagcagctcaactgaagaccatgtgcccattaggacagggtaaacacctaatagtctagcatggtggtcagcacagagtctatattcaaaaagtaactgctgaataagcagatgtatcaataaatgaattattaaacaaataaacaagtgagctaattaagcatacaatgaccatcccattttggctttcaaacatagggcaagaacctattttcctcacatctacttcactgtctcccttcttacttttggtctttagcagagctgctggtgtctgaaatcacatattttacacagttttacaaggctgttggggctagggctatcccaacatgtgcctgctttactgctcacattgaacatgttcataactgagctcatcatccagtcctaaaccactttaccttacatctagagacccttcccttaaaagatcgctttgagaaatccgtttttaatgccactttcctatgagaacttttctggtctccaaaaaccacagctaattttttcctccttttatcaaattgcaactctccaacactttctcaatgcatttatcttactatatttagtgccataatcatttgtatattagtcttacaaatcctctttatcaggctatgtatttctgaggaacaggaaggaagccactcagactgagtagagatcatatattgaggaccagccatagaggaagggttttccatccttgcacttcttcctcataagtccacgagcagtacgtactgtgttcactgttttgcagatggagaaattaaaattaacttgcatgttgaaagctcgaaaaggttaaatgactattgggaaatttgggtaagtggcagaatttgaagccaggtctgttagattattaagtttgtgttctgaatcacaagactgcaactcgccatctggattctcatccctgtaccttcagtacagaaggtgctcaagacattttagataacgtgaacaacagaggctaagattatagtaacgtctggcagtggccatgtgggcaagtcttctgggacaaaaggaaaagcatggatttgtagtcattagaaggcttggcacctttcctgcttctccatctgccaccagagagagactggggtaggctgagtctctgcctacgttccctcactggcccattatagttgcaacctacagtaacaaccagcacatggccaaccttaggagacctgcccctgactgtggtggccagggcagctgtttgcactcacccgcagggttgtgatggtggcaggatcccggagccggccctcctcatctttcagattgtagccttctggcctcttatcacgctcgctgactttccacagcttcacagttttatctgtagtgggcaaccagattaagtcagaattatagtgaaaagcaagctcataagggagttttcctgggggcaatggggagaggaagaggtaaggatggatagaattgctacagaagctggctcacataaacgtttggcgtgcataaatcccatgtcatttgaaggcagagctcatatttcaaaacaaaaacatacattatgctgggacaaatggatttccctgataatgggctcttaaatctatagcttataccttaattcagctcattcaataaaagcatttattgagcattgaataataagagtgcaacatacacagagcttacaatgtaactaagaattttacatgaaaaattggtttaacagtcataactctggaagtaggtgctattatctctattttagcatctcacctcactaacacattgtccttaccatgtcctaaaaggcccttcatgacctgccctctccactttctccacctttctgacccccctgtccatcctctccctgctcactcactgtgctccagacacatggcttccctactgctccaggtacacattaagctcactaagcctcggggcctttgcacttgctgtgtcttctgtctggaaagtcctttaccctctttttcgtataatttgctcctttactttcctcttgcgcttgcatcccaaccttagagaagcttatgtaatacctacctaaaaatgctgtcctcagaaccattctctatctcctctctcctgctttatttttcttcatgataccttttactacctgacaattggttgattatttatcaaataactatctgtctctttcactagagtgtaaaattgttgaaggcagggattctatctatcttgtttatcactgtaccaccagcacccagaacagtgcctggcacacaatagctgctcaataaacattagtagggcaaatgaacaaatctcatctacctgcatagtacatatttctagcaatattcagggaaataaaatggtaaggagatacactgaaatgttcctttccttttgctgcctctatggagtctccagctggaaactacctttctcacctttgtactgccccagcactttttacaacttgatgacacctggcattctctatagcattaaaacagagaactcctatccctacagaactcccatgagaactcccatccctacacctgtcatgcaggccaaggaaatgagtaaaaagggctaaaggatctgtggagctggaatggcgtgccctacatgcaggcttttaattcaattttttttttttttttttttttttgagacagagtctcgcattttcacccaggctggagcgcagtggcacaatctcagctcactgcaagctctgcctcctgggttcatgacattctcctacctcagcctcctgagtaggtgggactacaggcacccaccaccacgcccggctaatttttttgtatttctagtagagacggggtttcaccgtgttagccaggatggtctcgatctcctgacctcttgatccgcctgcctcggtctcccaaagtgctgggattacaggcgggagccaccacacccggcctaattcaattatttaaggagacaagatcaggcaaacaaatcatgtctgctggccacatgctttggtgggcttgccttatcagatccagtgtacattttttatacttgttttaacatatctttttgaaggcagaacttggttgccttctttgtatcttcctctgtcttgcacaaggtagggtttggaatcagacaaccttgggcccaatccccactctgacgccagtcacatgtccaaggacggggattcccactcagtaggtacataacccttcctcccttccctctctccttccttccctccctcccttttttccttccttctttctttccttccttcccttcttccttcccttcctctctcctttcttcccttcctctcttcttctttttttaaattgagatagagtctcactctgtcacctaggctggagtgcattggcgagatcatggttcactgcagccttgtcttcctgggctcaggtgattctctcatctcagcctccagagtagctaggaccatagtcacatgccaccacgcccagagaatttttctattttttatagagacatgattttttcatgttgcccaggctgatctcaaactcccaggctcaagcagtctgcccacctttgcctcccaaagtgctgggattacaggcatgagccaccacacccgaccacaactagtatttcttaagcaacaaataggattgccagatttagcaagtaaaaaaatatagaacacccagttaagtttgaatttcagataagcaaaaaataatttagtatgagtatatcccatatagttcaatcttacaaagaaagatggtgcctcagtttctttatttgtaaactggggaaacagtatcttcctcatggggctctgatgaggattaaataagtcacagcatggagaatgtttaacacagtattaggcttctaataatggtccgcaaatgacagcttttattagaattagcaaattgggcaactattctgccataataacatgttgctctgacagctttagcttcaaccctcaatgatgtcagcacatcctatttcttatctgtaacactgtcaggggagaaaagccgtccctctgggaattccttcctcttttgccccttgctccattcctccacttctcctcacctgactttttgccaccacctcccacttctcatgcctttgggcggacagatcttctaagcaggagatgtggatcacagtaccattcgccttgaagctgccagaaacaaatgccttgttcttggaggtcttaatgaaccacattgtgaagtgggctttcagcagcaaataagtgccccattttcttgtatctgggcatcacttgggctgctcgtgtctgacacactggcaaggctgctaagtgtatgatttgtgcgctctgaattgtgccgtcaccctggcttgcgctggagcgaaaggagatcctgctgcataccgaactgctttttagggtgagaaaatgaacatgggccatatttatatagtcacgtgattagctcttgatcagctgtggcttagaacatccccaaaattttaataccaaattttttttgttgcgtggctttggaatgtatcccatcccatttgcaaagttaacatcgtatatttttcttatcatgaatgataaattgctatacagagaaacagagaaatcatgggtataacatgaagaataaaaatcacctacaacctctccagtcaggaacgatcatcgtcaacattttgcataaatccttatagtactttttctatgtactttggggggagaatacaaatctgtaatattgcatatatagattttgtattttctcattttatttccttctttttattatacaagcgatacatggaatgtttattaaaataatcataaaggtaaaaaaactcccttaattccactagatagagatacctattatacaaattttgtgatttcttttatatttatgtatacaattatgtaactgtttttagtaaacataatatggcatacttagtttacagtatgcatttgcctaatcatatttatctataccaacgtctatccctgcaaatatatttatagggatagaatatatttgtatactataacgtattgcatatatgatttataatagtgagaatttgttaacagctaaaggactaatcgtaggaggcttactagtaaactaaagaagaatcatacaaggaaatactatgtggtcattatgatattttagaatatttaacaattgggaagatattcctattattaagtgttatattaataaaaacctagttacaaaagagtttgcagaatatatcatatttccattaagaaacaaacaaatttatttgtatctttttgctttttactttaaaagacttaacagtggttctctctggatgggaacacttttattatttttgtttttctatatttttttttccatgaacatgtactaatttcatagtgagaaaaacaaattcagtataccccacttctcattataggtattgaagtggaagcagaaaatgaggtaaaacaatgtgtttttatgtcataaataatttgagagtctagattcacaattgaatgttggttttattttttattgaaattgtaagtttgaaaatatattctagcagaaagtaaaaattgttcctaactataataagataagcagtatattttcttaaagataattgatagtgaattcaatccaattccccatggttgggttgcctggagtcattcttgactttattatcacactttttttcttgactcagtatcttgaagctttgtgaataaaaaagtctaaggaacatgtggctgttaatgagtaatgactttttctttcttcttgctggttctctgagtagtttatcatcgcttgtggcagcttttaaacacaatcttatcatctatcttcattttctcttttgtacagtaattccaattgtcttccattaacttttgcatgttaacctatttggcctaagggggattctcaacctcaatattagtataaaaaagaaaattacataagaacatgggaatttttcttagaagaatcattttgagatgctgttggcatatgaaacagtatcccaaatgggaagataatatccttgttaatcaaaaaactatttaaaaactcaattaacagaatattatgctatataattaatcttcattgcatttcactgattttttcccatccccccgccaacaaagtagttaataaatccttgagttttttttttttttgagatggagtcttgctctgtcgcccagggtagagtgcggtggagtgatctcggcttactccaagccccgcctcctggattcacgccattatccggcctcagcctcccgagtagccaggactacaggtgccggccaccacacccggctaatttttttgtatttttagtagggacggggtttcaccgtgttagccaggatggtctcgatctcctgacctcatgatctgcccgcctcggcctcccaaagtgctgggattacaggcgtgagccaccgcgcctggccaagtcttcgagttttaaatgcaataatcaataggctaaatttgagaatataaagtgagttagctatagaagacaatcagacatttttcctctgcctaaagtaattaagtcaaaatcatcagaagtctcttttattccaagtagtgttgaatctgcaaagcccgttagtgaaacttaaatagcaaaattaaaaggaaagaaattgaaacaaatttatgtggtttggcttccaagaaatcaggattgcaaaacataaacagaacaataaatatagttatgagaaagaatcaaactacttggagtctggaaaaacagatgagtagagatctggtcatgaggagatgagatatgcttggataatcctaaaccagctgcgtccgaattgtcatttttttagacttctatgctggctttatatttgagagatttggggttcaaatgcattaaataactttccgcttttttccataagattaatatgagactcattgtaaaactttacaaattaaaatgacaaaaggaacaaattgacaagttgcccatactgcacaaaaattaatcatgatgaaccttatgttgtatttccttccagtctttaaaaatattcatgtatgtttgatcacattattgacactgtattttttcacttgaaatatgaacatttccctttctttttaaatcccttgcttcttgcttctcgatttaaattaaaatgtatattcctcatagactcacatatgagataaaatgaatcattctccaactcattttcttgggagagagtgtttaatttttaaatacgaatcctcttaattgttatgctattcaattagcaccctttaacatgtgactttatgccaagttgttttgagcttagatggcttcttttagcaaggatttaagaacctggaggttaggtaattccactgtataaagacttacccagtcattatgtaatttgtctctctattcagtacccaacatcctctctctctgacctatttatgtcaactcctcctcatccaacaaatggtgttaagtatggagggagataggaaaagaaaccctttcttgatcagttttttgataaagtccctatctcttcttgccttgtgctcctatcatagaagttaatttttgtcagagagacacacagccatctgctttacagaccctaaaatatattcagggattaataacttctattcaatatgccaacctcacagagacagcatgttgagtttcctgaaatgtattcccagaataacattcagtgaatcttaagacaggaagtcacattccaaaaacacctgcaaataatctgcaatagttgaaaactgcagataatgggtctcacataattgggtcataaatttaatattttaaaaaacagtagttactatttattgagggccgaatctgtgtgtgccaggcactctgctaagcatcttgcaaatgttatttctaagtttttcaacagcccacacagttcaaaggaaattgaggttaagagagattgaagtatatagtttggccgactgtatctctgaaaataccaaacaggaattccacctaccattagtagacagaagaaagtaagctgcattctgctgggggagccatcttattttattgattttttcttctatttctaaactcttcaggtaatcgaactcgggttcatggctctggaatgtgctgtaaacattgtattcacccctacgatgaacctgatttttactctgtaggaaaggaaaaaaatacacaacagattaaatcacagtagccaactgtaaaactcgccaactcccttttttttccagcagtcattgggggtgggatgagggcagggccatgaggatgagggcagggccatgatagtcactagcacctctgaaaaaaaaaaaaaaaaaaaatatatatatatatatatatatatatatatatatacacacacatataattatacacatgaacttctgtactatcatatagtatacataatacatacatagaaatattaaaatagaacaaaattttaaaatcaatataaatagaagttctaatattttctttttgcatcctaacagatgctgcagtcaccctttggagtgagtcatcccacagtggcattcgtaaatacttacatcgaccccttaaagagagtacaaaattgtagcatctatgactttcattggccttttaagatctcacctgattctcatgaaatctctgaggtagggtggggcaaggaaatggacaaaagaggctcagatattaaatgactttccctaggtctcacagctcataaggagcagatttgggcatcagatatgcccctgctccttttttttttttttctttccaacatgagtgacaaagcagacaggagctcagggatgctacctgcatcattaaggaatgatgagactttacctcttggctttcctctagcgctgattatgcaatgagcaaacagcagggactacatacatgatgagagaattaaacacaagggcaagggtctgcagaaacaggaagaaaaagaagaaaggaagagaggagaaaaaaaacaggatgtgaaagaaagaagaagaagaggaggaaagtggaaagggaagttttatttcagatattttaggtccttattaccaagagcttcaagaagcaggctttgaaaaactcaaaaattcaaatatgagtcttattaaacatttgttataaaagcttgactcttaataaaagggttaatttccaaatgtatatttctaggtggatataaaatatccaaacccaaatctcaacttactgaccagtgagagtgctgaaccctgggtgtgtaatgtatttgtgcagactctctgggtgtgtgcctcctgagaattcactcctggagctcactcactgaagtcaaaagcaggtctgccctagatgatgtcacatgggtttgtttctcggatttagtgctcattttaatcccaagactggccacaaagcttaacgcttaactgcaggttctttatcctcactgacatttattttttattgaacaaaactaccctgctttagaaaatgtgtcccccatcattctacgaatgaatcaggcttcccaaatatttcactaaattaaaataggtgaaacctataaatagctaatggaaaatgtagagcagaatattactggcaacatgctgccttgggtaatttatgctaaatagctcctccggttcctctttatcatcactgcgaacttaattggtttttttttttttttttttttttaagaaaaagctggaaaaggaggtttgaaaatgagtgttcaaaagactttaaatgctgacatacttggtactatcctgctcatttgcagagagagccagtccaccttaacaatacatttataagagtgttgatttgctaccatccaaatcagactgtcaagtgtgtgtagtatgtgccagaccaattagcactaggcagctctggaaaagcaggaaaaattccaggtcatgaagagctattagtttctacttgccaaccacattttcgtgtttccagggccaatggaataggctggatgcctgatttaatgctgaacacttgaatttatatggaaccccgagggattacgatgcccttatagaaattaattgcaaataatgtgcaattactaaatatatcacctctaaatgaggctttccttttttgaggggaggtgtactgcaagtggctttgaggcacaaagcaggctttaaattgctagggaagtctcttgtgaaaccttcctctcacactgggcctctctcatgcttcccgagtgcccggtgaatctcagaggcaggcagtggcagatgggagagctactagaacacagactggcctgctggaagctcgaagaccatgccaggggaggccaaggaaatcaaattgggccataattccattttgacaaacagaagcagacaccaaaaacctcaatttatatgaaaaagagaaacaattcctagtgaaacccatgtctcaggaagaaatgggtttatgagagttactggaagttagaactcctgctcagaaatggtcctatatgtagcactcagctccagggccctctgtgtcacctacagtgatactgtgatgtgtgtcataagctttactcagacgctagtttgtggccttttacccccttaggtgaggtaagctatcattttcttctctgctgtcccaagttgtcctcttcacatctgttggcaaataaactatgtttttttcctcctgcatattctggcacacctgaaatcaagggagactgaatttcaatggctctatgacagatcccattgaaaaaggaggagttacgctcaacaagcacccatggaattttgcaggtcaggcgagaagtgaagttgttttgcaggtgtaacatccaggcgtagaaagataaggccatgcccagaaaaggctctcttttacagggcttttatgagtctgaatgtataacagttgatgttaatgacttttttggcagtttttagttttcgagcaaagcagcaaggttaagggcgacacataaggattaaggaacagtaggaggcctcctttaaaaagtgaagaaaatgggcattttgcattcaccaccacttacctcctgctctcgttgaaatattacaacccgaccccccttgtcccctgtcgctagtaattctcccgtgtggttgaattctaccgtagagataatgtcagctgcaaagaagaagacaaaggcaatttaagtaactgcacacttactttgaaaggatagataatagatatacttttctgtgcatttaagggcttagggctttgtctctgcagtggaatttacaaggatgttatgttctgggttttaaatgccaccagaagtggcacttgggaagtaaatttcctagatgcccacactgcacagtggtctcctggaacatctggagagaataaaagggaaaaacacatttatacccttttaaggaagagaaaattaacttcatgatggctgaaggaaatggctattttctttgatgatttctaccaaccacagacccttcgtgcatccacggcctttacaccaagaatcttccccacacaggcttcagttctggctattcaaatcagggctgggggctgtgatgaagcagggttaggatgcttgaagcttagacatggaaaatggaggaacagagcacaaagaaatcattgggaaaactctgccagtcgataattcaaggaaggaactgacgaatgctccagcttggcccgtgccccttctttttttgtgagcccaacacatccttctggaagagcatgacttatttcaaccccaggagaagggtgctgagaaaacaaggtcataagggcagagaagtgagggcaatttgtactctgtatttctaatcagagaaaatgcacaggcaccaggaactcagatcacagataattgctgaaggaatgccagcctgccaagtctttcttctatgctggttacccctggaggaacatggacaggtaaattacctatgattggatttattagggctatttttagaaaaatgtcagaggttaattcccccacaattattcccctgcagggctccaacaattgctaccaagagtgcaaatgagttaaaaaaaaaaaaaaaaaaagaggcaggggaattatgactatggcctttgacaggaacattctgaagataatgtctaggtaaggaaagcaaaggggaaacagtgaggtggaaaactaaggcaattacccctgagtaattctgatctcaaatcttacttttatatcattatttcaggattttctttgtatgcctgatttattcaggtaagtagtgtaaaattctccacttcacatataactgttcttttccatgtatgaaaaggctccttatggtcattcattgtgcagaagttaacaaaaataaggcataaaccttggtcactttcaagctagacacatttaaaagaacaattcttgatttcttgttttgacttcttagataattgacctcctagatagcaaatacaaaggcctgcagggccacaaagtaacataggtgaactagaaggactatgtatgtctcctttaaaggggcaagaggctattcagcttaagctgattggggccatgattgcctgtattgccatgtattgcctgatgttctcattgtttaaatatatataggaagctggaaatcaggacttttatgcaaaaatctcttaaagtttatacattggcaagtattttttccaatgccatgagaatgaaaaagttaatcatatctgtgggctgaatgtggtttgtgggttatcagtttatgacttctaatgtacagagtcttcatttggaataggctatctcattccaatactgatgctcttaactagaaatctagttcattttctcgagaagactccagtgaatactaccttaaggaaacacaaaataagcaatatggttactaagttccagatgtaagtttagaaggtccatttatgtaaccaatgcccatgaattgagaagaaagtccagccagtgagaaagccagacacctcaagtgagttatttgaccactttcctttgttacagtttgcccatcttagcaaactactcccatgtttagacgagagaaggcatctacttaacatttgcagttgcttcagattgccctgcttgaaagtaccagtgctaagttacacttctaacattaaccactgcttctggcttttcaatgaatggttagcaaagggttattcatggggcttccaaatttgggtacagcctaaagcgggcatgtctattgcttttcactttttgtctttggtcaggtacaaaggctggtccagttcaaggctcttgaactgctcaaatacaaacatttctcagaaagaaagagtagcaggaaataatgagagggtggtgggagccaggcctgaggtttacaatgcctggctcttgtctcagagctacgttctaaagttctgcttacatgcagtctatgccctttcactggacagtgattaatgcagaacactagagttctgggtgggctgcaagggccttacaatgagaactaaagatgggcctttccttttggtgaagttgggtatcagaagagagttaagtagcttttcccagtgtgagctcttggctcagttgccaagaagatattactccaagggcaacacttgctttcccaggggatgacacatacattttccttcttcctagactctgaaaatgtctttactctcactttaagacccatgcaagtcaaaacaaggcaggattcaagtggaagtcaaagtcacatgatttaagccagtattattagaattctgcattatggagtattaggcatggtcccaggtaatacaaatatttcctttgttttccaagtgttattattttgcaatgctatgtctccctcaagaaccttgtaagagaaagggtgatttgcatggcaggattctgaaattccttagccctcttgcagagtccttacctttattttaattctactagccagctgctctgtacatgaacctgtttatatcatgctattgtctacttcccttcagagaataagccgtggcagctcaagttaatacttgttttgaactttcatgtttcctgactcatttatcattgctaagccagtaggtgtaactggaatactttactgccccatccatctctgcatatcttcatctatgactgtttaataattgatgcaaaactcatgaatcattatacattccaatttcaagatactgaaacttctgatacaaatactcttgtgtttgcagcatgctctttggtaaggcagtttaaactggaaaatatactgctcaagacaaaataattttgtgatatggtaagaggatgtagtaataaggtagcaagtttagagataataacgtcatttgaaatcatgatccacagaaatcaattcatcaagttcaacatggctttcacctttaaattgtaagtttatatgacaattccacatttcattaactgctcagcctaatcatgctgttgatcaagaaactacaaacttgagcatttttcctctgttgtatatagatgtggataaagtacacaatgactaaaaacaaaagccagaaacagctagaaaggtcagatgtagttaaagtgatttttaaaggaaaccctgggtagtgtgaagtttgccttgctccaaatctatttgtgctgatttaatttccacaagatggtggcctggtaaccccatttctagctcaataggcactattaaggctgagtttattattttttttttaaatcaatctcagcatcctacaaaagttctagactggtaatttcatacataaagtattatttacctgaataatagatattgacttaacaatgatacgcatgtgaggctaatgattgtgaggcttacggaaacagaggaatctcctagttcatccctagtctcttgcagtatcatgctaggctggagtctatgcaatgccagagaattgagttgaggcaggcacctggattattaggtgatatacaactcacataggagggtgactgttttgataaaatggagactcagtttagacttaggatctaaactcaaagtctacagatggaatatcttactgaccaggtcactagcactgacctctcaacatcaatcatagagatggaaatgcaagggtaatgcaatttagttttcagagcccattaaatgttttatctttcatctaagaaacatttggtagataatatcataaagtcatttaccctacttgcatcagctgactagttctgcctactcaatacctggctttatttctgatgactggattgggttttggtagttttcgccttcagctaagataagaacagaaaatatatttcatagtgaatgataatggtgaaatgatcatagttaccaggtttgtgttgagaaggttttgcggggtcacttctaggctggggtgccatgattaatgggtaatgaatctgggtgggtggtgggggaggtaggatgtgtatcatttgtcatcccagcacagaggcttctagctagactggcaatgactactttgtggatcattaaacaaacgggattcttaggtgtcctgatgggaattacagttgttcctcccatccatataaaactgtggtctccttcttgggtcctggatcacggtccaaagtcagcatccattttctctgataaggtttactttaccaaagtaacttaccaagttttggtaactgaaatagtgcatttgagcatattttccacaaatagggggttggggaggggataggaaaaaagtctggttatggccaaacccaaatactcctactgggattatgccaagatgaccttgttgaaagatgttaatatgtcataaaatttagaaaataatcagtcaataaaacagtttatgtcaaatgattgcaattttgtcaaagtgttttcatttcagaatatatcttttctcttttttttttttttggcagagctagctgaggttttattttggacagaaaaacaaaacaaaacaaaacaaaaaacaattgaattgttttgtggctggaggcatgggcaaggggcgggggtccccaggcagtgaactcccccgcgggtgggctgagggctagggctgagcctcaggtaagtctcctgttccctgtgcttccttgcacagcagcctccctcctaggctttggggcagccgtaggaggggcaggctgggaggggctgccgcagctgttcacttgagcaggaaatcagaggacaccagcttcccatctcgggtcttgatcttcttcacaaccatggccctggtggagctggtgcggctgaaggagctggaacctgcgccagagcgagagctggagctcaggccgtagctgaggccagagcctgtgaggcccccataggccaagctcacaccacctgcatagccgctggtggtcttcgtatggatactcatgttctccatcttccagcagcttcctgtaggtggcgatctcgatgtccagggtcagcttgatgttcatcagcttctggtaggcacgcagctgccgcgccatgtcctacttggtctgctgaagggcggcctccagctcggacagcttagcgttggcatccttaatgaccagctccctgcgctgctccgcatctgcgatgccggcctccagggaaatcctcccgcctttgaggccctcagtctcagcctggagccagctgatgttccggttcatctcagagatctcagtctttgtaagacgcaggtcttcccagccagcgtctgcagctcctcatacttgatctgatacatgctctcggcctcagcccgactgcggttggcgatctcctcgtactgtaccttgacctcagcgatgatgctgtccgtgtccagggagcggctgttgtcaatggacagcaccacagacgtgtccgagatctgggactgcagctcccggatctcctcttcatacagctgcctgaggaagttgatatcgtcagcccttccaggcaagactccagctctacctcgttaatgtaagcttcatccacatccttcttgatgaggacaaattcattctccgtctctgtactcttattgatctcatcctcatagttgttcttgaagtcctccaccagcccctgcgtgttgccaagctccgcctccagcttcagcttctcctggcccagagtctccagctgccgcctaaggctgttgatgtagctctcgaatatgttgtccatgttgctcccagccgtcttctgctgctgcaggaggctccacttggtctccagcatcttgttctgctgctccaggaaccgtaccttgtcgacgaaggaggcaaacttgttgttgaaggtcttgatctgctccttctcctgggtgcacacagcatggatgttggggttcaccttcaggttaagggggttcagcaggctctggttgactgggacggcagtgatgcctcccatgccactggccccaccataggccaccccggaagctgctgctgcccactcaggagaagctcaaggagctgatgcagacaccaggcccactcgtgtaggagcagctgcagaaggcccgggtgccagaggtggacaccttgtaggacttctgcaccctgatggacatggtggaggcaggagtggaggcaggcgggctgaaccaggcggagattccagaaggagtggagaagctgcttcttggtagaatatatcttttctaacaggtaaagcaatatgtacacttacagaaacttctgttaatgacaaggtggcacttaaaatataaaactaagtttcctttacaatctgactctcctacaagtaattgttaatgactacacatacccacacactctctctctatagacaaaagtttatcagagagaatccaaaattgtactttttggtgtagaacgtacataatttattttcttatggtctttttctaaatcttcggtattttctatattttgccataaccataaatacttgaacaatttttaacttgtaaacaattttaatttgttttcaaactgaatgaaagattttagcactcatctcagcagctttaaaactttttaaaaatttaaaatttatatataggctgggcacggtggctcacgcctataatctcagcactttgggaggctgaggcaggtggatcccttgagctcaggagttcgagaccaggctgggcagcatggtgaaacaccatttctaccaaaaataaaaaaaattagctcggcatggtggtgtatgtctgtggtcccagctacttgggaggctgaggtgggaggatcacttgagcctgggaggcagaggttgcagtgagccgagatcatgccactgcactcacacctgggcgacagagccagacttggtctcaaaaaaaaaaaaaacactgtatatctgtatatctatgtatgtgtgtgtgtatgtgtgtgtgtgtgtgtgtgtgtgtgtgtgtgtaaaattcactttttgtggcatccagttctaaaggttttgacaaatgcatagagatatgtatccataaccactatcatgatatagaacaattccattgaccccagaaagttccttcatactgctctttttagtggacaattcttccaaaagaagtaaaattatgggaataaaatgaactgatagatataagagcttgtaagagttaaaaatgctgtgtagatacagtgtctctattgatatgactcaacttgatttggcaccaataattattttcttagtacacagagtcaaagattttttttaatctttctgtctagatgttattactatttgggattctgtttggatggtatggagctaaaaaaaattcatcaatacacttttgccaacctgcatccaagctacgttatccatgaagtattctaccttttcacctatgcccttgtctaaatggaactatgtttgagttcctgattcagtagcgttaccttcttaacttgacactgcttctcacactcatttagtttggtactaaagacagaagtagtaaatacacagttctgattacacatgccacatgcttgctatccttgacctactgtgtgtaatacgttctgtttgatccagaattgtttcctctgtcatccaatcagtgtctagtatttggatactgaatattcttcctttcatttaattaattctgtgcatactggttttatcttcaacctggtgctggtttacctcttagatgaaagaatacagatagaagggtccaatagctccaagtcccaagctcttatcacaatggctgtttcctacttaaccataagtgcagtattaaaaaatgggcactgcttaaatgtcagtctgaccctgtagatcaagcccattaatggcatgtgttatgtcatggcagatactcttggttggctactcctactcagaatctttcttccttgcctgcctcctactgtcccactgtagaggctggaaaacccacatacttgctttttagcctcccttgtggctaggggtaattgtgtgacccagatctggccaatgaggcatacaggaaagtctactggggaagcaggagcgggacagagattctgggaaagagttttcttccctgaataaaaggaagtaagtgagggaaggccttctgaccggactcttcattgcttcctgcctttgtttgtaattaaatgtgttcataatacgtggggctgtggcagccatcatgtgaccatgaggtaataagcctatggactttaaaaggctaagaagctgagtatgacagatgggagaatgggacaatatctttgatgacactgttgaacaactaaaacctaccttaagacagcctatgtctgaaattgttaaaccctgtggtttaagctactgttagtaagttttctgttatattcatctaaattcatgctactatacatgtctttccatctttgttttccttatagcactttgcacagggccaggttattaatgcatgttgagttggaaactcccttgccttacaacatatttgcacaaactctcacatgcacatttccactttactctaccacacaaccaattttccttcccacttgcttgattcctagtattaagatgatttgtgtttttcctccttcccctgctgtggagatggtgtattatttttcaaccattcagatatgaaagcagcttactgggatagaatgccaaccccaatttattcatggtgttcattgtaaaattatgacttcagagggacctagccacaccctctttaggagccaagctttccctgctaatatgcaggaagcccaccatgcttgctgagctgtgaaaatccagatggtgggaagcaggtgagtaatgaatgccatgctgttccccttaaaatgcacacagcttccccaggctgaccaaatctccaacactaaacaggtttgaatcaacccaaggacatgtgggttgataaagattgccttttattcaaaacaagttcctgcaacatagaagcctagaagataaaattttcccatagttggaacaaaacttgcctaaagggcaaaggagtcttaaaaattataagtctctgagtacagaaaaatccagtgggaaattgatagcagtccagacttgcctacatgcctgtgtggtttacagtggaatctgctgtcaaggtgtttaccatctgtcacccaatttttcaaaaagcagaggagtaattaactgctcaggcaatacaaactctgtcaatcattcagatctattatccgcacaacatgggacatctatggctgaccccaaagtcagcaggactccaggtccaaaatgagaaagttctcacatctgtgggggaatgggagttcttgggcaggccctgtgctacctgctacccaaacacacatattatggcatctggcacatgtttggtcagaaattttgctttgccagatgttctgaagtcagtaagacatggtatccactttgtggaagctaaaattccccatattttgggactggctcaggtatcacttccttaagaagccctgtgtgacttcttttaagcccaacacagctccctttattatgcagcctcattgctccccatactttgcctttataagttatcaccactaatcattagcatttatcacaatgatattagaatcatttatatgcctgtttcagtctcttcattgtaaacttcacaaggaacttgttcaccactaaaccctcagtgcctagctgagtctcttagtatataacagatgcttctcaatctttttttttctatgctcacaagtcatcaagcaatcaatcttttttctttaatggatcactgaatgggcactgaagagagccaataccaaagtggaccaacatatagagaatggataaccctaaacaaagtatcaataatcaaaatatgtatgctgggtagatgtaaacatttacttaagatgtgaagcaagaaaaagttctcatttggaatagtgagtgtttgatgattttagaatgagatacattgctcaataaataatagatcttgtcctaaaaagcctttgcagcactgtcagggattcagggtcctatgaataacaggaagagaaagcagatgggttgggggagagaggatgtccaggtagggtcctacttgggagagggcatggaggtggtaataagaaagccaaagtggatgagcaaatacatctgagatgaaaggactcgatttaatgaatgcctattatgtgcatgtcactgggctgggtaccagagatatagtaataaacaaacactactggtacttgcccttgtgaaactctcagttagaggactgggaggtaatgggaggttgggatacaagtacaatgttggggaaaggttgttcaaagattctgatcatagagatttttaagtcaaagaattttttttttcctagagggaagcagaagtccttatcagaactcaaggaaacacatctcagccatatccttgcatgcaataaatctcttttatttctctaaaggacaaattgaacactaaatacaatgcatatttttgttaaactgtaggtgggcctaaagaaatgaatgaagaatatgataggcaaggatttgattttttcctcctaaaacatgaggtcccgatgtcaaacaaaataaatatgttgctaatagttcacaaggtattattatgttacgatggtttttcaagggtcttagcaaataaaatggaaagtattagaaacaagcgtgccagttataataccatgaatcacttagtattttttctctttctccctccctccttctagtttctggctaggagttgtggtattttgaagaatattataaagtatgctctcttttggataatatgcatattttaaagcactgaatgcaatactgtacacacagtaggtaagagtaaaatacagaatgaataaactagtgttgattttcatcagcagcaggacccaatctttaataaatattcatcaggataaaggcagtatagtaaatacttactgcttttatctatccactgaaaatcggatatttagaaaatctattatatttgacttcatggtcatgtagcagtttagataacaatgaataatattaaaactagaaaagtcaggaaagatttaatgttaataggacataagggtgatctggttgcaacatctgtcaccccactgatcaccagggttgatttggctgatccggatggctaggcaggtgtctccttcctccctcaccactctgtgcatccctcccagagctgcacaatgggttgaagagcatgatcatccccaatagaggaggactggtcttcggtcaagggtatatgagtagctgtgttcccctgctagaatctccaaacaacgtctcaagatttagggttaattaattcattcattgacccatttattcactcaacaaatgtacattgaacacaccaactacgtgtaaagtactattccagatattaaagaaagatcaattaaaaatagataagatatctgtcctcatgcatcttacattctagttgtggagaaaagaaaatcatcaatgaacatattaaattacattgtatgttatgtactaaggaaaacaaatagagctgagtaagatgaacaggactggcattttcagggaggctgcaatttcaatagggtggttgtgacagacttcatgggggagacttgaaggagtggaggcgttcacgatgcaggtatctgtaggaagagtgttccaaagagatgaaactgacaatggaaagaccctaagagggaaatgaacatgtgttaagggatcagtgtgcctagagcagaacaaacaaggggtaaataggtaggagaaatgggaggttcacatgatatagagtcttgtataacacagcaaggactctcttactaaaagtgaaatgggcacaacaatgtgaatgtatttgatgccaccaaactgtatactgaaaaatagttaaaatggtaaagcttatgttacgtacattttacaacaaaaaagtgaaagggatagctgttggaaggatactaagtagacaagtgactgcttttacaagactcaatttggctacagtgttgataacagactgtagagggctgaggtagaattgggaagtgtattgagataatcaaggggagataaaccatggtgtaggctgtggaggtgaagagaactggctattttctggatgatattgaaagttgacctgtgaggatttgctgatggattgattatagggtttgaaaaaatacaagaatcaaggatgatcccaaagtttttggtctcagcaactggcatgttagagttgccatcactgagaatattgtgagtaaagcaggctttttgaggaccagatgttcagttttatgcatgtgaaatgtgagaggtttataagtacagatgttgaggagataactggaaataagaatttggagttcaggagaggggattgagctggtgatataaatttgggagttattagcattcagatagtgtttaaagcaacaagaccagatgaggtcttggggagtgagtgcattaaaataaatgaagaggaccaagagctgaacagtagggcactccaacattgaaaaagttggggacagaagaagaaaatccagggaaaaaaacaaagagaatgaccagtgagataataagaaaatcaaagaaacgtaatgtcctggaaaccaagtgaagttcagacaagtgaccaaccatgtcaaatactgctcataggcaagctaaaagtttagagtaaaactttaagcttagtactgtggagctcatttttaactttgagtaatgtatagtttctatgggatggtggccataaaacttgatcggagtaggtttcagagagaatgggaggagaggaattggagatggtgactatgtacaactccttgaagagtagcaaagaaatgaggtgaaagatggtaaggaaagtgggatcaagagagtactttcacagtgtcatagaaataacagcatgtttatatgctggtgggaaagttccaactgccaggaaaaaaataacgatgaagaagaaagaaggtggaattgctgaatgaataaaaaaataaatgtatagatgaacaggccaggaatgaggactggtcgccactaacatttgaaataaaatctgtacaggttcaaaccctacccacagccaaaatctggatagtaagaaaaatgctattgaaatcttctcttcatataaggtttaacaggattcttaaaacatttagtattacaagaatttctctcatatatcagcatttcagagatccatgtgattgctatgaataaaagacctcttgattttttttttgtttcttcctccttattctctccctctcccctgacctcacacctcttctttcttttctgctttccactcatctcttcctcccttcccttctccttttgaagctgagagcagaaaggactctgttcttttagctacctactatctgcctaccaggcagaaggctgctaactcatatacactttaaagtgatgagaaatctactacaagatcacttccacatgggtaggctgacctccttttggccttccttaactttcaccagtatccttaatatcttatagaaacaagtctgtcagagtggggaaaaaaaccctacactctcatcctttccctgtgcaagatttacagacacattgtaaatggccagacccaggtgatggtgccaggaactttccaagtgatttgtagatctcccttccaggacatcagtctttaatggaaaactcttttagctgcacattcctttcctgcagtatgactacaggtagagaattgcaactgtcataaagaagactcactgaaattaactagctattgacttggtctcaagacattacagtctaagagaaacaccagcactgcacagtttagaaaagcatagtttttctttgaaactaccatttattgagttggcctactgcaagccaggcacggcgttcgaccctctatatacatacactctcttcctaaatctatagatccatcgtcatatattggatactgactttggtcatgatctgtgctttgtgttttatgttatatcacttaattgtcactcaaactccatgagttttagtatctttctccatttttcagttgggaaaatggtggctcagacaggataaataacttgctcatgtttgtaagactagtcgtggagctgggatttaaacccaattgtagttccaaagcttgtgttcagaacctgcctttttgtgggctgcttcttttccctccaccttctattatttcttgttcctattctcttctgtatactatctcttcttttttctatataaattcttttttcatctttcactcacagttgtaggttttacttcttaacacagcagagtgtatcttctgggctcagtcttcacttttccatcattgtcacacactccatcaaagtttaactcctcagactctcaaagcaaatacaatctttgctgaccaactgttcatgccatttcatttatctaatatattcttgtcattaattgtgcctgttgacatctcattctttgagacagcatgtcccttgtgggcaggatcttctgcattattataatctgaggacctagcatagggactggcatctagtaggtttgcaaaaaacacttgtttactgactaaataaaaaagtaaatacacaaatccttcaaggccagctcaaatgtcacctattccatgaagcttttctaagcttcattgattggaaaaaattccttcttcctcacaaaaactgtaactctttgtacttttacatgagatccatgacattgtcacttacatgtgtacttgttctattttcctaactgaaatgtatttcattaaaggcagaattcctattttactcaattttgactctactaagcacaattaatgtttgatgaataaaagaatgtaaaatctgaacctttctctaataatacaatttagctcttaacctttattaggagatctcggacatctttgaggatccaataaaagctataaatcctttccccataaatatgcatgtacttatatttgtgaaattctgcatcttattttcatggtacttctgaatctctggatccctagtgggatctgagaccatcactcaatactaccctgcattcagacctttgcttaaacaattcttcaatctggaaattatcctcttagaacttatcctgtttcccttcccttctaacacccagttgaaaattattctcttctagaaaccaagtaaggacagtttacatttaaaacttcactaacttagctggcatcttcttatcaggcatgactcatttctattggattatggtctgaatgttgatagatggctcaaatatactttgtgtatgtgttatctgtttaactagattataagttccctgaaaacagaataatatttatttctttagtagaaagcatctttttcagtacctaggatcttattctgtgcatagcaaacatgacataaatggttcacaactggagatttaggattctcatggggacaactgactttgggtttatgtaatgcacatgacagctctctgcttagcttaaagtcacacatgttccatttttacctacaacttattgttatttttaattgttcattgctataggcttatagcctgggacacctctgaaataaaactagtatttgagaaatctagtaccaaggccattttcagaaatgctttctccaggaatagcagataggagaggagtgaaaatcagatcacatttccatacctccaaggactctatttttggggaacatttcaaatactgattccaacaacctaagttattgcctctggaggatatgaaaaagcttcaaacttgaaaaagtccataactattaaatgcgttggcaaaattcctttctttccaacacacaccatagcaggtttctagcactgactgtgatgcattgctttctgcaaagttcttggggaataaaaaatgatatgtcagtattttatcaggtaacagaaggaaccaaaccattaagcactgaagatatagactcaacactggccacaatctcaaatatacctcctgcttcttcacctgaacttgtatcaacagtaaaatgtactagacaccattttggggaagctttggggtaatacaaccttttggtaggtcatcattaagaacactttgtgaacgggccctttcctccctcgcaaactatcccctgacctccctccttaccattttctagccctacttttgctttcaggatctcataaatttcctgctttcccccttaatttggggaaacatgctttgcctaaactagtcccccgtcctcccttttccttagccaacatctcttcattttaaaaaatttcagcttgaacaacagcacttcctgagagtggacttttctgacaacctattttaaagtcttcacattgttctttatagtactctatcctttttctttaatgcatctaccataattcatcattatgtatattatgtatgtttttgagtgtttattgttaatgtctgtctcccttgtaagactacataattcacaagaattcataattcacaggaagcacagctgattttttttttaaccaacggtattcctggcccctagcccaatgtttgacacatagtagacatgcaagcattgttcaaggaaagtatggttttctaatcctatctctacaaaaaatacaaagattagcctggcatggtggcacacgcctatagtctcagctactcaggaggctgaggtgggaagacagattgagcccaggaggttgaggctgcagtgagctgtgatcgcaccactgtactacagcctgggtgacagagtgagaccccatcttaaaaaaaaaaaagtacggtttcctagaatatttattaatatttgtagcctgatcatttggattatatcctctaatgttgttcttacacacacacgtacatttggttttcagttgaattgagtgtagcagaactatgggatcatgaaaatttgaaaaccaataaaatccacatttgcttcattctagttaataaggtctatgctgagctaatcatatacacgaaaacacatgcattataaaatgcacacacacccttctgctacttaaattccagcccttgtctaaaccagtctccaccctttcaatttgcaggaagaaaggcaatcgaacaccagagactgggtgggaagatctttatatgccaagaagtctgacccagtgaactatttcagtcacatacgcagtttgaattggattgcccgatccctgagaagggatttctggattagacagttcattagaggctgagccagcttctagggcttgtcagtctttgctctgcatgcctggaattagcaaagtgatgcagtgaaggctgcctgagtgacagctgccagtgagtcacatgaaataatggctgaaatagcagctacttagaggcaacaaccacacctgcagcacagaatcccaagacgaaaatgagatttgctgtccattgaaaactatttactgagcaccttctatgtgcctgacctaggactttgtcttgagaaataattctaagagttgatcaatagcagtcttgtaatcccaggttaaattatagcttccacatttactagctggcaaatcttgggtttattatttaacctctctctctgccccctacttatttaatctgcaaaatggagatgatgatattatgttgagaattatgtacataaatttatgcaaagcacttagaatggtacctgacacacataagcactaaatgttagtatagtattttacctagaagtaacataatgaatggttaacagaatgactttaggtgtcagaaagataccattcatctctgtcatttacaagtgatgtgcctttgggcaagttacttgagttctctgaatctcagtttctttatctgtaaaataagaataatattggtaccattttggaggggaattatgaggattaaatgagataaggatggggaggagcttagcatgatgccttgcacattgtagctcctcaatatatataatttgttgttgttgttcccagtggatcactcatctggatcccagataaggcagagcaaggctccacagctccacatcatgggaccaaatagcccagaggataccagttggagtggataggtcatatctgacaagcagatttattttatttggactagtttattaacattgcagtattagcccacacaaaggtttccaacattttgaatgagtttctatcatctaaaaagtataaagtttcattttaaacaattgagatttttcagtttctttagaaaaatgaagattggcaacatcaagctggcattcccatatggccattcctgacttgagtggggaagcagctgctccctttagaagggcataggtcttgaatttactgcacctcctaacatttcctagtgtacccccagccttagtgtcaagtgccagctcccatttaccctcctgaggttttcctctacctctctgctttcatcttttacgctactttgcctctgtaggcatctgagttagcagctgctggtctttactgttgagtggtatcctctgcaaactggtacctctctacagggctgcatgcaaggtagcaacacctttatccacacaacgttaggtcatttgtcagcactgcaagtgcaagtatggaatgaaaaaacagtcaaaactgcaaatgcaagtgtggaatgaaaaaacagtcaaatcacaactaagggctggcctaaccagtaagctgagcacatccttggaggacagcctcttacccagaagttgactgcatgaattcactattcactcaccctgaatcttctccagtttcatttagactgagggtagaggatatgggacaaaggataggggtgctatacaacaatacttcaaaacttggttaatctaaaatatatcatatggaccattagttccttaagatgctgtttcttggggggaagatgtcgaacactgttgggaaatagctcatacactgtccctcatcttggggatttatctgggtaaatattgagttgtcccatcagaaagaagttcacccacagttcatacattaacagatatttactaaggacttacagatatttattaaggttttattaaggacttgccaggcactgttctttttggtgttggagattcagtattgacagtcaatattaaatctgaatattgacagattcagttcagacaatcctgaactcaggtaacttattctagtgtggagtaaagaagacttcactctctttccaaatttatctgactatagaatgctactgaaaaatactgctttatacatagtgcatagccacttgcaaatcctatctcttgagacttttcatgataaaggaatgatggagattttcacttctgtgaatacataagagaatcagaccactccaaaatgttttagagaaacagataatttattttttatttcttgaaaagtcaattaacccaccagagcagccttaatttggaaagaaccacagcctcacctggggactcaggcctggctaagttttctgagaatatcacatgaagggttaacttgacatttacctccaaactggagctgtttttctctgcctctaatatgaccctgttggaaatgtatttgtttttcactatttaatcttctgcatcacccactgttgattagatttaattaatttatgtttctaatgaatttagaaacttgcagtgctatagcaggaaaattttcagacagcatctggccaccaaatggattgattaccttgtctgcaaaagtctttcaaacatctggggcctgattttgtgaaacatccagaggctctttcaaaggtaagaaaacccacacagaagaatcttgaggggagaaagagagaaggtgctagaaataggtaggattctctttgatttgcaaaccaggatcctggcactctcccaacatgaaatcacattttgctgctcgttggcacagtttcaatggcaccaaatagactgatctgaatctattttgttcaacatcattggattccaccaggcccaagccaggctgccgccctgtgcgcttctttggcacttccttctatgtggaagctcccagtgatcattaaggcgaaacatttacagaaaacattcagagagaagcactttgctctcattcactcaacaaacatttatcaggagcccactgtgtgcctggcactgagccacgcatacctcttaagtagctcttgcaacaaccttgcaggataggtaggtactgctctcccattctcatagatgggaccaagtaataagtaaaaataacaataatcattaaggttaacaggaacactactaatatagatgtagagatatgcatacccacacagcaggctctgtgtgaagaactttacatgcattaactcatttaaccctcacaataaaaccataaggtagatgtcattattactacccccattttacagatgaggaaactgagtcactgtaagcttatgttaacccagctagcctttggcagaaccagccttctaacataggcagtctaacttgagagctttttgctataaaccactcaactttactacctccagatactatttactgaagacctgctatatgttaggtactatcttacagcttttacaacattagattttaatgacatttacgccatatgcagtggatgctattattcccagacaagaaaacaaaagcctagaaacattaagtaacttgttgaagtcacaaagagagttagtaagacttaggctatggcttaactcaggtctgcggagctacaaaggccactttctgcttactgagttatctgctgatgaatcagagaaaaaatgagtgttgagaactcaatagctttctcaaagctgccccaggaaacaaactaaaagtcagaaggcatagcctggctgctttgcacagcccagcccagtccagaaaaggggaagctacaaaatatgctacaaagaataagaaaaacagcttcatctaacagaagtaggtgaaatcttattgcctgactggtttttctggctcaaattcagagaaatgactgacaagcaagtgggttgcccacagtataaacaataatgaaaaagcctgcaatgctgaacatctgaaattttttgcaatgttgcacaatcaggttagtgcctaatacatagtataaaacacaattatatacagtaccagtgttgaagaaacccagtttgacatggttcttgtgatagaatataattactaagtctggccatttcttttgattaaaaaacttactttctttgacttctctcttgtctactgccactacctaaacatgaacaggtccttgctcctctttgggcctttgtatgtgcctttctctgcctggaacctggctaatctctattcatcctcgatcctcagattgtcgtctcttcctccaggaagtcttccttgactttcctattctgggttagatgcccattttaagcacaatgtatatttcctcctattatagcatttattacaccgtaaggtaactgtttatttgttggcctcctcattgagagagcatatgttggttaccactatattcccagtgtatgggtatggtacataataagtgtccaataaatatttaattgattggatgaattggagtgaacctcataacatcctctttgttggtctccctgtttgaaacctctcacctccacactttgtgctacatcccgtcagtcattcagctttcctttaaactttcatagtgtcattttaagaaatcacttccctttgaacactcacataaaagtcggaatactgataatctctgggcgagggagaattaagtaagagtgggcaagagaaaatcttacggagtcctaaaactgtcctgtacctttatgtgggtaatggtgacatggttgtatacatgtataaaagtcattaagctgaatacaaaagaataatgctcgttattgtgagtaattaacacctcagaataaacacatgaatcctttgaaagatcacttgtgttgataggataaaatccagacctccttgccccagttttcattgttctttactgattggcccaatggtcgatgtacttgttcaaactcacttttctaaaacacacgccctgatcttctaacaggtcctgaaacccttctcactcattcccatctctgtgcttaaaatcatgttttcttaccctaaatgtttatttctcttcctcccaccttacaaaagctcctccccctcttggagggccaggacaaattcatccatacaaactcaacaaatccacaaatctcattaatcccttttttctctgaacctttgactattttgtctgtttcattcattcgtgccaacatttcctgaggactgtaagttccttgaaggcagggatgttatcttattttcaatttttatatttaggacagtgcctggtacaatggtagattctcaatatatatttgttgtgaatataccaaagtcctacttacatgtccagaccctgggcagctatgagtctatacagagattaaaaaggcaggttgtctatgtcctttagaatgaaaacatagtggtgttaagcccatggacttaggattcccacatgatttcaaatccaggttttgcaactcactggctctgtgatccagtgtattcgatggccatcccaaaaactcagtttcctcagctgtaaaatggggactgtcataggtttttttttttgagggttacatgagaatataaacatttattttattagtgagcttttattgaatttgttgttttgctaaataatacacaattccacccaaataaaagcttatgcccttgatgttataatgcaaagaattcagcatagtgatcgactcacagggaacactgaacacatggtagctattcttatcagagctattataatccaaatatatagttgcagtgagaaaaatctataaattaggaggtaaaaatgtagaaagcaaggagagtggactcgttgtgagatatatacatgtgcacacaaacacagagtgaatctaatctgtaacaaattccttagggaaattccatcacatcccattaacacggtcccaaaggcaggagctgggctgatcttgacatatttaatatctttgaaaaaattctgaaaccataatcatctcaaaatggtatacaaaagcaagtctatctgggagttacatgcaaacacattttaccttagttctagcttacataattctttaatcatcataattcctagtgcttctcttaaaacttttgaccttaagaggatgattgacagttaggaaagggagaacaccgctcaatagggttttgacagttaggaagggagaacactgaggaacaagttctcagtgtgtttttacacactcatttaaaaggcaacagtttaataattctaattcatatatacttctattaatgcgatcaataattcatagaaattcctcagcagcatttttagtgacaacagaaagggtaaaatatttcttctcttccctttgccttcctttcctcacttagtcatgcctggagcctggagagcacacaatttcaagaaaacagtttccatggtgattcttcttttgagtacccgactgtattttgctctttctggagtgaattaatgcttcttattgctttcatgctaaatatattgcagattagatttgatttcctttgcagtgatatagttttattgcgaaaatggaaagtaaaaacacagcatgaagaacctatgtatttctgccactacactgtcagaaggctggaaaaaaaatccgtttcagaaaaaaataaccagccatagggaaatggatgcaggtatctggaagctaggatatgcatgcatgcatctaaatgttggaaagcctgccttagaagataatcttaattcttctataagttgaaggtgttataagttgaccataaaacactgagttacaagacatatcgatttttagtgtactatcctcttctcagcacagaaaatatatatcatatagaacaaagaaatcttcaaacccacaatatggcacttactttatattttattaaggagagctttgtttcctactaaagctaaataactggccttctttcacttgttaaaatagttatgtgaccttcctaagattcccatagcaccctgcatttcctgacatagaatttatcacatgtacttactatccactatgtccatcttcctcactagactctaaaagggcagggcccatgtctgtcctgttcactgttgtaccttgtgcctagcatggcacatgggaagctgaaaattataacaagaaaactatgaaagctaactctgaggcactgaggattttcttgtaaagcatcagtgggctggtgtgctggatagagatggaatctcatgtacattataaatactcaaatcttagcagcagctattggttttgatagtcagtcctacctggagccttgatcattacttgtctttgaggcactaaggagttaaagggaagaatccatcatgccagaggaggaggaacaaaaagcaggcaccatcctctaaagcctccttctccaccactgcatccccacctctcagagcctggagccaagcacttactgggcgtcaaacaagcaggaagaaaactaggattttggccaatttaagccaactagggagtattcagcatctatgccaaactagatatgactgtcctaggtgctgctgaggacaaagagtggaacacaggactttttggctctagcgagtttatagtctcaaagggattcttttgggattgtgcagaaggggagtatggccaagtataaacacacacacataccctgattattaacaatagtgaccatatttattgaacaacccattaggcacacttctaagcaccacatatgcatgaactcacttgatcctcatagcaaatctgtttattcctattattttcatttgacatataaagaaattgagactttgaaaggctaggtaacttgcctaacatcctaaaaccagttagtagtggagctaagattcaaacccacacagtctagtccttgagtcaatatcttaacaacaaaaccattctgaatctcaggctcatgggatctgatctgagaaatctactttacaaaggatttcccacagtctcttttgctgtataaattatccaaagtcgcttatgttcataaatgctcctggggaatcatcaggatgcatagagggccatatacagttctggatttcaagaggaaacccagttctgtggctatgtaaatgttagatttgcatggctttgtaactaggatacacattatggtaagatttctcctggctcaaggaggcgtttccataagaagggacaactggaggattactgaatgctaggtttcatcctatagaagagagacactctagtgttttgacacactctacaaaggggttcttttggaacttcattttctaaactacccttcagggaattcaaaattgctcagctgtatgctgaatttgattccacaaaaaacagtgacaagaacaaggtctcattgtattagctcacagatatttcccttcatttcagagtgtggattcctacagctatgttaaacatttatttaaaaaaaaaaaaggacaggaaggatgtggatgaagtcttaaagggtaggattatgagaggtgttttttttttacttatttaaaaattttatttttaattgatgaataattgtacatatttatggggtacaatgtgatatttcaatatacatttacattgtggatggattaaataaagctaattaacataactatcacctcatatttatcactttttgtggtgagaatattttcaaatctactcttttaagtgaaataataaacattggagacttctagaaggtgggaaggtagaatgggggtgagggatgaactattacctatcaggtagaatgtactctatttagataggtgcagtaacagcccggacttcaccactatgcaatagatccatggaacacaactgcacttgtacccgtaagtcaaaaagaaattttaaaaaaattataaaaaataaacaaaatacccaaaatctattcttttagcaatgttgagatatataatacattattaactataatcaccaagttgtgcagatctctaaaacttcttcttcttgtgtaattgaaatgttatatgctttgaatgacatcttcccatacccaattgctcccccttcccctatctcaacccccaactccgaaaaccagccccgggtaaccaccattttactttatacttctatgagtttgactttttttagattccacatataagtgagatcatgcagtatttgtgtgcttggatggagtttaaaattttacttttgctcttttgagataattctatttctcagttttctgtaataagcatgtataattttaaataccacaaagtaactcactcactttaaaaaacttttagtttctctgaatatgatggctagggaaacacttacttttttttttttttttttttttttcagatgcaatgatttcccagcaaaaggaaagcaaggacagggaatggagagataccaatgtagcaaatgttacctatgagatctcagaatcaggaaggggaaaaatgttttcttctcagtattatccattccactgtgtgactcctataaacagaatatttttaaataagaccttttccccatgtttagtaataagagagattatcacttattaagcagcaaaaacattgaataggtgtgtttattttttctctcagaagagagaatgggctcagagattatgttctgtacatgctcagagtcacagagttaacagatctccgtgggactgctgcactccacatcctgttggttaatactttgctctcctgtcttcgtgtggagcaaaataatcctccaacagttgggaagtgatatggtttggctgtgtccccactgaaatctcaacttgaattgtatgtcctagaattcccatgtgttgtgggagggacccagggggagttaattgaatcacggggactggtctttcccgtgctattctcatgatagtgaataagtctcatgagatctgatgggtttatcaggggtttccacttttgcttcttcgtcattttctcttgccgctaccaagtaagaagtgctttttgcctattgccatgattctgaggcctccccagccatgtggaaccatataagtccaattaaacctctttttatttccagtctcaggtatgtctttatcagcagcatgaaaacagactaatacagcaaattggtaccaggagtggggtgttgctgaagagataccccaaaatgtggaagcaactttggaactgggtaacaggcagagattggaaaagtttgaagggctcagaagaagaaaggaaaatgtgggaaagtttggaacttcctagagacttgttgaatggctgtgtccaaaatgctgatagcgatatggacaataaaatccaagttgaggtggtctcagatggaaatgaggaacttgttgggaactggagcaaaggtgactcttgttatgttttagcaaagagactggtggcattttgcccctgccctagagatttgtgaaactttgaacttgagagagatgatttagggtatctggcagaagaaatttctaagcagcaaagcattcaagaggtgatgtcagtactgttaaaggcatttagttttaaaagggaaacagagcataaaagttcagaaaatttgcagcctgaatatgcaaaaacccattttctggggagaaattcaagctggctgcagtaatttgcataagtagcaggagcctaatgttaatccccaagaccatggggaaaatgtctccaggccatgtgagagaccttcatgacagcccctcccatcacaggcccagaggcccagggggaaaaagtggtttccaggactgggcccaggtcctcatgctatgtgcagtttagggacttggtgccctgtatcccagctgctccagctgtggctgaaaagggccaacatacagcttgggcctgcggtttcagaaggtggaagcctcaagccttggcagcttccatgtggtattgagcctgtgggtgcacagaagtgaagaactgaggtttgggaacctccacctagatttcagaagatgtatggaaacacctggatgcccaggcaaaagtttgctgcaggggcagggccctcatggagaacctctgctagggcagtgtggaagggaaatgtggggttggagcccccacacagagtccctactggggtactgcctagtgaagctgtgaaaagagggccaccatcctctagaccccataatggtagatccactgacagtttgcactatgtgcctggaaaagctgcagacactcaatgccaacccatgaaagcagccaggagggaggctataccctgcaaagccacaggggcagagctgcctaagactcttacatcagtgtgacctggatatgagacctggagtcaaaggagatcattttggagctttaaaatttgactgcctctctggatttcagacacttgcataggctcagtaacccctttgttttggccagtatctcacattttgaatagctggatttatccaatacctgtacccccattgtatctaggaagtaactagcttgcttttgattttaaaggctcataggtagaagggacttaccttgtctcagatgagactttggactgtggacttttgggttaatgctgaaatgagttaagactttgggggactactggggaggcatgattagttttgaaatgtggagacgtgaaatttggaggggccaagggcagaatgatatggtttggctgtgtccccaccaaatctcaacctgaattgtatctcccagaattcccacatgttgtgggagggacccaggcagaggtaattgcatcatgagggccagtctttcccgtgctagtctcataatagtgaataagtctcatgagagctaatgggtttatcaggggttttcacttttgcttcttcctcattttctcttgccgccaccatgtaagaagtgcctttcacctcctgacatgcttctgaggcctccccagacatgtggaactgtaagtccaattaaacctctttttattcctagtcttgggtatgtcttcatcatcagcataaaaatggactaatacagggaaattaaacttatatcattaaaaagagaggtgatcagggaagcctgaattggcatgaggagtctgaccaggaaatgtagccaaaagatattctctgcattccaagaagaaaccgatgaggccttcgaggctcacagtggaaagggttagagaggaagattcagccatgtacgaggtgtgagtttggagagaaaaacacagattagatgtatcttcctgctgaagccatacacaacacaccagctggctccttttccaatccatgctctatcagctaatccaacaatcatattttgttattcttctcataaataaaatgttgtatgtgtgacaaagacatccctgacaggagactgcactccaagtaagttagaatgaatggtgacaaaaatgggatgttttcaggtatacagaataattgccagttactggcacttaaaatggctgcaaaatctgtggtactgctgggtacctgatgtttgctgcagcctcaggactctgatgcctggactttttcagggtcttatagtatccattggctttctgtttatagtgctaatggaaaattaaaattattttgcaagagaccttaactatactgtactatgagtactttatgtggcagagagaaggccaacttgcatttctgtatattcttctcctttccctcttcattttccgtggcttcccgtagagtttaactgactaattaagagcttgggctttgaagtcagatggatctgagggtcaaagcacatttctgccatctattagctgcaaaaccttgggagagtcagtcaccctcattctcaatttccttctctgtaaaacagtgaagaaaatctttccacttttcatgaaggaggtgtgcagatgaaatgacataatgcaaataaaggagctagcacactgcctgacatctgataaatcctcaataagttttaggaaaacaacaatgtaacacaactgacaagaatttggacagagtgggtatgtccattgaactttttttttgtctttcctctatgagaagtttgccatctcatcatggggtcatattaatttctctaactatattgttagctatagcctttctttttgaccccaaagttagagcgtaaatatctcccactaacttgatgattaagataaggtccaggaactttttcccgtttacggtttaaaaacaaccttctgtggagatttttgatggaatgtagggatatttatgactcaggcctcctggaaaagtccttgatgctgactcattcattatcacaagaaaggaggaggcagctgaaatcaccactcatttattctgcttctaacttacggtgaaaggtcaaaggtaagtcactccacatagggctgagtatgagaataagaatttcaataacttcttttgaccacaagagaaaacagcatttctaatgcacatacattgataaaaatttttgcaaggacctctttaatacaagtgctatagcactgataaatgataatatttagtctgaagcctcaggcttccagctaccaatacacagaaactacggtttttccacagagcaagtgaaaaccaatgggaggatggacaaaaatagaaaggaggcatgatttggaatttccacagtgactatggccttgaaatcaggaacaaagggcaatcttgcagaggtataagaggaaatataaaaggttttgtagaacaaacctggaagtgaattccagttgaaaccatgctcatggtaaaacatatttttaccacaaacaataacagcattaatagcactgtcaccatcagactataataggcaacaaatacaacatcaataaaatttattgtatgtaaaaagcttaggaatatgcaaatcaatagaagaggaatactactaagtaacaagtatttgagtactttgtgtcaagtgctcagctacaaactctaaatgattttttcatttactcctcaaatagcactatgagattgactccacctccatatagactgtagctggggcactccaggcttatagatgttatacaacttgttcaagaccacacagttaatgaaggaggctgattctaaagcccatcttctgctattgctgcttcagcaaagttgtgttgaaaacaatgctatctattggccataaattactgatacacactcacggcaaaaattatttttacatatttaacattattcttggctctagatacaggatataggggagaatatgggccgaatttggacttctaggtcaccatgaactctcagcatcacttcctttacaaatgtaaatcagtgggaggtgctgttcccgcaatctggttactcatattcttccctaaatatgcaagtaacccactcagtgcaagttatgtgggaacatgggataaaacttccagtatttccaaagtacagggctgggtggtcaaaaaacagtggcagtatgggactgctaaatgttatttggtgcaatgccaacataaatagttttgcaagatataaaattaattgggggtgaggggcttcttccagtttcaacacagcagataccccaacagaactacccttggcccatattttaaataaatgaataagctctctaattataaatattctaaatgagtaaatagaagactacccattaacatttggctttcagtaagaagtatgtgaactaatacaagtagacttgctaaagcttgagactagagagagaagatgacaggatactgaattcccatattaaagttgttctaagcttgggctagagctttagactaacctccctccaagtctagaattggcaaccagtttgagaaggtcataagtagatctggggcaaggaaaacaaaaccacacacagacacacacacacacaaacacacacacgtcatttatatggtagcataggctataattactatcatgggtgaattcagcttaccaggaccctactcaaggtctttgcaatatatgtgctggaaagtactgattttgtattgaatttgagtcatgacaatagcagcagcagcagtagtagtggtggtggtagtaatagtagacaataataacggcagtagtagcagtggtggtggtagtaatagtagtggtagtaataacagctaacatttattgagcatttccaggaattgttttaagtgctttacatatattacctcatagggttgttgtgaagataaaatgagttaggttttttttttttttttgagacagggttttactctgttgctgaggctggagggcagtggcatgatcacagctcactgcagccttaacttccctggctcaagcagatcctcccaccttcgcctcccaagtagctgggactacagatgcacaccaccatacctggctaatgtttttatttttttgtagagatggggcctccctacattgcccaggctggtcttgaactcccgggctcaagaattcctcctgccttggcctcccaatctgctgggattacaggtatgagcctggccattagccatttttaacagatggagaaactgtgttaaatgccctgtatacaatatctcattcagttctcataactacctatctactttattattcccactttgcaggtgaggaaactgaggcacagactggttacttatggtcctacaactcaataggttcaagaactagaattcacttccaggattgtttgatttcaaagctcatgttctgaactgctacattacagttttggtaccagtattacccctcatcctggccatattccagacaccccaccccctggccatgcttctctctcccactctgtctgtcctcgtgagactgagatgcagcatctttcaaactgagaccctctgctgtcaaattggataaaatcaatgtctacctcaaagtgctggtgtgacaaccaaatcctataacgtatagagaggatttgcctggtaccttccatataaagacctgatgatacttatgttttggaattctattagactggtgcaaaagtaattgcagattttgatggcaaaagctacaattactgttgcaccaacctaaatcatcacttttattacccgcccctttctctgccaatagcatttccttccagggatcagaaggaagctgaggatgaatttctctagaagaagtaagaaggccaagggttaatgtgtaagagatgaactgagctagatgagagggaaaggagaggtggaattgctttgaatttcattgctaggaaccgcgatcttttttattatttgtataaatcacttggctgtgaagacaccacaggccaagcctccgagtgtgccgatgataataaattgggtagcacaataaataacaggtaaaatcaggctgccaaatgaagcaggatttagatcatttaaatcccaggctatgagttgtcaaatccagtttaatactgataagtgtgggataataacttttagcaaacagtcccctcccaccaaaaccccccccacaatccttctactctcttctcccaccccttgcaaacagacagagaaccctgaggggatttgcagaatgaaaaggcatggtatatactgaccagatatgagtccaagttattacataataatcccagagcctcagcttgggctgagagcaaataggaagagctaatagaatgctgcaaggttcgattagctgcaaaggagattctaaatcagagcaggttttatatgattaaattggatgggggaaaaaaagagtctcacactcaggtataatggaaaagtggaaaggataagggaaatataaaaccatggacgttgctggaatggctatggagtggcctgagggtagagtcaacgctgagggacacttgtcaaaacaagagacaacttagccagcagttctcagtagctgtgactgttcttacaagactcacacccacattcagagatatagcagcaggatcctacctgatgacactggaatttcaggaataaagagtcatctattgcttgatttgatgatgataacctatttcattcattcaacaagtatttattgaataccaaatatgtggtgggcattattatttatgattgcataaaatagactgtgatggtgactgatttagtttggctgtgtccccacccaaatctcatcttgaattgtagttcccataatccccacgtgttatgggagggaccaggtggagataattgaatcatgggagcagtttcccccatcctgttcttatgagagtgagttagttctcatgagatctgatggtttcataagcagcttttcccttcactgggcacacattattctccttcctgcctccatgtgaagaaggatgtgtttgcttccccttttgacacgattttaagtttcctgaggcctccccagccatactgaactgtgagtcaattaaacctctttcctttataagttacccattcttgggtatgtctttattagcagcgtgagaacagactaatacagtgacaataactaacaactgagcgttatgccctgccacatattttacatgcatttgctccttcagtcatcacagaaatcttatgatctagttgttattattaccatcattttaaaaatgagtaaactgaggcccggagagataactaacttgctccagatcgtgcaggaagaaatgatgctgacatccaaacctcatatgtctaaagcccatctgctttaacatgcctccaaatgaagaagtgaatcatagcagccatcgtaagtcttgaggacatctctgccatcttcttcccagcccccagcaccaccccctttcctaggtgtgtacatgggtacatcccacaattggtatttgaactaaagtgaatgagaatgttctgactccggtgtaatctgttaattactattaataccaccatgagggcacaaaagcaggattgcagctttgtgttttcatccctgctcagtcattacctagtggtatacatttctggatcacctttggcatctctagttggttctttttagaacctataacatacatttactctctaacccaggactgttcaatagaaataatgtgagccatatataatttttaattttctaatggtaacatttaaaaaataaaaacaggtaaaattaatcatatatagcattttatttaactcaatttattgaaatatccttttaacatgtaatgaatacaaaatattactaagttattttactgtcttattttcatgctaagtcttcaaatcctggtgtgtatttcatacttacagcacatctcaattttgactagccacatttcaagggttcagtagctactggggacttcatactggcagagagctttagctgcactgtgaatgttcattgacttgtcctgattaggacaagtgccttctaggcatataggagctgtgccttctagtagtattttttgggtgtctacttcatgcaaagacctagagtgggcattttgatacatattatgcttcatcttgccagtagctttccaagaaaacatcgttggctccacattacagataaagagcctgaagaaagttactggaagctccaagactgtagagagtatttacttttacctctttaacacttagcacattgccttgcacagagcatgattcaacaaatatctatggaatcaatggaaggttacttgtcaaacctgcagaagagctgggatttgaatcaggtatgcctgattttaaagcttgtactttttgatccattccgcttttttttgccacattagtaatatactaatttgcccctaagtaatatacagtgaagaataaacaatgcttatttagtatataagcctttcatcccagtgaaaaaatttataaatgggaaactccagtcaggtgttatatttatggtgggtgtcacggtcttctttgagtgtatttggtttaacaaatgttgttggaggccaggtgtggtggctcacacctgtagtcccagctacttgggatgctgaggtgggaggatcacttgagcccaggaggtggacattgcagtgagctgagatcacgccactgcactccagcctgggtgacagagtgagaccctgtctcaaaaaacaaaacaaaacaaaaaaaacgttgttagaaacctactcagacctggggactatgttcgaccttgaaggtacaaagaccatcaacacatgattgtcactctcagtgtggtttggaagatatgccatagagtgtttagtacagttaggtgatataaaaaatcttagcttcgggctgggcgcggtggctcacaactgtaatcccagcactttgggaggctgaggcgggcggatcacgaggtcaggagatcgagaccatcgtggctaacacagtgaaaccccgtctctactaaatatacaaaaaattagccgggcgtgatggcgggtgcctgtagtcccagctactcgggaggctgaggcaggagaacggcatgaacttgggaggcggagcttgcagtgagccgagatcatgccactgcactccagcctgggcgacaaagtgagactcagtctcaaaaaaaaaaaaaaaaaaaaaatcttagcttcacagaaaaactagttggaagtgactttaaacgtcatcttattttattcataatttggtactaaattacatactagcaagatttcacctggggaactcttgtattcccaacagtaggttcttgaaaggagggagaaatacatctttactccccaaagtattttgcacagtgttaagcaaatgacggttgaacaactcctagttaactgccctcagctctctgtctccttctgtgtgtaccaaggaaccaagagtcagattcctcatgggcagagagcaccttggtcagatgtcgttaaagttctaattatagaccatacttctcagggaggatataggtagagttctttattctagcttatactagagaacaataaaactaattatactgagggttttttaatcagattaattcataaattaattcaaatatttattaactattagtcattagttggtgtgactagaactgtgaatatgatagtccctgccattgaggatattactgtctggtgagggacacagactaatgaagacacatacattgtaatataatgcaataggaattaagataaggataacatctaagaagtgcacctattttttttttaagagacaggatctcactgtgttgcccaggctggagtgtagtggtgtgatcacggctcacagcagccttgacctcctgagctcaagtgatcccccatcccccgaacctcttgagtagctaggactacaggtatacaccactgcacccaaatagtttttatttatgtaaagacagggtctcaactatgttgcccaagctggtctggaacactggggttcaaacaatcctcttgccttggcctcccaaagtgctgggattacaagtgtgagccactgtacttgggaagaagtgcatctaaatggaatttagagaaattaggggaagcatcgtggagaaagcattccaaacccagtgttaaaagacaaatgagagtcagcctggccaaagggcaaaggatggggaggaaagaatgccaggggtgggggacaactcatatgaagactcatagaacatggtacatttggggaccaacagagatttcaatgagacggaagcatggagtgccagggctgggcaaaggaaggacacatgttcagaatatattagagaagtaaacttgaggttcatgaggaaggtctttgtgcatgataggaagaggatgcatcaaagattttaaggaaagaagctacgattataatttaagcacattttactctagccctgctgtgtttcatgtacttctcacattccatgatcactatttatccatctgcttccatttctatcctgagatccttaaaacaagggctcctatgtttctctttgtatcaccagtaccccaatgcagtgtctgctacatacttgatgcttaatacttattttaatgaataatgtctgtgggaatcctttgtagatttgagggaactcagtctgctgaggacatactaccagggagtatccttaacctagattccttggacctcttgaaaatacttggaaaaatgtgggtgcgaatatgtgcattggttttaggagtgagatattatcattttcatcagattctcaaaggaacctaagacctcacaatgattgcaaagcacaataaatggggatccttgggaaatgtagtttgggagccctctctagctagaaaagacttctcagaggtgaaatgctaaatggtggttctcaccaaaggtagaaaaatgaataggtgaaatgttgatgtgacctaactttttccaagtgaaagaggtgtacaagtgataaaagagaacagctctgtggtgacaagataatgtttgcaagaaaagagaaaagaatcttggagatgatgggcaatttcccttatgtctcctaagttactaagagcacctgatagttaacccagtctttaaagaagagtgctccaggtagaggtgtaaataaggagctttgaaaccaccatgggaagaggctgttgtaaatgaagggctcttggagtcagagaactcaaagaaaaagttgttacctctggaagaaaaaggtcttatggaagctacctccctctttcttttccacaaatttggatctgccaaattaatattttaaaatgagatcacacacacacacacacacacacacacacacacacacacacacacacacagataaaagttcttgatggatgccattaaaatatatagggtaattccatctcagtgctgaaaacctgatgatttttactcacactgtctgattattttttcacaatgagcatattttttcacagatgaacatgaaaaaaaattccattttgaaaaaatgatggtaggataataatgcaaaaattagtgttctaaaagaaagaagatcataggagggcagagtgctgctcaaagtgtgtctcataggccatgaagctcacaatcaccaaaggaacacattaaaaatgcagattccatcccagctactcaggagactgaggcaggagaatcacttgaacccgggaggcggaggtggcagtgagctgagatcgtgccaccgcactctagccaagcgacagagcaagactccgtctcaaaaaaaaaaaaaaatgcagatttttgggtcccaccccagttctactgaatcagattctttaggaatggggatctaggcatccgcaatttgaaaaattccccaggtaattcctatgcttatcacagagattttgaaaaaacctagttgataaggatggagcacatgcagtaaggaaggttcttgtctagcaggcaacccccctttctccatgtacatatgtgccttggacactaagagagtacaggacagagatgagcttaatacagtgtcttaacctaatgaaactgatttttttcaccttctaaaacattttcttatacattaaaaatgtacttataatctgaagttggacatgttggtgtcaggggaaggtataaattatgaactgacagtgctgcatattcataaaaatcccgcctttctaggagtggagggtgaaacactcccggtgtccttgtagatggcatgcttcttggacacctaaggatttttctactctctcacccctctacagggcaaatgggaatccatagctaggggtataatacgaagggcgaccgcctctcgggacgtggggacagaactcagagctccgagaatcatgccatctcaagaaggactgcgtcaccacctgtcaggtttgtgagagctgccactcctgcctgtgctgggaggccagattctgatactgacagtacacaattttaggccacataacttttaatgtagtctatcatgtcatatttgatacatccttgaatgtcatcctaaattatttttgaagcagagtacagtaaaaatattctggttcaacaagtctgttttgacagatcgatattagcctagtatccaaatataaacaggtgaactgaatgctgtttctatgcctttaggtaagaaattatatttgtgtttgtgtaggaagactcgtctgggtcttgggattttcttaatcgagcccattagactatcttcttgtaattatctcaggggccaatctgtctgtgtaatgggctctggaggaatcaaaccttcacgttcttacaaaggaaaatgttatgtatgtgtcagaaaaaaatgttttgaagaattactggctaaccatctcaacagccgccggggggaactttgctgtgatactgcaggaaattgttggatttgagactatattgctccaaagggtatttctttttttgtgggctttttaataaatctaaaatgcgcatgaagcctctgatgcaggggactccacaccaactgcctccttactgtatgaaaggataccaaaatcttaccgttggagagactgccaacactctggatggctagggtttaactaatgactagctatgctgcttcactgaattgggctggccagttgttctggatccttttacctgaaacattaatgtctgaatatggtggctatgtccaacagttcattattacttgaagatattcacactatgcattgatattctgatttcttcacctccctacttttttctgtttttgcgaatttttaattctctgcagggtagagaatagatttatagtataaaggaaactatgaaaagctaagaaataatgaagatataataataaatgataataattattatgggttgaattgtgccctcccaaaatttatatgaagttttaacccccaatatctcggaatgtgactttatttggaaataagagtcattgcagaagtagttgcgatgaggtcattagggtgggtcctaattcaatatgactagtgtccttataaaaaggggaaactgaaacacagagatgggtatgcacacagggagaatagcacatgaaggcgatgaaggcgaaggcagagatggggtgatgcatctgcaagccaaggactgccaaaaattgcctaaagaccacaggaggctaggagaggggcctggaactgtttctctgtcatagccttagaaggaagtaactttgccaacaccttgatcttggacttttagcctccagaactgtgagacagtacagttctgttatttacaccacccactttgtggtactttgctatggcagccctagcaaactaatatagtaatacacaaaccaggtcctatggtaagcactttgcttatatcattttactctcttaacaacagccttttggtctgaagattgtcataaacgattgatgggtggaatggctgggtgggtggaggaagaattctttttcttcccttttcaccattcaaataggatttttcaacatatgctggactgaaaggacttgggcagtgatgctggatttatatattcccttcatgtgtgacttcaccagaaatttataaaactatcatgcgaggctaaaggaaggcatcatattcagcactcccttcacttgtggtacataaaagatattctttacaaaagaaggaaaaggtgaggtggctgctactcacctaatgagaaggaattgggattaaatttagcttagtgactctgatggcaatttttacttctggactaaatgttatgaccttctccatccccacgtctaatccagttcaaattccttgagcactaaggctctatatgctttaattttattattattatttccctttcagattcagtttaaaacttatttcatttcccttcctgtcaagtttattttccccaagcttcctttggaataggccctttgcagtataagaaagaaaacaggcactaaactctaaaggagaaactgttacaccaagtcgtaagctaaaatgtgcctcaaatatggccacaaaattattgagcaaatattgctgccaatcaatctgcctccatagtgggtggtttacagccagggttaccaagattaaaactaggaccaatgatgtgcaaaagtgggcccaactgaccttattgattatttcccactgagagagaatcacaggttagcaggcagaaatcaattcaactgcattaagttaagccaagtgtagatttattcataccatgcctggaaattataaagtggcaaaaaatatttaactatacgtagtatacatactaacttacaaatatatctttaaagtacatagatgcttgctccttcctccttttcataatatttaaaaatctgaaataaaatatagaacataaggctgttcctgcatttcctcccacaccatcccctgcccccacccttttaaataaaagaggttatttgtgaatgctcttaacatggctacttcagccacaccccagatttcaggatggagtggcagagcagatacagatatgtctccgcagccaaagaagcaatgaaagctatttgctcttgaggaaatcatcatttttggctttttagatgaaaggaacttggcccttaggcttcagtgcaccatggggaacacagaattcattctctttcctcctccagtgacaacacacaggctgggactgaagagagctttcagaatgaacaatgggtggaaaacactgcccttccagcagtgagaaatgtgaaattccactcctaccctcacatgtgtcaccagggaaccatcctgtgtgctccatcagcactgggatatgagccaggcaatcatttgtactcagggactcagccttaacctaaaaaatcatcagaagagcctaagaagggttcctcctcattcctcatatctgagaaacaaagaacaacacattttactgcaagaaattgtttgtggatcttattgagaatagcttagagcttgcttttcctttaagcaggctatctacttcttattctgcctagccagctaagatatttatctcctactttcatggtcattcacagccacccagaactttcaaatgcattgctcagggcctctgggggtggcctgtaaaccaacaaaaatacttttatcaaacacaccatagagatcaggcagttaagagaccaagagtcaaatttatattcagtttagaatataaattgtccattcccagttcaatgggaaaatagataattgaccaaaaccctttagttgctcaaagctgggcactgtggcaatagaagaaacctgtgtctttgcagctcagtgtcagttgtcttgactcattttcccccaactctaaaacgtgcagagaaagacagagagagagagagagagagagagagagagagagagagagagagagaaagagactataagcatggaatgatgtgaagaacactgggtcagccagtgggcctgagttcttaccctagttctaccacttggtaaccctgtgcccttgaacaagctctcaactctaaaatgtggcaggatttcaatcaatattccaagattttgagatttttggccataaaaatgggatctaaagaagatctgatttgcagggttgttatggaagatctagaaagaaaataaatatatcagcattttgtcagctgttaagtgaaagacgaatgttagttattgtcatagggataagagaaaaatctttaagaacttactatgagcagcctggcacaattattagagtcctctagattggtaagtcactgaatctctttgaacttcagtttccccacataaactgcttgccttctggcatgaagagaaaatgaggtaaagaaagtatgctttaaaatgataaattgtcggccaggtgtggtggtggctcacgcctgtaatctcagcactttgggaggccaaggtgggtggatcacaaggtcaggagatcaagagcagcctggacaacatggtgaaatcccatttctactaaaaatacaaaaatcagccaggcatggtggtgcatgcctatagtcccagctacttgggaggctgaggcaggagaattgcttgaacccaggaggcggaggctgcagtgagccaagattgtgccactgcactccagcctgggcgacagagagagacttggtctcaaagaaaaaaaaaaaaagataaattgtcctagaaatgcaagcaattgttatctagagaactcattttgacttttggcattatgatgcacacacagttagttcttggctcaatgacagactttaattggcttggctatgaaaaccttatagcgctattatgtgctacacctgtgatggccatgcagcgtgttaatcaagacaattaggctggggacccagagaacggctttccaccactgtgcataatcctcctcactttgaaagggaaattaactgctgctttatggtctctcatattatctcactttcttggagagagatcccaatcagatccaccttgactaaacaacacctatcactggcgcatgggatgacacaacatctgtattaactttgactttgaaacagcttttggactgggagtttaaaaaaaaaaagtcatatgtagcaatcattagacaaagcagccactgggtgacagccagaatcagaggccagaaagttgatctctttcaagtgacatattccagaggagaaaggaacaggaggatgagcagatcaatttagctctcaaagtatttattctctagcctgcaaaaggagaacagggcttccaggacgactctgtctgctcctcaatttctcactacaattataaaatcttttggaattttcttccttgcgctacccctgctatccccatttcttctaagaagcatgagaagtatattttgttgtttggatttctttcactcttgggcaaagctgcttgaactgataattagtgattttaaaaagcagcacatctaaatggtggctattcattaatcataacattctgagtttacatgcatttatcttattaaatgctgtgagataaaagtgctgtagggatatttaaactcccattatgcagataccaaaactgaggctcaggaaggccaacctaacaagttcatatggcgagtccgaattttcattcgggtctcttggctccaaggcttttctataacatcgtgctgcatatcatctgtggaggaagcattattcaagggctaaggactaggctcaatttatttctgtggctccagtacctacaacagtgcttgtcaccttctaggtgcttaatgtggaattaaattttaagaggagcttcccaaattgcttaatatctttagaataccaggaaaaaaaaggtccagtaccccattcctaatcatcctctgctatcgctgagtcagaaaaaatggctcttgtctcccaatggtaggcagtttagctgtgagaccatcctggggacatgggtgtagatagaagcagatggatcatgacaactggaaagatcccagtagagcagctttgggccttagtctactttgctttgctctggaagaggccaaaatgaactgttcaacctataattcccaatttatgcaccaaagcactccagggcatcatggcatactcacagggatgctgcaggatattttaaattttgagtgaacaatagtgatattaaacctctgtcagataatgtgagaatgaatagcatgagggaacttaccacttcaacattagtacatagtatattccccttaattacaaagtatttttgcaaagctggagttttggtagttaatataattaaaaacaagcactgcatcaaaatcaatgtggagcagataatgaaggtgacagtattcaatctgattccaaggtttgggaagtggtacagactattagggacacataattccattgtaagcaattgtagttaagaatgaaataaaattatttcttcaatttatgttactatgtttcaaacagttactacattgttagtgcaaacacacttattaagtagtttgaacctaactacttagtaaacagaacagttgtgaatttttttttggcccaagaacagcatgaaaaaaattaggacgatacgaagggtgatatgaactgaggtacttggggaacctctgttctacacaaagcatggtttaacccgagatgttccagggctgaacctgcctctggattctctatgtggtacagtgacagccacaaaagcagctcccatctactgagctcttggccaaacataggcaagctcttaagcattgtaactgcatgacctcatttaatctccagagcactgtgagcatgggtcttttatgatccccatttaaccgatgagtaacctgaggccccaagaggctgcccatggtcatttagctagtaagtggcgtagcaggaatttaaacccatggctggttgatttccaaagcttgtacttttttttttagaaaaattaagcttttaattttgagattcacatgcaattgtaagaaataatagagagttactatggaacattcacccagttccccccatcacaatggtaacattttgcaaaactataggactatatcacagccaggatctgacattgatacagtggagatacagacaatttccatcactataaaaatctctcctgttgccctttcatagccacaccagtttccctccagtccccatcctttccttatcccctggcaaccattaatctgttctccatttctacaacattcttgaaatgatgaaatcataaaaatggagaacagattagtggtcacctggggttaagaagaggtacatccagtagtacataagcttttggaattggcttttttttccctcaatattttctggagatgcattcagattgttgattgtatcaatagctcattcctttttaattgctgaatagtattccatggtatggacgtaccacagtttgatgtgctgttcacacatctaagaacatctgggttgtttccagttttttggtaattatgaataatgctgctataaacattgtgtacaggtttgtatataggtttttgtgtgcacatacattttttttatttttcaaagacaaatacccagaggtgcaattcttgggtcatatggtattatagtttcatgtttaggtttttaagaaattgccaagttgttttccagaattttttccctagaatattcagaaggtacattttacattcctatcaaaaatatatgaatgatggactttctctgcattccagcacttgtattgctaccatttcattttagccactgtgatagatatgtatctcattgtgctttaatttgcatttccttaatggctgatagtgttaaacatcatttgctgtgcttattggtcatctgtctatcgtctttggtgaaatatctcaggtcttttgcccattttctaattgcatttttttaatgctgttttgagagttctttatatattttggtaactagtctttgtccgacatgtggttttcaaatattttcttccggcctgtagtttgtcatttaatcctctaaacagaatctttggctgagcaaatgttttaattgtgatgaggttcaatttatggacagtgcatttagcataagaactctttgcctagcctagatcacagtgcatgtagcataagaactctttgcttagcctagatcacagtgcatgtagcataagaactctttgcttagccttgatcacagtgcatatagcataagaactctttgcttagcctagatcctgaagatttcctttttttcttttcttttcttttttttttttttttttttcgagatggagtctcagtctgtcgcccaggctggagtgcagtggcttactgcaagctccgcctcccaggttcacgccattgtcctgcctcagcctcccgagtagctgggactacaggcgcctgccaccatgcccggctaattttttgtatttttagtagagacggggtttcaccgtgttagccaggatggtctcgatctcctgacctcgtgatctgcctgccttggcctcccaaagtgttgggattacaggcgtgagccactgcgcctggccaatttccttttttttctaagaattttatagcttcacattttatatctaagtctgtgatccattttgagttcattaagattaggttgagattaattttgtgcctatgggagttcaattgcaccagtgccatttattgaaaggctgtctttcctccgttgaattgcttttgcaattttgtaaaaaacaaacaaacaaactgagttgaacatatttgtgtgggtttgtttttggattctttattctgttcattgatctatgcctctatctgtctgttaatgttacacagtctttcatactatagccatataataaatcttaaaatcaaggagactgattcttcccagtttattattcttttaaaaatgatttttagctattttggttcctttggttttccatatacattttagaataatcagatctgtatttataaaaatcttggtgggattttgatagcaatcacattaaacctatatatcaatttgggaagaattaacatctttgcctcgttgggtagacaagtcctatgcctttataaacacttttttattttaggacgaactagggtaacaaattcagttgctcaaaagaggccgcatgtatcaggtttaagaacatgcaggcttcttgtgatagtagattggatacagaatatttctgtactgtaagaaaacaataactcaatcagatgttaaatgaccaggaacacttgagctcagcattagaaacataataaggaatggtggggattgtggcttgctggaggaaagccatgtcccctatgaatggagcagttgctacccaagtcttctcatggttaagaacatgggcacagcattgctatggcttatatattttcaacataagccagaaatctattttttaaaaaacctaaaatgttggcacctactttgaattaacataaaataaaacagttcaaatacacacgttggtacgctggatccagcagcctctctgtggtctcagaattagagacaacaaagaaggtccccaccctcagggaacatacactccagctggagcagcagagagacaccacaaagcagcactgttctgctctcaacagtaggagctgaagagcatgcagggggatcctgaactctgccctgggaggtcagggatggctccccaaagaagtggatttacacagcaactccaaggagagacatttggaaccaagctgtaagcacattaggaaagagtaagggatactttccagagaatccaaatcgtggcatgaggtactcttgagaaggttaattcagttgatgattcaacatgtgctatttaatccattgcctccagagcaaacattgataggattaaataacagtgcagagctctacttccgggcatcacagaacatagcggggaagaggtcatagagttcagtgtttctccaagtgttatgtcacctgttgggaattgcaaagctaaagctttccagaggtgaacagttttctgatgctcttggaagaaaatcagagccccttctaattactcacaaggacctatgtggtctggcccctgcctgcctctttagcctcctcttctctccttattcctgtcttctttctgtctttgcagcatatcatgactcaaggcctttgcattttgtcattctttcatttattcttctgtttattcaagaactgttgattgaatagaaataaatattctaggtattgggaatacaacagtgaacaaagtcaactcagttcttaccctcatggagtttacattctaatggaggaggaagacacacatagataatatcctgccttgtgtgatgagttctatgaagaaatattaaacagagttaagtcatagggaataatggtgattgcccccagagggtgggggcaggtcttctggtgaacatatgagaagaacttgaatgaagtgatggagcacaacacaaaagcacatgggcttttccagaaagagaaaactacaagtgcaaagagcctgacgcaggagcacatttggcctatttgtgggtagcaagaaggggagtgtgctagggcagaagagtggcaggaaatgggggtagggaggaggccagatcatgtgaaactgcaggccttggttagcactgtggcttttaccctcagtgtaaggaggagccacagagacatgatttgacttacagagaacagatggtggatagaaatctgttacaagtttattagaaaagtccaagtgagagatggtggcagcttggactagtgtggtagcagtgagggtggggagaggctgatcagcttgagacgctgtcaaggtagagatactgtagggttgccttgcacttgccttggagtatgagaggaaggagtcaaggatgactccaggggttttgttctgagtgatacatttattgagatgaaaaaaagcagtgcctgtaacatcacaatgttggctccttatcatgattcaggtctccatcgaatgtcttctctttggagacatcttccctgaccacccctcatcctatcagtgctgctcattttatttctcagaacttaacacatatctgaaattatcttattcattttatttgactcatttatcatccggattccccactgaaatgcaagacctaagagaataagtgccatgtctgcttagtttattgcaatatctttagtacctaattcagtgcctggatcttgaaataagatcagtaaaagtttgctgaatgaggtttgcaatgtgtgagataagttaagtccccaggtttttggggtgtgtgtgtgtagttcttttcagagcaatcagttaatggattaaatagtattgattatctgtggcaggcactgtgccaggctctgggaaaacaaaaatgagcagaaaaaaagcattgcctgcagcctcatggagcttccagcagcctggcagagccatagtaaataatctcaccaacagactttcactgtgctaaaaactctgaaggaaagacacatggaggtatgaaagtgtattatctggggatctgatcacttcggggaacacaggtgaaacttctctgagctgagatccacaggagaagccactgtgggcctcagggatctctgagaagcatagatgctgtggctatgacttcaaatttttcatggagcttcttgtggaaagaaacacattttggcaaaagcagaactagtacaaccttctcaagcactggggcttagctgggttcagaacctggataagatgagcagctgctccatgacagaactagggttttgtatttatcatgacacatgtgggtaaaaagggaatgctacctacttaacagggctgctatgagaaggaaaagttattgtccatgaaatgcttagcacagtgtctggtacacaagaagtgcaaaatacttggtaataattatcatcagacttcaaatttgtgagggtataatgtgaatactctcccacacacagagaatagacagtatagaaccttacacagagcaggacctcaataagtttgtattgaataaataagtgctggttgccttggtgacacaccattttgaatctgaccaaacattttcaccaaagatggacacagtaaataagtagaaatgaactaggccagttccttttgtcagctgtctcaggactggtagctgacattaattattgatattacagggagggagattcttgccagccaaggacacttggcagcttgaatgtaaggaattcggtctgatgctcggttttaaactaaagataagtgagaagtgggaggacccagaggattcgatgattttatgcatcaataatacttgccataggaaggctcagccagagtccgggaatagctgctactgaaatggcattttccttttcattgaaatccacatgcttgatttgtgcatgtgacttctcagctgctaccataatagaggaagtggttttgaattaacactaatcaacctgaatctccaggggcaacttgtacctgaaaacctccaagtcctttgtaaacagcagttaagcttccctgtctcctgagggatgagcttctggatttttgcttaaatcaagcagaattgtaggaaagaggttgcaattatgagcaaagtgggtgtcagacaggataatttctcatcataaatccaggcttgaaaagggccaaaaataatctgaaagtccccaagatattttgcccaccaaagttctgccacaagcccccgccacgtgtcagatgaaggatgattggaaattacaacagccgttctggagggcaatttagccataactgttataataagcagacccttcaactcagcaattctgcatcaatgcatttttactagagaaatcctggcacatgtgctgaggagtaagcaagtacccccattgctgtgtcatctgcagaagtgaaagtctgggagcgatctcgaggtgtactcatcaggaggagaatgattaaataggtagtggaatagcatgcagcaactaaagagaatgaagttgacccccatgtattgtcatggaaaactaagattgttaagcgaaaaaagcaaatttgcagaagcatatgtgcactatgccatatgtagtggttttaaaatacatacagaagttcttcgatactctttcccttatgagatgcagcttaattcgcctccacttgagtttgggccagacttagtaattcatttctagtggacagaatatggcataaatgacaaggtgccacttccaagactaggtaataaaaaggtattgtggcttccttcttgatctctctctttcattcttttactctcccatcactcactctagaggatgccaactactgtgttttaaggacactccaggaaccctgtggagaagcccatgtggcagcctcctgtcaatagccagtgatggacagaagactccaggcaacagctgtgttggtgagccatgatggaagcacttcctccagtcccagtcaagcttccaaatgactgtagtcctggcttagaccctgactacaacttcaggagagatcatgaactagaaccccccagagcttagtgcccttggattgctcactctcagaaagtgtgagagatagtaaatatttgttatttcaagtcactgttcatggcagcaattgacaacaatacaccgtttatataaacataaatttttaaataacttaacaatacacacatggagacaaatgtttagagaaaggtttggcaggagatgtgccatagtgatgaaggggttacctctgagaagtggagaggagagggatggagggtggggataagattagcttcacctgttgtgtctctatttttgttatacatgcattcatacatgcattactgacataattttagaaagcactaaaagggaagaaatacaatgtaaaattctactactttggaatttcatggcaagtcagataaagctgaggtttacctttgatcaccttcaagtaaaagggttgcttagcaaactcatttaataataaacaaggttatcagcggagctctccaacctacttaagaaagccaactcctgtcagttactcttaaaaatcaccttagcataagtcatatataataaatgatcatttttactcatgtttcttatctattattaaagcaggtcaaagagacctttctttggacaacaccaattggcaatatttgtattcccaaagagcatccaaattattttgaaaatgacaaagataagctctactgaaaaagccaagttatatattaatgcactgtggtttcatcaaatggtttaaaatcaaagaggttttgttgtcaggtaaggttatggaaaaggtattttaaaagtaaactttgtattggatttcttttaggcttgtgctaatttgtttttcaacttcgagcctgggggtctgcatcatttaatagcagttccaaggcaaggaccctgatcctcgtctgtggctagactggctgcaggcaccaaagcttatgcattttcagtggaattgggtccagagcttagctgcaaaatgccttctgggtgactgaccagaaattcaatcacagcacattcatttcaaaaatccctttcatgtatcatttaaaagcagcctgcatacttacatttgcatatctctgaccctggattttggaaatgcaggagaagaatggattgctgtttaattttcaggatgatgggaaggaacaaaccagaggcatttccttctcttgactactgagtagatttagtacttctgaaagattctgaatcagtagttttgtaacataagccgctgttccatagagcttgggaataagaataactaacatttatagggcattttataccctacaaagtgggttaccattcattgcctcatttaatgggcagaggggctcttaattatcctttctgatgaggggacaatgattctttcaatcccagcatctgcagagattactctggttttcctttcatatggacacactaaagaaataatgatactgcatgctagcttcctcagcctgggaaagaatacactacggcagatgtgaggtttcttcattttccccatgctgcagtgtgtattccaagtttctttcgattaactgaaaagtatatgtgaatcttttctgcaggaagacaggaaagttaaaaggtagcctctgggatgcctgggtttgaatcctagctctgtcattttctggctgcaaagtcttaagcaaattatttttctgttagatatttaaaaccctttaacttatcagttttcttatctgaaaaatggggctgataataatagtaccagcatcacatggtttccatgagaattaaatgagtgaattcatgtcgtgtacttaaaagaatgcctgatgcatagtcaacattcagtgactgttgtttgtatgtgcagtgagctgcattttaggctggatgggtaacaaggcacatccaccattcattcaattactgcacagctctctgccaggcaggctgaagctccaaggatatgtcaaatgtggttcctctccttgcaacacttacattctggtggaggaggcagacaaattaagattaaggagggtagacaatggagagtggagctagagaatgaagctctgagtgagagtggggttttcttgtttttaggatgtgaaaggccagcctttcaaaacacatggggaagaacagtcctggtggagggaagatcaggagtgagggcttgaaggaggagagagcatggcaagtgtgaggaactgacaggcaatggaattgggggctgagtggagagggagggaggtaggcaggttgcccaggccatggtggaatgtgacagttttgtgctgtgtacaaagggaagccacagaaggtttagaagtagagcgggaacatggttttatataaatttatgacatttagtgaaaactttatataatggtatcacatataaatatctattgcatacacatatttaaagatagtactggctgccatgtagggtgaggattgtggaacggagggaccacagtaggaacacaaaaatagaagaaagagacacataccagcagagaactacaactgctttggagtttaaaggaaaatgggtggaaggcgagagatggaagccccatttgaggtgactttgaagaggacattgttttggacatgcaggggtgtctggaaaacatagatggcctcactagttgctatgtgtcttgcacagaggacataggggtcttccctggagtgtcccaaatttaatatatggatctctgaaatctgtacaaacatgcgatatgggggaaggaaagaatacaagaatattgcttgtatcccaaatcacactggtacttagactatcctgtggaaccaaactgcaagaaagttccagaaataaccagtgacttgatctgcatccaagtggaaccctttgccctgacatcaccttggcttttgaaggccaagaaaacctacagggtttaaacttccattttccacaaagctttgaggccaagcggaactcttccatgcaccttgaaggcttggtcgcctgaaatgaagctgagtagacataaggagatgtccaaaggaaaacaaccaaggaaggacatgaaacctctcagctactcagacctgtccagatatggagcttggcattgtgatgctattcctcagttgattttgctcacattatggttctgtttatgtgatattctttgtgacaggccaccccttcctctcaacattaacatcagtgatgtctgctttctctggagttactcatacaagcattctccttggcttagagatttacaaatgatagataaccaaaatttcaatgattgccccaaaggctcaatctgtagcagcaaaagcaacaggtgaactagcaccagaggagctaggtttcagtctcagctctaccatgaaacagctttgtgatctggggcaagaaccctcattctttgaatttctctttcctcttggctaaaagttaccaacattacctcaaaggcttgttatgaggattcattatgacatctgtccaagtattttattaaattaataaaatacaaatacggcactatcatgatgaaataacagcaaatgtttacatgacatttaaaaatatttaaatattttcacgagctatatttcattagccaattcactaatgaatgagttccccattaagttggctccatgagacgccacaaactttgtctgatttttccccatcctgaatccttagcatctaaagaagtaccagtacctagtaggagcttaatacctacgggtcaaatgaaagaaaggaagaatgaacagaaaccactctggggaatggaaggacactggtttgcagaagacagagaatatcttctgtaggtcataggaataatcctgagcaacagaaaaatttagttatcctacaaactaaaatttcacagctacatttatgatagcacaggccctaatcctgtctctacagacccctaggtttttttacttccaatccctgccctctcttacatggaattttttttttcccaaatggaattaaaacctaatactttcctaatgcagtctttcagttctcttcttaagccatctgctcttttatctacaaaaacttacttattttatttgaaaacttttaattagatgcttccaggcagtggctgagttaagtttagaagcttcaagcttgtctcatactcagcagctgcagtaaggaaataaggcttatgatttaaattcattattatctccatgttgatgtcatttttctcccttgctattgcattgttccaggaagttacataaggcttaagaaccaccagactaataatattgcttcttagaaatgacctttcagggaattttccttatgtgatcagatgctggtaaagctatgataataagtaatatacttcccctctacctcaccttttatctgaagattactgaaagctttgcaaacattaattaagccaacctcataacactcagggaaaaaggaattatccatcgcagaaaactaaaactgagtttaaaggcacattactgacatgtttagagtcagccaatcagcaacagaattctgattgttctgtccccaccttcacccccacctcccctgtgggcttaagaaactcttacttatcctccaagactctgctcaggcatcacctctagaaagctctccttgcctccaccttccaagttgaattaggtgcatcccttcctgttgcactctcaacatcctctgcaggtatcttcatctatacacaccctattcttcataataacatatattaatgaagtgtccatatgggtgggtctgactggcaaatccatttcttccctttttttttttttcatttgtgacggagggtataagaacaggaagtgctggtatcataattattttgaatctatattaatttatataaaagagcaaaacatttgtcaactccagtgctttagttgttgttagtagttattgtgatgtcttacagttatatgatgtgccaatagtgtattacaatatcatatttgtgccttcccatcctatgacacaactctgaagacagtgagagcatctgataatcttaaataacttttgggtaacaagaaaggtgtgtttgtttagaagctaaatctgcttcctatattatgtaaaaattaaatgataattgcatacaaagcatttagcacagcatgtaacacacagtaaacacgaataaattcagctgttgtgtaataacatcaataattactatttattgagtgcatattatgtgttaggaactatgccaagtgctttatatgtaccctcttaatattcctggcaaccctataaggtattgctttaatctctattttgcagatgaaggaactgaagtatatggaatttttataattttcactgcatagctagtaagtagaaaattaagcttgtctgcctccagagttcagcaaactatactgcctctatttaagcaaacaagcagcatttattaagtgtctttgtggccaccatgtgctattatgggatgaaatgaactctctgctctccagcaactcatactcttgctggaaaagacaggcaagatacccaagtggaagatgtgaggtgataagactgtatgtgatgaattatcaaactaaacaatttaaagcaaatatgctctagatttaaaggaggaagagactgaggagctgcaagtcagaagagacctcagaagttaaggtgcacctggaattattagtatggtctgcatgctctgctgtgattttgtgggtgagggatgcattggaaatacctggctgaggggaggggtgctttttcaaacttcactctcacccacccttgactcgcatagttgaaaaattgctgttgaagtttaccaggggtattgaagaaaatatttgagggttgtcccatcaaaaagtgggcaaaggatatgaacagacagttctcaaagaagacatttatgcagccaaaaaacacatgaaaaaatgctcatcatcactggccatcagagaaatgcaaatcaaaaccacaatgagataccatctcacaccagttagaatagcgatcattaaaaagtcaggaaacaacaggtgctggagaggttgtggagaaataggaacacttttgcactgttggtgggactgtaaactaggtcaaccattgtggaagtcagtgtggcgattcctcagggatctagaactagaaataccatttgacccagccatcccattactggatatatacccaaaggattataaatcatgctgctataaagacacatgcacatgtatgtttattgcggcactgctcacaacagcaaagacttggaaccaacccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcacaaggacaaaaatccaaacaccacaagttttcactcataggtgggaattgaacaatgagaacacatggacacaggaaggggaacatcacacactggggactgttgtggggtgtgggaagtggggggtgcagcacaccaacatggcacatgtatacatatgtaacaaacctgcacgttgtgcacatgtaccctaaaacttaaagtatagtaataataaaatttaaaaaaaaaaaagaaaatatttgagggttgtaactgtctggattttgtagtcagattgcctgagctgaaattttggccatgtctcatttcttttttaacctcagttttctgatcaataagatggaaaataataattacagtatgaggagatgtttgtaaaacacctagcatggtgcctggtgtgtaacatgtttaatgtgtgataatttagtaatgtttccctggcttgatgagggataaaaaaagatgggactcactaatctaggatgtttgtcagatagcaaaccgcattgagctctctgcagagtgtatgtgggaatgatggcagagaagggctgtaggaggagctgacaagcactacatttccaatctgtcttgggacctaaaccttccagcctgaagacatcttagcatcttagcctgacagtatttcttaaacagctctgactccaaatggccactcaaacataatggaatgatatgatttcatacaacatgctcttgggactggtagaattcctttaatggacaaaatgttaaagaaaaaagttactgatattggctaaaacaaaagaacagtttactgcagaatatagaataatctttcatagattttaggaagcaacaataagcagttatgaacaacgtggactcaatgggaagactacacttgaattcactcacttcagcattctctgaaggcatcagtttccccatctattaaatggagaagaaaatagtaccgaaagctgcacagaaggcagttatgaggattaaatgagatagtgaatataaaacacataacacagttccaggcatacagtcagcactcagttctgttcactactctttctattcaaggtgctgtgctaagattttgggtaatagagatgaaaaatatctaagcattctcacaacagtttttagtagttatttcttacatatctacatactctttgggaacagatttctggtctaatccattctattcatctccatatatccagagtcaggcacagaacttgaagtacagtctgtgcttaacagttgtgacttgaataaataaatagggatgcacggcacccaaccatcatgcttaagaaactcataggaatgaagacaggcacctagacaagtaattataatgcagtgtaattgttgtggtcaagaggctgtggattcatagaaggcctgggcgactagcatcattgtcctggaagcaaaccagaccaagtccaggtctgccctgcttcaggctggtaggtaataaggaacatgtgtggaatatcaccaacatctgactacggtcactttgagttctctagttgagcctctgtcatttggctaatgtgccccgcacatcagtggagtgacctgtgacccgcctggctccaagagcagctctgtgagcctgttttgctagatttctgcctggagcacttggccataacaaagtggagaggagagaaatcaataacaacctgaactgaacgcacagttaaaacatcagccttcaactctggaatcacacccttgtcactggcatccaaagtgcttttgctccacgacctgctcagggtctagtaagcaaacatgaaggaggaaatggaaatagctccagggcacagacagggaaatgtgctatttgataaacgggaacccaccaagggacagcttcctagcgtataggatagaaataacgcagctggttcaaatgctggttgaggatcttccggtatgtttctcaacctctctgagcctctggtttcttgtttggaaaggatgatgatgatgataatcttacccaagagtggtatgactcttttggcaattcagtaagcattaatgcatgtgacatacccaacacacgaactgactcttggctggtgctcaataaatggtagcttattacaactgcttttctgctgctcataaggaggtaagcaagaccaaatgcagtgaaaataatttattagccacagaaataaaagctacagcaatttaggtttcccacagttctgttaaaagaatgcttaccaagcacctgtcatgtgccacctgctatgttaaggactgggacccaaaaatgagttaagacaaggacccttctttccaaaggtcttgctctgtctctcaggctggaatgcactggtgctatcatggctcactgcaactttgactttatggactcaagtgatcctactgtctcagcctcccaagtaggtgggactacaggcatgtgctaccatgcctggctaatttttatattttattttttgtagaggggggtctcactatattgcacaggctagtcttgaacttctgccctcaaactatcttcttgccttggcctcccaaagtgctgggattacaggtgtgagccactgatcctggcaacaattttaatataattattaaaaggaatttcacagaaaagagaaacgtacaggtggcagaacacacagagaggggcaaccagctcaacacagagaagatggaagctggtttgagtctgaaggacttcatggagccagccccatgacggaaagtggaaggggcactccagctgtgggctgtagggacctgagtctggaggggggtgggcaggcaccagatgacaaaagccttgtgggcccacttttgaaggaatttaccctgagaagccaggagccactgaagatttttaagtaggaacagatttacatttggatatatcactttggctttagggtggaatgaaagttattatttcgcaggagtatttagggcgctatttcttcattcctttccaactcaagcaaatacacaagtctattgcctcttctggatggctcaagtcagtaattatacaaccaaacataacttttggacccagaatcattcccctaatggataaaatgttttaagcaggcatctctcagctctcatgctccatttccccagagtccttatcccttgatcacatacttgtctacttctgctgcacctgcaagagtgagttcattactctccattatacatctccattcagtcataggcaacctcagtgggaatgtcacaggtcccaggccttttggtggctgctacagttaagataatttaagtccttctaatctcaagaggtgatcttgctagccaagagatgtctctttatggaacatctctatcccgagagagagagagagagagagagagagatacacgcacacacacacgcacacgcacacgtactctgccccatctaaaccatcctagtggatcttcctagttattgccaaaatattaagctacttgaatcatatgtcattgcagtacaattaagaatttaattatcctcaggtataaaaagagttaataaggccaataattaaactcttggtagaaaacacatagaggtttcagaagaataagtagattttgttaaaagtgtgtcatacatactattttatgacaaatgtatcttcttttttaagttccaaatcagtgaagatttcttatatgctatagaaaatgtgatatcaaattttaaaaggttgcttggaaacacagatgtaaataataactatatttcacattcatacattataagatgtagttttcatatgatatctgaatgctttcacatcccttagctagactgagcacaggaaatccacgtctaggcagtgtgtgttttcacaccttgtactagggtaattttcagagtcattaccattctggtaagaaagtttcataagggctttaacaacatatgagaaataaggaaaatctatctctttttccttattcctctgagcctcaaagttaagcctgcatttgaagaacagtgcccagaacatggaaggagcaacataaaccacatattatgagaagtggccaaaaccctttgtgttagcatctgacttattattggtaacatctaaattgccactctaaattataaatagttaaactgtgcgcaatgtgaaataatcaagaccatgctttgtttcttaacatctactacactggctcaaatacttttatccagattcttccaacatgacacacattacatttagaacttggttttctcatcagatttgtagagaagatagttaatgcatatttcacaccacaggaagtgattggggtaaacttaatatcataggagcttttggatttagacaaagaaacccattagttttctcaaacagccatcagagagactttaattaagtcaccctgacacacgtatgccttcactggatcacgatttctcatgctggtaactttcaagcccggaaaatagtcactttgggaaagtgtttagactggttgttttggacagaactttttagactctccatttattatcatctggtgattaaagaattaagatggtgatacctaaacatgttcttttaaaggaaaataagtatcattaaatcattaataattatttgaggaaaaaggagccaatggcatctcttgaaaagccctcattatactttctgtaatgtgctcctagcttaaatgcagaaagatgtctttgctaactttaacagctcatgaaaagttactgtaccacatacttagtagtctttgatgtattttgctgatgataaagaatcaaattccattcttcccacaaaaatttattccagtatttttaggtttaaaaaagatgtctgggaaaaaaaagagaaaatgtctctaaattagcatttgagatgaattaccattttccagagatatcactccctacaatattccaccccaaataaaccggaggaagaactgtggctaaatgcctaagccaggagtgagtggggagtgggaaaaggctccaggcaggtgaaaagaaccaagttaaagtctgaccaagactgaggtaaaaaacacataattccttctgataacacagcagccattattatagctagtgttgtgctcagtactttccctgagtaatttcactaatccttgtaagtacttcatgaggtgatttctattatttatactttcaaatgagaaaacaggctcagagaggttaagttctcaaagtctcacagacagcaagttcttgtcttagcttctggaacagtgaatgctaccacaacaccgtgggccctacggcaccataaaaaagcttggcagaaggtggggcacggtggctcatgtctgtaatcctagcactttgggaggccaaggcgggagaatcacttgaggtcaggagttcaagaccagcctggccaatatggtgaaaccccgtctctactaaaaatacaaaaattggccaggtgaggtggcgcatgcctgttgtcccagctacttgggaggctgaggcaggagaatcacttgaacctgggaggcagaggttgcagtgagccgagaccacaccattgcactccagcctgggcatagaagtgtctcaaaaaaaaaaaaaaaaaaaaaaaaaaaggctcagcagagacagtaacagcacagaatatcttaggtagcattagtttctccttgcatatatccagacttcactaaatgtttaggccaagaagaaaatcacaaaacaggaatacttgagaatatataaaagtggctcatatccttcaaaatttgaaccccgaggcccaccccttgtctcctgtttggggagtccaaagaattcacagacacatcagtcatttagtctgtaagcaaatttcatttaattcatactttgcctggggttagcagtccatggtcagaaatgctcctggtaccatattcctaagactgtcactgactctgcagctggttcttccgtggtatagagtgaatctttcagtaggaagtgtttctaacaagttcccatgctgctgaagccaacacaaggcaagaagctttgaaatggctgatgtttaaattatgactccaatacacacatacatacacacacacacacacacctatatatatatatttagtagacttttttagagcagttttaagttcacagaaaaattgagtacaagctatagagatttcccatacactccctgcttccacacatgcacagcctccccattatcaacaacctccaccacagtggttcatttgttgcaatcgatgaacctctgttgacacatcattatcacccaaagtccatagtttacattagggttcactcttcgcattgcacattccagggtttggacaaatgtagcatgacacgtatctaccactatagaatcatatacagtagttccaccaccctaaaaatgatctgtgcctaacctattcactcctccctctccccaaaccctggcaactgctgatcttttgactgtctctatagctttttccagagccatatattttttaaaacaattacctgaggtcctctggggaaaaatatcttattagagattcacaataagcattgtcatttgaaaggatctgaaaactctagcagttaacaattggttttcttttttttttttgaaacagggtcttactccgtcacccaggttggagtgcagtggcacactcacagctcactacagtctccacctcccaggctcaagcaatcctcccaccccagcctcccgagtagctgggactacaggtgcatgccaccatacccagctaatttttttattttttgtagagacagtgtttcgctatgttgcccaggctggtcttgaactcctgaactcaaacaatccatctgccctggactcccaaagtcccaaagagccaccatgcaagtcctaagaactggttgtaattttgttgtagccaatgcttcccaagaaattcctgggggtgaaatggttaacagttttattccctcctcttctcactatctccactgtcactccccagctcagaccaacctcatctctcactgtccactgtcatggcctccaaatctggtctctccattcacctcctgcttattttgcatcctttttcctcttaacacagagtgatctctttagaatataaactggctttccactgcattaaggtaaaatccaaacttcttcccatgatctataaggtcccataccatctgacgctgggcccacaccatctgacattgggcccacatctccaactttgactattattttcttcctcattaactgcaagtctcactggcctcctcccagctctttcctgttcctggagatttgctgtcgcatctgcctagtgtttctgagactttttacagctcttaatccttcaggtgtcagcttaactatcttatcgtcaggcaaagatttgttgttacttttttttttttttgagacagtctctcactctgcctctcactgaggctgaggctgaattgctcactttaacctctgcttctcaggttcaagtgattctcctgcctcagcctcccaagtaggtgggaaagcaggtatgtgccaccatgcctggctaatttttgtatttttagtagaggcagggttttgccatgttggccaggctggtcttgaactcctggcctcaagcaatctgcctgccacagcctcccaaagtgctgggattacaggccaggcaaagcttttgtaaccacctaaagcacagccttctcccttgcccttctcgatgttactccctatcacagtagttttcaaaatgtggtcctgaaaccaacagcatcaggaacatctgggaacttgttaggaatgcaagttctcaggccccaccctagacctgctgaatcagaaactctggggtgtggcaaatccatgtgtattagcgagcccttcaggtgattctgatacaggctaaagtttgcgcagttctatggcagtatcctgtttatttcctacatgtttatcgtaaactataatcgtttcttcttattatttaatgcatttagcttttctcactagatttgcaagcactgtaaggatcagcaatcattgttgaggtacaagacaatatctgaggctgattaatatttgctgaatgaatgaatgacacggaacatatcttggaaaatactgctttacataggatctatattagcttatggctaaacttcaattgccgtgaaccaccttaccaatatttctttccattcatttattcaacatttattgacatttgtaatatgctaggcactatcccaaatgctataaatacaaacacgagcaagtccttgttctgaaagaacttatagacaagtgagataaaaacaggtaaatacacaattattttattctgataagtgttattataaggcctagaaaaacctaccaaaagcattaaaaatacacatgtacttgtctttgacctagttattctagttctaaaaattaattctaaaaaaaacccagggatgcatacacagatttatcaaaacgatgtttgtcagcattatttatactagcaaaaaaaatcagaaataacctaaatgtaaaagaatggagaatttggctgggtgtagtggctcatgcctgtaatcctagcattttgggaggccgaggcaggcagatcacttgaggtcagcagttcgagaccagcctggccaacactgtgaaaccccgtctctactaaaaatacaaaaattagccagacttggtagtgcacacctgtaatcctagatactcgggagaggctgaggcaggagaatcatttgaaccaggcaggcggaggttgcagtaagccaagatcacaccactgcactccagagtgggtgacagagtgagattccgtctcaaaaaaaaaaaaaaaaaaaaaaaaagaatgaagaattcaaaaattatcctagacataggccagaacactaaaaaattattgcaattaaaaagaatccttaatgatgtgaaattgttcacaatatactactaagtaagaaactatataatatagtttttaattctatataaaaataaatgtattgggaaaatgtattaaaaatgttaacagaaattactaggtgttatgataacaggtaatttaacgtttctacttttatgcttctctttatttccaaatgttttgcaatgcactatgatactaagagaaaaatgttaagggcaacaagtcagagttgagggagcaagtaaatctgctatgtgggttgggaggtatcatcacacaggaggtgtcgtctgagttgggacttgagaatgcatgggagctgttatcaggaagagttgtcagtaaagcaggattcagggaagtgctgagtgcctttgggggccaagaaatagctcaatgaggctcaagcagttgcagaggggatttgcagctctccaccaaatttagtttacagagaacaacctatttactttctcaaaagaaaacaaagtttcatatggacagtgacattcttttttaataaaaatcagaatttacctatgcatgatgggccatccatgctctaccaggcgcattttgaaaagccacagacagctttcctgctgcataaagaataatacaaataaatagaaattataacgtttcactttggctgattatgagataacatcagatgggagaaggaggaggatatatctttatatcttagacccaaagctcccagtgccagaattctagaagcaggcctaatcccatggtctggctctcatcagtggccaagaagactgaatgagcagtgaaatacctctttgatgcttgttcatcactcagcaccagcacagaaatttcaaaggccatgttaagtgacttgacaatctggagacagatgataaagtctcagcttctgatcactaaacacaataaatcccttgcgaacaggtgctactaattttttttaaaaagatccatcttgtgctgtcagtcattttcagatcaactacaagtgagcctgttgacctgaggtatactcagattgggctaaaattcagtaaaatatgagttttgagaagggtacatgtgatttaaatagatgggattgccccagagatgccttccataagagttacaaactcaagtgtcaatagagcagtggcagatgatgagctgtctaccaatatcagtcctgcccttcttgaacaataagaaagttttagctgggcacatgattaggtagaacatttgctagcttctcttgctatgacagacatgtgagaaactctccaaacaatttttctatttttcttcggtatatagctaatctgtgtttcccaatcccctactgcagttaaaagagggcatgtgactaatttctagccaatgcaatgtgggtggggatgagatacccaatatcctggcccataaaaagtattccatgctcttttcacttgcaggagaagagaaaggaatccacaaacctagaggagatcagaatgtgtgtaccttcagagatacaaattctatttcaaaaaagccaccttactgaaacacttgcacatgtacacagagaatcattttcatgggtgttcgttgcagcattgcttatactagcagaaaattggaaacaacctgaattacatctacaggaaaatggtaaagcaaattctggaatatccatactaaaaaacataatgcaacctttaaaaaggttctatatgggctatcatggaaagatctccaagacctattgctgatcataaaagcaagctgcaggataatttatcccctaaaacagcaaacatttatagatgatttatatgtcaggtactgtttagggagtggggataaagtagtgaaccacagacaaaaatccttgcctatataaaacttatgagcacgtagaatgtatattttaacatcctaaaattatatattagttaataacttgtgcatatatatatatatatatatatatatatatatatatatatatatatatacttatttctaaatacagagagaagatccagaatgagacccaccaaattgttcatggtggtaatctctagagaggggagtggggtcaaagaggggataacaacttctttgtctatattcttctgtgtttccatgtttataggaatgcatttgtgaatttgaattctttttagtggaatgcattccactaatgcaaccaaaaaaactgctcttcaggggcctagccatggaactcctcaagggccaccaccatagaaggatgaacaatgtgtccattttcctcaactggtgtcttcatctgctttatttatttatgcccataagtgaggtttcttttgatcaaaggtttctgtggccacaaacgtttaagaacagccaacattgctcataatcagaaaattaaaatacacaaaggaatatggatagaaatctcacttgggcataacactagactaatcccatatcatttaagggttttgattgtctagctcttttgttactaaggctcctctgcctgtaaaggacaagacttaagcttttcagatgtcaaatagcactcaataaacatcacaaatgagttctgatgtggaaaatgcattctcaaatagaagagtttttgttttattttaaaattgtgttagcacctaaaagacccctgtaatagtgaagataaagttaatccagtaatgcatttaccatagtaaacctccagaacagaaacacattacttccctctgatggaattttaaatcagcgtaagggattaaacagtattatccagctgatggagagcaacttggaaattatgggaaatggccatactgcacagccgtttgcattccaggaattccgtttggaccttccatgattaatatgtctgatataattctggggagctggtgtcttttctcctttgactttttcatttcatcttttcaaaaggcttgcacaaagcagagccaggcttcatgctcttctttcagactgtggtttattatgatctagatttgaattaaagcagtggaaatggcctcacaattctacaactccacttttagtatttggttgaaacagaatgcattctccattgtattagcacatgcacaaaataatgaattatggcctatctacaaaaataaacattgtctgacagattatagggtgagtggattggatgatacagagcctgaaggtaatcaaagttcattccttcttttgccaccttccctttcagcttgctttcctgagcagcagggtttgagaattctctttttttctgcatgtttaaattaaggcacaactcaacagctatttcagataaaatagtctcccaatttatccatcttttcctgaaatatttttaccgtagaggccaattttaattgccatgagttttttgtttaatgtgaattatttatataattaatctgtttttcttagcacttattgacagcctaccttcacagaccatctcttctcccaaatacctcatccttgtttctcctatctgtaaacattcccactgcaacccgtcgtaataggtaatgtcagccacagaaggaaataaaatatcttagtatccataagcaaaacaagagagaaaactgtatattttgtaggcttggtgaattctgtggacttataagccttggactaatcctaatcaaaattaaatctttctttgattttcctggatactctaacttgatgaatgacttaactgctttgtgttttagttttctgaaaattgataggataagatgataatacctaactcatggggttaagagttgagtgagatgatataggaagctatttcacatataatgcctggcatgtggaaagcatttagtaaatgggagctgttattgctgtcattattatcatcactatcagcaatgtgtttttgtcttaaactgaccaaaaaataataaagtctgagaaccaggaccaaatgtcagaaaggttcttggatccagattttagtaaaaatcaaggaaaacctctctaatgatgagagagacaaaaataaagtggggggttgtatactaacattattactgagtttacagaaaaaaaaaatggatgtaagagaatattataaggctgggtgtggtgactcatgcctataatcccagcactttgggaggccaaggtgggcggatcacctgaggtctggagttcgagaccagcctggccaacacggcaaaaccccgtctctactaaaagtacaaaaattagctgggcgtggtggtgcatgccagtagccccagctacttgggaggctgaggcaggataatcgcttgagcctgggagatagaggctgcagtgagctgagatcatgccactgcactccagcctgggagatagagcaagactctgtctcaaaaaaaaaaaaaaaagaaaagagagagaatattatgaataactgtatgccaacaaattgggtaacctagattaactggacaaattcctagaaacacagacattaccaaaactgacttaaggagaaatagaaaatccaagtagacctgtatcaagcaaggaaatgaaatcagtaattagaaatcttccagagaaaagcccaagactagatgtcttcacaggtgaattctaaacatttaaagaagaattaacaccaatccttctcaaactctttcaaaaaaacgaaaacaaaaacacagaaacaaaaacactttcttaattactttatgagaccagcattactttgatactaaagtcagacagacaacacaagcaaagaaaactataaactaacacattttatgaataccgatgtaaaaattctcaacaaaatactaggaaaccaagctcaacagcatattgaaaggattatacaccctgagcaagtgaaatttatcccaggattgcaaaagtggtaaaatgtatgaaaatcaatgagtgtaatataccacattaatagaataaaggaaaaaactatgtgattgtctcaattgacaaagaaaaagcatttgacaaaatctaacaaatatcctttcatgataaaaccctcaatacattagaaatagaagggaacatcctcaatttgataaaagccatgtagcccctaagattaggaacaagacaaagatgtctgcttttatcacttatattcaacaaagatgcctgcttttatcacttatattcaacataatactgaaagacctagccagagcaattaggcaggaaaaataaataaaaggcacctaaattagaaaggaagaagtaaaactatcttcgcctgcagatgatatgatcttacatttaaaaaccttaagaacacaaacacacacacgcaaatctgtcatagctaataaaatgaattcagcaaagttgcagaatacaaatcaacaacaaaagaagttgtatttttatgaactggcaatgaacactctgagaaggaagtttataaaaacgctgtttacaatagcataaaaaataataaaatgcttaggaataaatttaactaaggaggtacaagacttgtacactgaaaactacaaaacattgcttaaagaaatgcaagacaaaaataaatggaaacacattcagtgttcatggatgggaagacttaatactgttaagatgataatgctgccccaatgtggtatatctgttcaaagtgacacacagattcaatgcgatccctatcaaaatcctaatggtgtttcttgaagaaatgtgaaaactgattctaaaattcatatggaatttcagaggaccaagaatacaagaatagtcaattcatcttgaaaaagaataaagttggagaactcacatttcctaatttcaaaacttacttactgcaaagctatattaatcaaaatgatgtggtacagggataacaacggttttatataacaatatagaattgagagcccagaaataaaccatcatctctatggtcaaatgattttctacaagggtgtcaagaccattcattgaggaaagaatactctcctcaacaaatggtgctaggaaaaaaccagacatccacattcaaaagaatgaagttgggccctacccaaatatgaacaagaaattaactcaaaataaactacaaacttcaatttaagagctgaaactataaaactgttgcaagaaaatataatggcaaatgtgtattatgtcagacttggcaatagttttaatatgacaccaaaagcacaggtaacaataacaaaaatatataaaattggacttcaccgaaataaaaatttctgtatatcaaaagacactatcaagagagtgaaaatacaacccacagaataggaaaaaaatttgcaaatcatacatttggtaaggttttaatatccagagtaaaaaaataactcttataactcagcaacaaaaagacaaacaacccaaataaaaaatgggcaaaggaattgaatacatgttttcttataaaagatatacaaatggccaatatgtacatgaaaagatgctcaacattattaattattaggaaaatgcaaaaaataccacactaagatactacttcacatctactaagatggctataatttttaaaaaggaaaataagtattgtcaaggatgtggaaaaattggaatccccacacattgctggaggaatgtaaaataatgcagcttccatcctcaaaaagttatacacagagttaggatatggcccagcaattccactcctaggcatgcaccccaaataattgaaaacagtgactcaaatagatacttatataccaatgttcatgcagcattattcacaataaccaaaaggtagaaacacctaagtgctcatcaacagaagaacgaataaataaaatgtggcgcatatgtaaatgaaatattatccagccataaaaaggaatgaagttctaatacatggtaaacatggatgaacctcaaaaacattctaagtgaatgaagttacacacaaaaagacaattattgtatgattctacttgaatgaaatatctagaataggcaaactcatagagatagaatatatagtagaggttaccagagactacggaaagggagaaatgagaagttatcacttaatgggtgcagtttctgtttggggtaatgagtatttttggaaataatagtgataattgcacaacactgtgaatgtaattaacgccactaaatatgcacttaaaagtggttaaaatggtaaattttatgttatatatattttaccacagtaaaaaggtaaattaagaagtctattataaacatcattgttggtatttgtaatggcaccatactatgacatatacaaaaccattcagtttttctatgcacaattgagaaaaggaaaagtggcccttataaactggaacttaaacatatttttggccagatagctggaacaggcaaaatgtaattggttaaattgtttgtatcagttctacctaaacatattaatccatgtctataaatgtttaaaaagatgaatgcactgttacgagggagtaaaattcccagcactgaagatactaataaaaaattgtatggtagcccagcagggaaattgtagaaggaatttatacacatggcaggatgttagacaagatgagggtctcaaaggccttccactttttaagagtttaaagttctatgagaattgtgtacaactagaaactttcccaaggttaaataattttcctttttccagaggcaatggaaaatggcaatttgggttccggcattcctgataaaaatttactgtttttgtctggtgatgtctctactgaaaatattctttgctataaatctcttgcctgaaatttccatagagcttatcaggtttcataaagcagatcaccttaaaatggcttttaaaaattcagagtggaacagattcctctatgaaattgtaatatggaaaataaagttctcctaaccctaattgtcttcacaaaagtgtttccaaggagaacacccagggatatgacataagtagcaaggccataataaagatgtgagtgtaatttccacacatgctgtcaacctcaaatatgcagcctactcagaggcaatttgggtaaaaattgtcatagctattgccagtgttgtcacttcttgattttttcatcctagggactgtgtcttattcattcttggtctcactgatggtgccacagtaccatctttcaggcattcagtcaaagtctcctgagttgaattttcactcttcctagatttcctttgttatcatgagtttttgataacaaaggggattgtgaagagaggagatgggtcagtgactcaaatttataaagcaggggtaaatgacacagtcatcagaatacataactgggccacagaaggcacatttaagtaacaatttggaaaactcagaatctaatcaacacatctgtgctttatattctctacctgctgtcttgcctaaaatgaagatgcttaaatccccattagtggggcagggctgcccatctatggaaaaacagagccggactccaatctgctttgtgtgtcttcagaacagctgccagctgatcagaaaacatttaatgtgggggatccagtgtggggcaggacgaacacagctggttgacacagcaagcagttagaaacaacaacaacaaaaatgccatttgattcgtgggctgagccaatccatctgggaaatctctcaaagaaagtagctggaaatgacatttcagctctgattttcctagtcaagtctgcaccttaagccaaagactcaaaaatagcactccatctagatggtgtaaatacagtgacacttgagtctcttcactttggtcttttaagagtgattttaactctttcagagataacatgggagactgaaggggctggatgctggaaacgagactgtccacatcttgtttccagaaaacggattactctgctggcggttgattcttggatttcctatcataagatctgaaccctgggcctgatgtacagtgaggcgtgcgattggcatttgcagaagccttgacatcccacactgcagttcatgattggtgtcagacaaagaagcatattaaatgactgccggcccggtgataaggccggttattaccgaggtgtagtttccccaggtctaaagactcatagtggtaccactgaagcatgctggggagaagataaaatttaattaataatttccttagaggccaacagtctattacaactatgttccttgctgttctctgcaatgaccttatagctcataaacattatagatgcatgcttggtcatagtctcatccccgggtttaatttatggctcaggttgcactgtataattagctagtctgaaatgaaggttttcagatgctgaaaacatttaaaatagactctgcataaggtagggtgtgcctccctcccttctgttcagtttaatgcctgtaatacatagtataatttcctggattaataatacacatatgatgaagctggggatgaaggtgaagtctgcttttgagttacatataggggacgaattttggtttatgttagatttggagattctggacactaaattaggtagctttttctgtattccatagagtagctcaaactaagtgtttttagaaacacaaaattgcaaaacaatgatgtaacgtggggttaaatttttctccactacagtaaaacacttgtctctttgtatgtgactacaatttattttggacctattatgtggccaacactttgtagagctgtggtagaaacaaacaaacaaaaagcctcaattatctctgggattagtgcctcaaaatcagagaagtagtacatgtttaataaatatctgttgactgcatgagtcaatgaattgattgtgggatattttatacattaaattattttttaaaatgggcaatgtttatatggtcagaaaagtaataataaagtagattaaaaatgatagttgctatcttcctaaaattgagaaccaatgtttgctgaatgcctccatccaggccctgcggtacgaggaatacagagaatacagcagtgaatactgattcagactttaaaggctgactgtccgatagcaaaaatgactccctcaacttgccagagtcaagcccaaactctaagtattacattttctacaattatctttggcatattcccctttccagcctatgctatatccaaattagatggcctttgttctagtgcctggctagaatagagtctgaaatacctgttgaatatataacataaaaagaaaactaatcactaggaatccctgtgctgtttgctgttggtgacccctctagttagatattcttcctcagttgctagtccatgagtccatgacaattctctctgcctgttcttcaagatctacttcaaacaccatctagaatatagaagtgcattgttggtatttgtgtcatttgatcactcagtcactcatttgtatatatctcacacctctttctaaaatggctaaggcatcacatgatagaactgcatagaagtagaagaatatctatgctttgtaaagatacagttttcagtgccaaagcaagccactttattccaattctcatccacatttcagatgatgatgatgatattagttaatacagttaacactattgacagagcatttattatttgctctggactatgttaacttcttcctatataattatttcacttacatacataatgccaccatgatatatatatatatatatatatatatatatatatatatatatataaaattattctcatgatataagtgaagaaactaaaacagacacactaagtaaacctgccccaaatcacatcataacagtagtgtgagtatatcaacccaggtctaagtctaaatctttgctcttagccactacattatcctgcctctctcataattctcagctaatgacaaacagatgtgaaagtgtgtatattgaactgtatccttgaagaaggcaacttgaatattccatttgcctgtctgatgccaactacccaaatttgtgtagtcactcgaccacctggatatttagtttacgttaacacaaaaatctggatatttgaaaaactgtggtgctcaagcaagcatttcaaatctcatctaaattcctagcttcatataatactcaggcaaggcatttttcatgaaaacagaacataagagatctgagccaagaaaaaaaaaaaagagacaaaattttagacaaaaagtatgtattgcttaatcaataccagttaaaaaaatgaattttcctgtagcccaccaccacatttcacagaatcatagttgtcccaatgtgatactttatgaaaacagtatatttcaggatattacaaccagactaaatccaactgaaagtcaaataaaggaagaaagacgctaggaatgaaataaattttggatcaatccagattcatcaccaactgatatgattgggatctgtgtcaccaccaaatctcatgttgaattgcaatccgtaaagttggaggtggggcctggtgagaggtgataggatcatgggggcagtttctgttgaatggtttaacaccatttcccttggtactgttgtcacgataataagctcttttgagatctggttgtttgaaagtgtgtagcacctcccccacccatgctccagcgatttgaatactggctccccctttgccctccaccatgactgcaagtttcctgaggcctccccaggagctgaggagatgctagcatcacgcttcctgtacaggctgcagaactgtgagccagttaaacctcatttgtttataaattacccagtctcaggtatttatttatagcaatgcaggaacgatctattacattatccattgtcataattgaaccagaactctcctatagctattgaggatcttaacatgttgtttcaaataaaaataaagacaccattctgaaccaactttacatttagaatatgccagtttctatattaatccaggaaactcagcatctaagtttcccctaaagcatctgttcctggggtgtacccacaaatttataaagttataaagcccaaagagatggcccacatgaattcacttcagcctgagtgatgactacctgattcctccagttattagcaaatttttctgtttgctctctcttgatttttaattcttgcacaagtcacatcatacattgcaaaagatataatattcttcaaacctaatacctcagtactcaatagttgtttttttccttgcccatttttttttaaagagttgatccatagtttttcaagctatgcttcatgtatggtgaccaccttggtttctgtacttttcttggttatttcaatatgtaaaatgcttgaacttaattgaagggtgagagagagaagggagaggaaacagaagaaagaaggaaaaagaaagaagagaggagagacagagagaaacagagggggaaggaagggaggcagaaaaggagagagagaaagaaaggggaatgtggctagaaatgtggatacaaaagtgtcatagaatcgatatggaaaaaaaatcctttaacctgctatcacatatactggctcaaattctgcttttagtgaatttcccccaaatatgaaaaagtaagtaggtataggaagagtttttaagaatattgaaaaactaaaaaccataaaatgtctgagaataaaggataggttaaacaaattaagattaatgtcatgggctttataaactactgaaaatcacatgatataagagtatttgatgacatatttgtgatctattcctaatacagaagcatgcatggtcatagtctcatccccaggtttaatttatggcccaggttacactgcataatcagctggactaaaatgaagattttcagatgctgtgaacattacaaattctgcataagttacagtgtggtatagcataagccctgatttcatttaaaagatatatgcattgaataaagagataataatttccacaaaaatgctcataaaacctacctttgggtgctttaagcatctgtctggacccgtcattttctctttagttgattaaatagcataagcaatttaaaatttttctacttatgctttttccattttccaaagtccatacaacttttataatcagttaaacatcatgctattttaaaaaataattaatgtcagaggctgtaaatttttttaagacactcctctaacacaaagcacccaaaaggaacttcttggaggtggatgcttgtctttgcaatggtcaacagatacaagattgcagacaacgcatttgtaagtctctggcagatgttatgagaatttcccatgaaccagaaatgaagcctctgaggaacaaggacctgaatcactaaatatcaattccatcccagagcactgcagaaattttgctactgtctgatcgggggataggaagagcaagaaggctgtgcttctgcctcggagaatgatgttattaacttatcacattagaatatcaaggaagatcagagtatgtatatatctttgtgtgtgtacctgtctatatgagcttagcacgtaattcccagacctacaaaacttggcacacaaaggaagcagaagcaccgaaatagtgaaggattgactggagtaccccaaaatcttatgcaataaaaagaacctcagctggttaacattttaccctttctctctttaattgtgaataataacattgaatgtttcagcctatttttccccaaaatggtctccaacttctagttttttctgtaaatagcatgcatgatatgcagaagttttctcaataaacagctatagaaacaaaacaaaacaaaaatttagtcacaactaaaagtgtgagaagaggacagcctcagtcctctaaatgactggattggattcttacatatttaaaaaataaatgtagccattattttaaagtcaaggatgtttccatattacctacaaaatagatgtgatgaagaaatatattggcacttataacactgatgggaaaattgattcaacacaacattccttgggattattagatatttttaccccactacaatcttatttatcctattcacaccttcagtaaatatcataccttctcgtaatagtaaatcagaatgaatatcaattagaactggaattctaaatatatacaatctgtaatgtatataatatatacagtctgtaggttgctcttaaatatactattaaaagtgctagttcaagttggtaaacatatcaatacaatttctttttgtgtggctctcagctcttcagaaggatgactgccgtgttgattttaaaacattgtccatttttctagttaaataaatatttccacatcagaaaagaaggttctattatgttaactttacagaatatcagtttcctggtgagttcagaatcagacatacttgacttgtcagaatcatgaaattgtaggattagacatacgtaagttagataccaatttacaaaggaataaaatagatggagtatcaacttttggaatatatgattgcgaagaaaaaagcaaacagaaaataagagtcacccaagagtgcatcacacccatggagaataaagtacaatcgtagcactccattttacttagcaataaataaaaagtaaattgtttaaatattatttattgcttttcaactttatgagataactcattgaataaaccctcaaccttaatagtggttacaaaagagaatataaacacaatcaaccctgatgatataaaaggagaagagtatagaaaaggaggaaggaagtgggagctaactttctcatctgacacagtgggaagtcaagataaaatagctggccaggcaccgtgtctcatgcctgtaacccaagcactctaggaggccgaggcaggcagattgcttgagcccaggagctcaagaccagcttgggcaacatagtgaaacgctgtctctacaaaaaaatacaaaaattagctgggcatggtagtgcacacctgtaatccctggtacttgggaggctgaggtaggaggatcacttgagaccaggaggtggaggctacagtgagctttgattgtaccactgcactccagcctgggcaacagagtgagaccctgtctcaaaaacaaacaaacaaaaaacaaaaacaacttaatagcttaagttggtgaaacaagaaatagaagtttcatggtgacatttaaacttacaaaggcaagcaacggaactaaaataataactagcaaaaatcagaatggagtaatttttaaaaagtcagataagttttggaagtaaatccttatttttcacagttgaggagttaatagaaatatattaaatgtatatatcaagaaatagtgatatatgcatgttctcactgatacatgggagctaaaaaagttgatctcatggaggtagatagtagagtggcagttgccagtggttgggaagggcataggggaggggagaataaagagaagtagattaatgagtacaaaaatatagtcagatagaagaaataagttctagtgttcgatagcacagtagggtgactacagttatcaataatttgttatatatttaaaaatagctaagagagaagatttggtatcttctcaacatgaaggaataataaaatctttgaggtgatggatatcccaagttaccctgatatgacgattacacattgtatgcatgtatcaaaatatcacatgtaccccataaatatgaacaattactatatatcaataaaactataataaatggaaggaaaaaaagaatcactcaagatatgtagaatactattgagaaggactcatttcaaaggtcatttctgagctttaggataactctagacactgtcccccaccccacttttctgtgatacacacatcaggaaacactactttaaatgcattatcatggttcacccaggttgccaagtgaagcgctcctggagacagtcagccaggtgccaattatgaagttggcaccttcctgattatcccacatcctgataaggaagacagatgctgccacttcctgaaacccctggctgtacccacctgggcctcctgacaaccaccaactatcactgaagtgctgttcatgggggccaggttacttccagacaatttaagatatttacattgccctctgctttctccgagctcttaatttataactcctttctgtttgtgtataaacccttttagtcctttgcccatattaatccttcttggtatcatttggaaagagatgatattggtttgattctctctggctctccccacctcccaaactggtagggaaaaaaatgaagacacatttgggtatgatgtaatctagcaagttcctttttattacagatcaatctttagagaaagatgaagttgcctgaaagcaataaaaaggtgaggcctgtaaaattttctttaattcaatcatctcaggaagcttttctttataacgaagctaacaacaactcttgttatctatgcttataataattccagtcaaatgcataaggctttagggtttatcttgttcatttttcataataaatccctattttacagataaaaaactgaagcatagagaggttaaggattttcctatggccatgtggatctttagtagcagatgtgggattttaactttagatttgtcaaaaatcaaacacacacacaaaaatagtgcttacaactgccctattattttccttgccatggcctttgttgagggttgcaaactcagatgccaggcagataatctccatgaggggagcaggctggaagggaaatatggcaacctggaatactcctacatgatctacagggtgatcactattggccaactccagctaactgtggtcatgaaggttgtatgtacacactgtggccacaggatcagatttgtcaagggaagatagacgcatagatttttttaacatttaaaaattgtatgtttttcaaatgttggcagctcatttaaaatattttaactggctgaacaaaagccttctgtagggagagttcagatcttgggccaccagagctcttccttcctttcctctcttttctcttctctcctctcctctcttttctcctcccctctcgcctctcccctctcccttctctcttgtcttctctttcttcttgagatggagtctcactgtgtcacccaggctggagtgcaatggggtgatctcagctcactgcaaccttcacctcccagattgaagtgattatcttgcctcagcctcctgagtacctgggactacaggcgcacaccactatgcctggctaagttttgtatttttagtaaagatggggtttcaccatgttggtcaggctagtctcgaactcctgacctcaggtgatccacccacctcggactcccaaagtgctgggattacaggcgtgagccaccatgtccagcctattctttctttctttaggctcaaatcttaacaggtgtgataataacatgctgcttcaatgaaacactgcatctttggcttttaaatttctctgtctctctactatagttaaggagttgagtgacaaactgtctttctcatgtctgctttcggaggcaaagtcaaaactgagcaggcttggtggaagcctgattttccagctggaaatgagaatccctccctctgcctcctccatgccgttgtgtgagcatttgcgcaagttgcctccagttttctcatgtggttcggatatatagtgtcttctactgagtctagctatattttgtcttggaggaggaagaaaaataaatccatattagactccaaaaaatatagcttggcttcaatctcctctgcccaaattttggggataatggtaaattccacactcaccagccacattttttttttctttagcacaccctggtttaaagaaaaaaaaaaagggaacagtaacctccaaagtagggaggtttaggttggacagagcaacctacaatcttaacattaagtaatttggaaaattactttaaaaatctacggtggggctgggcacagtggctcacgcctcccagcacgtttgggaggccgaggtgggcagaccacctgaggccaggagttcaagaccagcccagccaacaagacgaaaccccgtcgctactgaaaatacaaatattagccaggcgtggtggcacatgcctgtaatcccagctacttgggaggctgaggcaagagaatcccttgaacccaggaggcagatgttgcagtggtccgagatcgtgcatcattgcatttcagcctgggtgacagagaaaggctctatctcaacaacacaacaacaaaaattatggtgaagggtactctttaaatataatcctttgggttacacttaaacactctgcaacaacagaaacaaaactctctgccttggggttttgactcacacagacctctaaattcattcatccctctcagtttcttccagagaccttagcatcagcaaatcaatcttgctcactgttgtaccccagcacctggcacaaacattggtaaatatttgttgaataaatgaataaaatgaaaaaagggctcagatcagttgggaccaagataacatctatgcagtgatttattcattcaaatatgttggaatgaactcaggtccctaaggagcgtgctccaggaacaaaaggtggccactgttgagatcactgtgaggcttttgttttgctctgtagggtggaatccgagggcaacagctgattgtgtcttgacaaaagagtaggaaggaggatttctgagtgaatatgtgggtggaaaggcaagagaaaatagccaaaaacttggggggcaaatgggtaagacttggaaaagaaaaaagatgttgggtatgtgacataaccctttcagtctctccataaaactttcagtaacatgttcactatcatcaatgattttagaatcgagtaacatggtcagtattaataatatagctatcacacatgcttaacatagagaagcaaatataaatacaaaaatacaacaaaatctctggagcagtctcaggtgaaacagccaaagaaataaaaccttatacttcaacatgaaaatcactcaaaggtacttggaaaacactgttgatttacgcaaagacatttactgagcatttactatgggcctggtgatgttatggcaaacgagacagtcacgggcatggtccctgccctcaaggagagagaggcaatacatctaagaaataggactgtatcagtgatgggggctctgaagggaataaagaggaggtggtataagataatgataatggattggatttaatattaaataggtggtcagggctgacctctctgaggagtgacaactgagcctaaatgtgaaggataaaaagaggccagacataagaatgtctgtggataaacctttccaagaagaaaaaagagagatgtgcaaatggccggatgtagcagatggtcaggcaggcaggggccagatcagggagacagagaacataactaggtctgcaaggataatgggtagaggggcaaagtctcagggaagttgactgaaatgcagaggtaaaatgtaatcacaacacaagggccttgacatgccccatctctgggggaaatgttctcaaacactagccctccagggggcaggaaataatgtagtctagttaattgcccttcgggactgctctgtgtatgaatgtaaaactagggattatccagccccagatgcaaatgaaaagggcacagtgggtcactggttttcctgaagactcttctcacttgagatagaagtgaaaatgccaattaccctcatttctgtggaagggaactgggagaggagaaacaccagagaattgtgcttccgattggcttgaaaatcataacaaccaccccaaaattaagagaacaggaaaaaagccctttgctcttgggaccttaagtgattagaaagagttgttatttggctgattttcacacttcattagcatatgcatgatttaatgagggaacatgctggggggttggcacgggtgagggcagctctttctacccacagactagaaactggggcagtagcattgggagcgcttaattacgccagcaaggcaacagagatcagtgcacaaagggggatgagcatatgatggggacttggaacaagtacagaaagataccccaatgtctgtcttcacctctgagcacacctgcactgagccataaggcagcattgcctaatatccctcccaaggataaatccacctgtgataaacctcacactctccttctcttgcctcagacacctagattttcttctctgaaaatcctacaatggcaggaagagtgaagcattatattatgattgtccacattccatttagcattgaagagaggaggaagaaagtgggacagtgttttggggacagaataaaatgaactcttgaggaacagtcagaccttcacattttgattctgaactatactagagtagatacacaagtggagcagaaaggacaaaagtcacaacgaatgctgcaaatcggtcaatgtttaggctttctttttctccattcaaaacaccccaaaggaagatgaaaaagaagaaaaggcaaagagagactacctgcaaaggaaggactcaactatgcccagtcacctatcttttaggacctgtttctcttcttgtgtcctttggaaggacatatatataacacaaaaagtaaggagtagaatggtgcgggtctttttgaaaagtggcagggaattttacaactgtcacaccatatcttacattagcaccacgttcaatgtcatgtaactatcatactgctatatcttagtccattggtctattctgagatattttgccaatctttttctgcttcttataactcttcagtgtcgatcccccctttttctattaagaaaatattatttttcatttttcagcccaatctgctgtgtgtatgtgtgtgtggtgtgtgcacgtgtgcgtgtgcgtctgtacagcttacaggtctgagctaatcggcatattccctgcccctggcaacagtgattggttcaggcattaaaaaaaaatccaacttggaccaatgagagttaggtccagattttcactgctacattgagaagattccaacatattacttttactctcttcacactcactcctcaaagctctccaaacatgtcaaacattttcatacctctgtgcttttgcagatgctattccacttcttgaatgaatgaagaaatccatcagttcttccatatgttattttggcttgaatccccaaaccttatgctaccatatttaatttaataagcacacactcactactatttattataccagaccactggctgtctcccagcaacccattcttttcttcttctgccaataatcccctgactttcccttttcttatcctcaagtaaaatttgagaggtgctgattcctcccgccacatgagagtgaggccctaattggcctaattcatcaggtattccatcttactgaatatagggaatagatttagggataagcacagaatccaaacagagctaatgagatgttaggagatgtttcctaaggatttaaggagatgtggaaccctgcactatggcagacaattttctaccacaaagaggctggaacagctgctgggtctacatagaaagcagaggacagagactattgaacccgggtaacatagctaggctctagatcaagccttactcaaaactagtgttctttagatcttttaaggtgtgtgtgcctaatttttgattaagcaaacttttagtaggattttttagcctgtttaaccaaaaaattactggccaatacagtgacaaaatgttaaatagttcaagagcccagccaaaaacctgtgggaaattataaactatcttctgagtcaatgccacattgttcatgcattcatccattcaacatgtagttgaccaccacttactatatgccaagtactgtcctaggatgttgggggtataacaatgaacaaaacaaacaagtgtccttttggaacacagattctggtggagggagatatgtaacaaacaataaataagtaaggtatgtagtatgttagaaggtgactatgggaaagcagaataggttaatgcagatcagaaagactaaaggtgcaaggggacttcaatttcaaataggtactcaagaaaggcttcattgaaaaggcaacacttaaagccttgaagaagtaaggaaattggctatgcagatgtctggaagaagagcagcccaggtagaagaaactgccaatgttaaggccttccagactggggagttcaagcagcagcaagaaggctacgggacaggcagaaagcagtaggaagtgaggttagagaataaaccgaaggacagatgatgtagggtcttgcaggccatcataagggcccttttttacactgggtgaggtggggagtcattgaaagattttgaacagaagagtgacatgatctgacctaattttttataggaatcaatatggctactgtgtggagaagagatttgggggtcagtggtaaaagtggaagcagggaactgctacaacaaagtatgttagatacttgcttgcatcagcacggtagcagtggaagtgatgaaaaaagattagattctgggtagattttaaaaatagagccaatatgattttctgatgcattgcatgtggagtgtgaataaagaatgactgcaaggtttttggcctgaagaactagaaggatgaagttgttatcaactgaggaagggacagttgtaggtgaaaaaggtttgttcaggagatgatcagaagttcagtcggaaatattaagtctgcgatattttattagacatccaaatagaaattttgaagcagcagttgcataagaaaatatggaattcaggactggactaaaaacatgaatttgggagttgctgacatatagatactatttcaagtcacaagagtagatgaaataataaagggagaattgtacataacagtggatccaagtactaattcatttaagtcacttatttaatccctataaccttgttaagtcagttatttttatcctaattttataattaaggaaatcgaggctcatggatattaagatcacacaacagcttggccaagagcatatatgctcacctgtgtataaagacataaatagctgagctgggactgaaacccaggcagtctgactctagagtctgtgttcctgtcacccaatattgctgcctattcccaagtggaatttttaaatcagctgatacatgtttagggttagaaataacgagaatataaaggacctaagtgtgggcaacagagccaaaagaattcagttccctgtctctagggttatactgagctgcaactacaatgctgagacaaaggtaagggctgaggtatctaaacacagggagaccagtttgctcagtggtccccacacttagtcaaattcactagatgcagctttctaggtgaccatgcctagacattgattcagtagatattgagtagagctcagaaatttcattttgacacatatctcaggaaattctgaacactttttgagaaatgctattatagaaaatagacttagtttgactctgtccaataactctccattcccaaagaccaataaaactggcctttatcttaacttcacaagtaggattgtgactgaagaaagatatctgtacatggctaatgactacagcttagcttgaaaaaatagtttgatactctttatgaaggtcttcagtcttcttttgtcaatcataatcaatttcctacttgaactgaaattgatcttttatttagtcatgttagtaaataaaataaccttgaactttgcagagcaaatggtaggtttgcactaattactcattaaaagtgtgtgagaaatttacatctttcatttgtcagtggagacccaagcttattcagataactttacctaatgatagttgcaatcaaagtgtaatagcttttaacttatgctaacaagtgactgtacttacaataaactgccacagcagagctataaataaaatgggttgctatgaatgcccacttcctttttagttctgactaaatagacaagtacagagcttctcagaaatgcgcatataactccaataattctacagttgagtaagcccagaaaaacatggaaaaaagagctgatatttgcttgaatcaaaggtaactgcacaaatgatttccttcaataccaaatgccattaccaactgtttgcacatcctattgctttatgtttttacttagggttttgaaaacagcccttatgaattgtctctattttagtgatatgactaatcatattaatatggtgcagttttattttaagaatttttccagaaccactgactcatccaatttattggttccactgggaggcaatcaaatgggactggactaatttctaaaacaggaaaatcaagacaatgaatagtggtgtcttcctcctgccccctattttttttgtgcaaaatgaaaatatgggggcaaaggagaaataatttcttaatcacattatattaaatacttacatagtaatttagtgtagtgattaagaaaatgggttcttagttgcaatggtcataagcaggttatcagtttctttatctataaaatggggctggtgaaagtacccacctcataaggactgttaaggagattagataggctcccacttctgactatatatccaaaggaaataaaatcactatcttgaagagacatgtaaacttccatattaattgcagcattattcacaatagataagatatagaaacaacttaagtgtctatcaacagattaattaataaagaaaatgtggtatacatgcaaaacaaatattattcagccttaaaaaaggaaaccctcccatttgtgaccacatggaagaacctaatacattacgccaaatgaaatgaaccacacacagaaagacaatactgcatgatctcacttatatgggaaatctaaaaaagttgaactcatagaaacagagtagaagggtgattaccaggggttgaggagtgaggtattggggagctgttggcctaataaattccagagacctaatatacaacatggtgactacagttagtaatgtgttatatacttgaaatttgctaagagtagatgttattctcatcacatatgcataaaacaaaacagaaaaaaccacaaaacataagcatgtgaggtgatagataattagcttgattgtggactcatttcactaggtatagtatatcaaaacgtcaggttgtgcaacttaaatacaaactgttttgtcaattacatctcaaagctgaaaaagtcaatttgcatgactaaaaaacagaagattcgatggaataacgcacataaaatgaccagcgtagtatctggcacatgataaaaattctttgtcatcattagtgactatcatttttatctatgcacatttttatctatgctcaactgggtataaacatgcctgcatatagactatccctacgttttgtcactattgaactcagctgcctagttactgcctaataagcatctctgtttcacctcttccactgtaggcattcagtgtgttttgctgctgactcaaacaatggtacaccaacagaaaacacccatataaaaatgtcattgcaatgatatgacatctgaggaggattttaaaatgcagaagcatcttgttcttatccaattgggcaatgaaaaaaaccaatgagaatcttcatgataggtccacgtatgctcccatacgtccaagtgtatacatatctgttcctcgagtcatcacaaacagaagtcatcacaaaggacagagtgagcagaacttaaaaccacccacctggcctatgtgcaatgcactttttaccaagtgataagtttaagttattatgagatagaacaccacttccgtggcatctgactgctctagtagctacaaatggcaaacattcttcttcttttaatttacactcagagtgcccacaatgtgccatatactgtgccaagggccctggggaaaggtaaggcaaataaggcaaaatctctgagctaaagataagccacagaatatactatttctccaacaaatacctagcagaggacctggctcataattgatgattaataaggatttgctgaatgaacaaatgtacaatttgggaagtcctatttacaaacctagggtagaaaaggaaactaatcaagccaaatttaggaagtctctgttcccagttaccactgccaaaaaccattatttgttttgtagcttctaagtctggccaggaagcacatgttttttcttagttaggccattgattcttagtgagtaccatcaccttgtgattattgctactaattaaggtccactctgaacttttatagtagtgagagtgacttaatataccaccattggcaatgagaagaatcagcttgatttcaccagcctgtaactccatcccataagttctccaccttttaaggtggaagtagtaaatcagctaaactcttccaaaagttttgggagttgaccctttgttagctctcaacgttcccactgtgttctcacagcatgaaagtgctccaccatgatccatacaataacaggcactgttccactgaaatcaacagaataaagggctcttacataccccttttcagctattatttgtagtgtgactacaatcatgctttagctttcaagacactcaagaacttaaggatgcaccatctgtggattcttgtcatcacataaagcaaataattgctttttaaaaaatccatgccactattgctaattttttcatttccacaagctaccctgctaaacaacctctgggtatttacatagcatatttgattatgcagtggttttgtgtgtactgaacattatacagtgagtccatgtatcctgaactcaccatctggatttttcaaaccaacttgcctgctttcttttatttttagcaggaggatgataacacccatctttctggcctctggagggattaatactcacaaaagctgtaaagctgaaagactctgcatctgtgctgaatatgatataacaaggtatatttgtaacctcgtgcttaaagagacctatctactgggcatctccgactaccagcagctaagcacattattgtcatcaaatggtatttattgaacatgcagtaactgtctggtgagctccaaattaatgggggactcctgagaacctaattttaaaacattatctccctctttgttatctgtatttgtttgtttcagagcctgacatgttaattggggctcaggactccaacgcacaactgcaattttccttttgaaagcaagaaagcggctgcctaaagacagctggcttagctcctggagttcagaggttggcagggagctgtgcagccacaagtgccagtaagtgccatgaatacggcagaaaactggagcttgtctcaggtacaggctgagaaatagacaaacaaaccgtcaatctcctttcagagtctcccttcccataactactccatccgagacaggcatttgtcttatttttagtctcctcctcaggagctttccatttttatccctagtatctttggggacttggtgagtctggttttgagcctctaattggcttttaccctctaattctttttcattcacccagaaggcaaattggccctttccttgtctactttatcccaatttctttcactcggttgcctcattttgtttttcatcttccaaggagacttaccctcttctctcctctcacgtatcactggagatctgtcaagcctgccttaaccctgacttccttaaccttcccctgatgaaggcttccccagctggtaatttatttctctaatccacagcttccacagtacttggtttggattttctctgtaatacattctaagatgatttatacccattgataggcatatgcagaagataaatcttcacacaccatacagcactcaccagcatactgagcctagagcaggagcttaaattattcttagacaaatgaatgctatcatttaaatattataagtactttacaaaaagaatgttttaccaatgataaaatcaacacctaacataatctaacagtgcattaacactgagaacaaacaaaattatcaacagtagcaactaatattgactcagcacttaagaatgctctaggcacatagcgagatgctttgcttggattatctctttgaatcctatcaataacttgatgaggtaggcactaatattatagaagggaattgtagcttcaggaattaactttctccagggtatacagctaacaaatagtagatctgggaatcaggtccatgtctgtctgacctcagaatttgctatcttagccacttcacttctgtcttctttttccttgtgagcctgtttaaagggatctagtcaggctcaaccagagtgactttgagaatttataaaaccatatatataaaaataggtgacagatacactgaatactccgaggtgactttttaatttctgtagaaaatatcctctgattcccattccggggcagccagaacaaagcaatggccaaagaaagtttacttactccccagttcttagatggagttatgatttcttcactaaacaatgaggaggccaacctaggttcttagagcaaatcttgttttctagcgatgaacatatttctccttgtctttgacttagatgttatttgcactagcctaatttaaattgttaacacagtacaaattttaacagaaagacagaaagagaatgaatatgaaagatttgggctgctgctggtgatagtggggagctctatttacttttggttaaatgccagtgctgtaagagtccaaggtcagtaaaagaggtgtgaaaccaattagggtttctcagcttctggctgctggaagatatgcatattgcacacccaaaatatacagttttgtaaggaggtatcgacaggctacagtcactctgccatgctgcacaatggcatggtgccaatctagcctgagacaacacatgtccactcatgagttttgggttaaaagtgctgcaacccaaaagaacagaggtgaacaaaagagattcagcaagactgggaatgaagcatgaatcacagatagaggagatcaccatcaaaagcttaggaaaaaatctgccaaagctatatagctctctgctaatgactatgattgtaatttctgcatattttaacagatgttctgtttataaaactgcaaacgaatttaggggttatgagtaaagccaggaggccctggagatgtttctttgtatgattaactgaccacaggccatttgttttacaacaaagatgcacaatgatccatagtccatgatttataccagcccatgtatactaacggctgatgtctccatggtacttctcattagcatcagaagagggattgcagggaaacagattatgggaattgctctcccattgctcaacacgatagttcattagtgggtgtggaatcgatctgaaaaaaaacctaagacgataatcataagctgaaatttgaattattataacaattaaggaagtcaattcaatcatgaaagaaataatatggatttttatagctctaggtccatgcatcttgataattggaaatgagaggattttctgtaatttccaaataaaagataaatataaataaaagataataataataaacataatattactgacttgtactgattacctatctatggatcaagcattctggtgggtaatttatataaattatctcacttcatcctcacaactgtgtattgtaaggatccccgggtactggtaccagaatggcatcaaggttaggggcatcccaggctgctggctatttcttttcctcctcaagacccttcttcttggagggcactctctaatgctgtctctaccaaattaattttctctgcttcctcatagccactgctgcctcattacttcacagctcagacttgctctcatagtctcatttcaccttaagttctcagagctaaataccctgatggtatttttttctggtctcaactcccaagagaagaaatctgatagactcagctaattttttttggggggtgggggggtggactaggtcacataaaaagtcataagcccatctatcgattggttacctttctgtactcctgcccttcggtctaatcagctgtgcttggatggggtaggaatgactaggggttcaaaataggggggctctccaaggaagtgaaatcaggatctccaagagagatccacattctcatgctcattgcaacaccattcccaatagccagatatggaagcaacctaaatgtctgtcaacagatgaatggatgaagaaaatgtggggtatgtgtacatacacacacacacacacacacacacacacatatacacacatgtatatatatgtgtgtatacactgggatatcattcagcctttaaaaggaaggaaatcctggcatttacaacaacatggatgaacctggaggacattatgcaaagtgaaataagtcagatgcagaatgacaaatattgcatgatctcacttatatgtggaatctaaaatagctaaacataaaaacagagtaggatagcagttaccagggcctgagggggtggggaaggagaacatgttggttaaggggtacaaagcttcagttatacaaaatgaataatttctgaagatctgatgtacagcaatgtgactatagttaacattattgtattgtagacttgaaatttgctaaaagggcagatattaagtgttcttgccatatatacacagaaaaagaggcaactatgtgaggtgatatatatgttaatttgactgtggctaatattttatgacacatacatcaaatcaagttgtataccttaaatatacacaattttaactgtcaaatatacaataaaactagaaaaagaatagggcccctttataaccttttaagtggagactggagcacagaagatgcccttggatggggaaatcaccatcagtaaatacagttcatgctgagggtgatgggaagatacaggctgtggggtcaggccgcctgcctctgcctcttattggctgtaggaccttaggcacttatgttaaaagactgagctttattcactcacccataaaatggaaatattacaattacctacttaataagggtgctatgagagtgaaagggatgtacaaatgcttagcacagtgcctggtgcagaatccccacttaataaatgctggctattatcataatcccgttaatacattttattaataacaaattataattgcaataacaacttctccagagctaagcccaaattcgaagatgagttagtgctccaagtggccccacttaaccatgctggaatgaaagggaggagcagctgcatgtgtctgtcattcaaatcaatggggtaattctgtttttattgtgaacagacaaaagctgtgtcctcggctgggtccaaatgatgagattctttatgactaactgaggcagaggtgatattctcagaccttcctgaatgacccacacaaacacccaatggttcttggagcttaaggagtaacaatctgactgaggaagtcaccacaaatttcatgctctagtcccagtttcacgcccccttttctcgcatccagagtcttatttcccaaatttgctttccctgctctctctagaatgcattggatacttccattggaaatgtctaggtcagtacctaacatctggcatagctatctccaaatttgttggataattaaattctacccaagaactcaacaggggggtggcaaatgaatacctgagggcactgcctggctttggaaatttgagtgcatattatcactatttgtgtgtatttgtgagcacaaaagaattagtaagtgctcctgaagcatcatctcattccatctgttgtcaaagttcacattaagcaccaaatccaagggagcataatgagttatgtgaaaatgaacttgtgcttggaatttcagtatccccaggtgatgcaaataggcacatttcagcttgttctgaagaatcccaggctctgggacctgaacatatggtctaagttatttagccagataagacatgggatttcctacaagtagggttttgtcagcaggttggtaaacagtttttcctcagcttggacactccatatcatggtggggatgggataagtatatagtgaggtctttccataaaggacatgtttacaaaaaaggagatcaagcctttaacttgtgccccaaggctcagaagccagcactagttagttatgcaagtattttgaacccacaggacttctggggaattggaaggagtccaacctggctattagaactaagcttcggataaattttactcctgtcctcactatcaacattaataaaatgttcaaggagctggaaccagagccataaagaatgttcatgtcagagaaagcaggatacacagggacaagaggagtgaaattcagcttatgaattgttcccttcatatgctccaaatgctacttctctctccaaaacatgtttattccatagagcgcatgcctaatgccatccacacctaaatgctttacagctactattatttagctgaaattagaacactttttaagtattaggagatcaaatccccaggcaatttgtaatgcaaaatttccccacattttgtatttctcagtgctgcctgaaacccgacattagaactatgtaagccccagcaaatgcctcatgtcagggaatgttctaagagagtgctggggattatcagccacatttgttaactttagtacaatttagacacttttaaagataaaggtcattaatattttaacataacattaagtttaaattcagaactgagaactgttatgagaatctaaccagttttaattcggcatttaataaaatttatttatgttaaaagaaatactgggtatcaggagaaaaaaacacaatagaatgaatatttgaaaatattatattctagctaagtcatgcagctttatttaagtcatcattagcaggcctagcaagttaaatttttcaaagccctatgacatgtgcagctcctaaaaatataaggaaagcttagcccagtcaccctggggtaatggtaaggaatacaagaccaagttaggcatccctgggttaaagcctgccatttataaactatgtggtttttggcaaattattttgcatctctagaccttggtttttctatctgcaaagtagggagaaataacagtgcttgcttcatgtagttgttgtgaggaaatcaggtaataattatatagttaagctggttgggcacggtggctcatgcctgtaatcccagcactttgggaggccgaggcaggcagatcacaaggtcaggagataaagaccatcctggctaatacggtgaaaccccgtctctactagaaataaaaaaaattagacgggcgtggtggccagtgcctgtagtcccagctacttgggaggctgagggagaagaatcgcttgaacccgggaggtggaggttgcagcgagcagagatcatgccactgcactccagcctgggtgacagagggagactctgtctcaaaaaaaaaaaattatattatataattataattattgctaacatttattgagcactacttcctatgcactaggcattgttataggcattttaagatacattatttaatcctcacaataacccaatgaagtaggtactttcatctctgtttttaaagatgagaggaatccgatgcttagagaagaccagtgacttgctccaggtgtcactactagcatctggcagacccgggactggaacccaaggccatctgtgtacaaagtttgtagttctgttgcctgccctctcccctccatcccctctaaccctgctctgatccattgccttttaaattgactatattttcaataacaacataaacaccttgagagccagggttgtgacttgtcactcaataaatattcgccggatggattactgactcttctgatgttgtttagaaagacaaaatcagaatctgtttagaagcaatgaggagtcccttagaaagcttaaactgaagtgaggatggagactgtggattttctgatattattatatattagacatgaatctcttcaaactggaacaaaaactggtaaacagaataattgcaaaatatgtgccaatggccttgaaatcaaagaggagcaggtcgcctgaggagaagcatatgtttaatgcttcacactccatgatgagtcctggagaagaaatgaggctgggcagaaacaaggcagcctatgtggggttcacatccagaaatgaagaaaagcattctaataatttaatttgaggggaatataatttctcaaactccaagagttgcttcagccttcagaaaaaagctgttgggtcccaagatggcaccataaacaacggcaattctcctcctcaagctgtgaggtcagattttatgtgctgggaagagattaactttattgcaaggagaaggatttaattgcagagagtgattagccaaatgcttagatcaatagaatgcaggtcaaactgtgctcagaaatatccatggctcttattacatagaaagttgaggacacagaaaccatttggggaccctgagccatttgtgcatgaagtcatctgcaaacctttccctagaccgcagaagcatccttctctttacccagcaatgatggcatgctgactcaaggaacattcacccctccccccaactcttggcattagagaaagtcaataaaacagctgggatccttgaatgctgttttcaaaagtagagaaaggatcctgcctggtctagctctttgttgtctaattgcaacaaaaatcaatggttttgaaaatggaaagcagatagatcattcctcatttatccaagatatttgagcagaagatggagtgacattgtctaacatgctttaatttttgctctcaccaaagccctctttattcaatgagtctgtgtttgcactgttcttatgaagaaattcattgatagcaatggaatatggtaaagcagatgagcctgtagtacaaattgcaccctaggaaaaaaatggagtggtttaaaagtggtattttacgtaaatgataccttactggctaaccaggcatcccaacaagttgagactatgcagaggggatgtggcttaaggggaaggctgtgtttgccaactgggagctctaaatatgttgcttcacctgtgatctacacctgacaagcagaggccccaaattcccttaattatcggcagctcgatgagtctgacttcctagttcttatttatttcctagaatccaaatcacatgatggaaaagacctagaaaagtgtcaaatccctaccttggcgaataaagccaataaagaagtaacatcaagaaaaaggccaactctttcagaattttctgggaggcttgcagataacattttactcatcctgaaaatacatttgtgaatttggtggatgacaaaatgaactgagtgtgccactgaacatatgaagaagctagggagacagtgtgtgtgatgcgcacatacacacatgtgcacaagcagaaacacgcctttatgcaaggtcacctagagtcagtgatagggctatgaattgtgctaagtttcaatctctcccaccaagttgttttaagaaactgtgcatctcaggcctaccaaggaaatgtattcttctccctgatagtttgatgcttcatttccacctttcctaataagagctgtcattaattttaggttgcctaggactaaaacatacctccaggaaatagcttgtgtataacctttaaggtattgctcagcttgtaaaatgcctctagaatcttgcttgtaatataaaaaaaagaaaaaaaagaggtacctgactctttccattccttcatgcttttgctgcatggtctgctatgcagactgaccccaaagtccttataaagtcttatgttgttggccatcatcatatccagcctggagctttcccaacattaaaaatgaagcaacagaggtgctgtgatataatggaaggtactctgggagaagagtcagcatactggaatttttgctgcagcttaactagcagtcaccaaccaggatagtatgaatgagtggagtaatctctgcccttttttatccttggctgacaaatggaaaaaggacatgacagaatgtcgttttgcaaactgctgagtgtcatgtaatgcaagacactgccgccacctgaggaagtataaaagtgcccccgacaggggagcaggcaataggggaccttagttttagccttggctctacttctcattgtcccatgaccttaggtctacccctgtgggtctccatttccctatctgaaaaagagggtattggtcttatgacctaggtgctctgaaaccttgttaccctaagtatggatcctagactaggagcctttgggagacctgggggcctggcagaaatgcagaatcttggcctccacccagaccaactgaatctgaacttgcattttaacaagctcctcagatgatttgtttgtacatgaaagcttaagaatcactggtcttcaagatctcttccagatttttcattctataattatactataagtggtccagtgtagtgcactgtcacagaacatctatttcatgagacagtggcataacttgctattcatggctaaggaggcatggcagtatgtttttgcttataggtgtacttcagcacagtcacatgagaccagtcagttctggcagaggaaaagtttgtcttggttcttccctatctttttctctctgatcacaaagctcaccaacactgctatccagttgtgggtttagatatacaagatgatcatatttcatattaaaagataatgtcaaagttgctaagataataacttatgccaggcacagtattaagtactttcatatagacctcatttcatacttaaaacagccctgggagtaggttctattgttatgttcatttcacagatgagaaatgtggatcttggagatgtaacttgcccaaattccaagccagaacgtgacagagctgggatttgaatacagatctgactcacaccagagtatgtgcttaaccaccagggatatgccctctccaactccttggttaaacctcctggggtgccttctttttttttttttttttttttttttttttttttttttttgagaagacagttttgctcttgttgcccaggctggagtgcaatggcacgatctcagctcactgcaacctccgcctggtgggttcaagcaattctcctgcctcagcctcccaagtaggtgagattacatgtgcctaccaccacgcccagctaattttttgtatttttagtagagacagggtttcaccatgttggccaggctgttcttgaactcctgatctcaggtgatctgcctgcctcagcctcccaaagtgctaggattacagacgtgagccaccgcacccagctatcttctcttaaatattctcactccacctttgtgtcctcacatcattcttgctatttcaaacccagtcatacaatattttaggtttgtgccgtccaatgggttaatcagtagccacatacagtgattcaaatttaaattaaaaactcagtttcttatttgcactagatgacatttcaagggctcaacagtcacatgtgcctagcggctaccatgttgaatagcacagatatagaatatttccatcgtcagagcaagttctattgcatagtgttgttttagagaatccaattgctgaaaatcatcactctatcactggccttgttctgtgtttcactgcttctcagtattgaaagctctactgttaaatgcacacatttagaaaagatacctcagagccccattcactaagaggtaagaggctgtctggaaaggaagaactgaccaatcctgaatagccaacaaactgggagtcctaaaacttgaccctgacttcaagttcaaagacagcatcctagaagccggggctctggcgtgtgttgccagccttgccagccttggctctcatggttcactgtgacaactcctcatttctatcaggggaaagaaagtccaatcaggcaagttttatttcctctctgaaataaaacagaattgacttgccaaggtatctgcagggacatcaactgttgggccttaaattacctggtaactcttctagtcaattctactttcatgttggagtttgcaatcaacatttatctctataggacagaccgtctgcaggtttctaataccatttttattattaccttgtaaatgtaaaatcctcgaggcagaaatgccagctgctaacactggtgtgtgtgtgtgtgtgtgtgtgtgtgtgtgtgtgtgcgcgcgcacccacttctccagtgatgaatgtccttgggtcctggagtttccaacagcaacaaaaagacataccaaggacttgcctagaaattatgtattgtatggatccaatgtcaggggctttgggggcagctttctctagtagacctgctgagacagaatgaccttccctttctccgccagggtaaagccttctatgtggccgtcaggctttctgctttggaaattaaggcaaataatggagacagaaattcttggcaaatgctcacaagcagacacttcacaactgtctctctgacaggtattaataaataatagttatcatttattgaagcccaactttaatttctctgctaatttagaaattcatcaagtctctactagaatagttctgggtctcaaagagcagccaacccaatgaggaaggtaggtatttaatctagtaagcacccaaataaatgtatattgactaattataataatggctgggaatgaaaaaaataaggcactatggtagcaatgaagaaaggaggccttatttagagggagtggtcagagaagaccctctctgaggaaatgacgtatcagctaaaactggaaggacgaagcagctagcctgcagccagagcttagtaagcaaggagtgggccacgaggctgtgggcacacagagaccagatcttgcgaggtgagtcttggtaaggcgtttgctactaagaacaacgggaaatgattggagggtttgaggcagcaggctgacaagtgcttcatgtttttagaagatcactctagctaaagtgtgaagaatggattggaggttacatggagcagagagtggaagcagggagacccggtaggggctctgtctgtagtgcaggtgggaaatggcagtggcttagactcacatggtagtactggggatagagataagtgaagaaatctgtgagatatcttgggggagtacaaaaaaggacttgctagccaatctgttgtgtgggggtagagtaaggaaaatcagaaatcaaagatgactctcaagtttcaggcttgagaagctggtgggtagtggtgctgtgtgccagaactggttttgcattcataatttgcaagcctgacaattagccttgtgaaagtcaggtattgttactaacatctccctttacagattgtgtattagttcgttttcacactgctgataaagatatacctgagactgggcaatttacaaaacaaagaggcttaatggactcacagttccatgtggctggggaggcctcacaatcatggtggaaggtgaaagtcacgtctcatatggtggcgggcaagagaagacaatgagagccgagtgaaaggagtttcccgttataaaaccatcagattgcgtgagacttactcactaccatgaaaacagtatggagaaaaccacccccatgattcagttatattccgctgggtccatctcacaacaggaggcaattatgggagctacaattcaagatgagatttgggtagggacacagccaaaccataccagatgcggaaactcagatagagcaagtaatttgcccaaagtcacacagctggtgaatcgtccagccaggatttgaacgcttgtctatgagcaaagttcatgtatgctctttccttcaccttcactgcctcatgactgtgttttctcattcactgacttccagtctctatggctcctgtctttttttttctttttaatatatatattttttattatactttaagttctagggtacatgtgcacaatgtgtgggtttgttacatatgtatacatgtgccatgttggtgtgctgcacccattaactagtcatttacattaggtatatctcctaatgctatccgtcccccctccccccaccccacaacaggccccagtgtgtgatgttccccttcctgtgtccaagtgttctcattgttcaattcccacctatgagtgagaacatgcggtgtttggttttttgtccttgtgatagtttgccgagaatgatggtttttagatggagtcttgccctgtcgccacccaggctggagtgcaatggtgcgatctcagctcactgcaacctccgcctcccgggttcaagtaattctcctgcctcagcctcccgagtagctgggattacaggcatgtgccaccatgcctaatttttgcatttttagcagagacagggtttcaccatgttggccaggattgtcttgatctcttgaccttgtgatctgtccacctcggcctctgaaagtgctgggattacaggcgtgagccacggcgtccagccatatggctcctatctctattagtctatagtaagtgttttccttggctcatcactccgctgaaagtgtttcttttttggaaaaccttgtcccacatctccatctggctactccttcttgttccttagaatcttagatttggtttctattctcctgccatttgctatcctaatgcacattaaactttatagcaatttctttattaatcatttgatttttcccaatagactgtaagctctgtgaacataggatcaactatgtatttttttttttttttttttttgagaaggaatctcactctgttgcccaggctggagtgcagtggcgcgatctcggctcactgcaacctccacctcccgggttcaagcagttctcctgcctcagcctctcaagtagctgtgactacaggcgcccaccaccacgcccggctaattttttttttttttttttttcagtagagacggggtttcaccttgttagccaggatggtctcgatctcctgacctcgtgatctgcccgcctcggccacccaaagtgctgggattacaggtgtgagccaccgtgcccagccagaatcaactatgtattatctgtcactatcacactaaagcctggcactatgcctgacacactgttcattcatcacatctcgatgcatatttgctaaatgaactcctactcactggggaagttgagatacagacttgcccagtttaatctaagagatcaggagcctggattagtggtcttattggcatgctacagggaactgggcccaagagctctgagttaactttggacttttgtcactaactagttctgtgacgtgtggaagtttccattacctctctgaaccttagtttccctcttagctcaaaacagaggaaagtgaaacctggcactctgacctcatggggtgagaataaaatccaaatatatgtgaaacagcttgcaaaggtataagaactatacacatggatggtatctcatttgcctcaaaataacaaagtttctcttcagcatgaagattctggagcctagtagatctaaggaggcttcgttgtagtacttatctgtttgtttatgtttgggcaagttgtcttctctgaactgaactaatgaggataatagcactactactttcccaggcctcttctgaggactaagtaactctagtgatagcagtatatatatatatactgtatatatatacagtatatatatatatactgctatcactagagttacttagtcctcagaagagtatatatatatatatatatatatatatatatacactgctatcactagagttactttatatatatatatatatactgctatcactagagttacttagtcctcagaagagtatatatatatatatatatatatatatatatatacactgctatcactagagttactttatatatatatatatatatatactgctatcactagagttacttaatgtgtgtgtgtgtgtatatgtgtgtatatatatatatatatatatatatatatatatatacacacacatttccattataaaaccatcagattgtgtgagacttactcactaccatgagaacagtatggggaaaaccacccccatgattcagttatatcccgctgggtccctctcacaacaggagggaattatgggagctacaattcaagatgagatttgggtggggacacagccaaaccataccagatggggaaactcagatagagcaagtaatttgcccaaagtcacacatctggtgaatcatccagccaggacatatatatatctacatatacatatactatgaatgaagctatatatatagtgtgtgtgtgtatatatatgtatatatgctatatgtagagtatgaagcagtgcctagtgcataggaagcacctaataaatcttagccttttaataatcattaaaaaaaacccctctctttacacacaaacacacatacctcacataccaattcaacttctacaccaacaattttggagttacattatttggatgcatatttttgaaaatgtcactaagaataaatattacctcatgcccaacctcaggagcagcttcttcaagcacagttacctataaactttgtaccaaatagtatgcccctccaaaaccaacagacccttctttgtagaagtcaagtggaagcaacgcttagaggtatgaatcagtgtgtcgctcggttccatggagacaaatccaagtaggcactggcagctgtccgggtcctcagtgagctgaagcaggccacatggcaagataatttttaaagtttcttagcatcaataaaacacctcctttttaagagctccatctcttaattcaaagtcgaaaccttctattttccactgctctgctccgctgctatttcagttattagaacacctgctgtctgaacgagtttgcctcccaaatagccgaataatcaaaagatgaggagacttgcttaagcagcaggaaggaaaactggtgaaagaaagaaagggttgacaggcagcaagaggaggagaatccaggaataaatgggacagaaacggagagagcaagcaggaggagtcctggcaagatggcaacagtttagaccaggacaggaagtggcaagaacagagaagagacaacaccacactcaggagaaggcaggagaaaagggaagtaaaattgctaaaccctctcacttgaagaatatcagtaaggcagtggattgtggcagttaaagccatgacttcggacacatagaacagggactgaaaactgtgcatacaaagtatgcactcagtaaatgctttataatagattatgagcatcagaatgggggtaaaacactccctccccaaataaatactgaaggtagagaaaacagctaaaaaaaaaaaaaaaccctccatatcctatggtctttttttttctcttttttggggagacaatgttagttttctaatttgccatcttcttcaaacgctgctttcttcccttgtagctcttctacatgaaatccaaagatgacaggtccttatgttacagtaggtagctattcagaaatgagcagagtaggagaggcctcccctgcaacacacaccaggaatgtcaggagaccatcaggtgatggtcaggcagtgttaactgtctctctaaaataataattggtcatggccagtgccagggaaaggcacccaatagatgggaaagtctcccaacagacagaaacatctgaaactggtgatcagcagcttcctgataagatctcaggagttgggtgaatgggctcaagcatgcgcactaaggcaaaatggcagattacctccctctggaacactggattggtaaggggaaaagcacctcaagtgagcatgtatacaactttagtaaacacattgcacatgtggtcccccccaagtgctggcaggccactgctcatgcagacagcccaccccaagggaagaatcaggaaagaacataagaccccagaggtatgacaacatggaaaaaccccaagtcaaaagtcaaactgcgcacttgatctctcaagttgtctgcttggccctcttccaagtgcactttccttcctttcacccctgccttggtctctccttctgtcttatgcccctcagttgaattctttcttctgaggaggcaagaattgaggttgctgtagacctgtacagatttgcctctggtaacatactttggtgccacgtgactcagatacgttccgctgctaacacttacagtagaaggagacatggaagccatctatcctacttctgcagagctggaatctccttcatatcatccctgaaggatgtgcatgctggcactgcctacactagtctgctgggggaaatccaatgcttccagcaaggtccattctcttccttgtgaactggattatgaaagttcctcctcttaacaagccaaagcactctctgctgttaacatcatcactggtcttaagaccttctggagttaattacaaaacccggatttcctcttccaatgtatattcattcaacactcctgcacacactttcattgtatgcttattgagagcagagaggccatctgtcaggttaatttttatcttagcaggttgcacaatacttgacacacagtaggtgctcactaagcatctgaatgaataaatgatattcacagaatcaaaggatttagagtacctactaggggtggtaaactaaatgccttcaggagtgcacgcaagtgaaatacttaagaggaagggcgtggcttgtggctaattgaggagtgaatgttctgcctaaaggcatttgaattcaaattgtttagaagggttgattagctggacagacccttttactgttgggttgcagcctgcgggctcctggtttgtgactccattttaacctatccccacttttccacacacacacactttaggaatctgaatagtctcaattatattctttacaaatgctaactcatgctcagaacatccctaaggatagggaaagcaagatcatcaaaactgttcattatttaaaaatctattactttgagctgaaagctgctttgttgaaatttttcccaattgctcctagtcgtgccctttgagggtggcaaaacaaattgacttcttttctgtttgatttccctgcaaatatttgaagatattcaccactcctccaacctaagtctgctccagattaaagttctttcagccgttcctaatatcaagattatgaaacctccactatcttgaccactccactatatcaatattcccctccaaagtgtagtggcacacacttacagtattattaataatagtgggctcatgcctgtaatcctagcacttttggatgctgaggcaggaggctcgcttgagcccaggagtttgagaccagcctgggcaacaaagcgagactccatctctacaaaaaaattaaaaaattggctgggcatggcagcacaagcctgtaattttagctactagggaggctaggaggatgacttgagcccaggaggctgaggcggcagtgagccatgattgcactactgcactccactctgaacaacagagtgagactatctccaaaaacaacaatactgaaacattttggaaaagatccaaatatatgacaatagaaatttagtaaattttggtcatcttctataatagagtttatgcgcctattaaacattatgctaaagagcatagaaaaatatccatatcagaatattaaatgaaatcacattacaaaatgatgcattcaacatgatttcaattttatttaaaactgatttgagtaagtagaaaacttagcatgaagactgcattgtccaaaaattacttcaataatcaaataaaaacacaggttttttattaaacatgatttcagaaattaaaaatttaagattgtagctcctttaacattgaagagtcttttgtcagtttttaaagtcagagacccatatggaggagctgattccaaaatccatgttctaattccttatcccttctccccaagatttgaatacagtcagtttgggtggggcctgagcatatttttaaaaagactgtcaggtgattttgatgaataccagtggttaagaattaaactagacagatttctatcaatgctgtcaaacaacatataccttttcttggcagctgcatgactttttgacttcctcttggagttaaccaagaccctggaggcttgttgtgatgagcgttgctcttgagggctactcccctccctgtatgcaggcaggtggctttgtaaaacctcaggaaagatactggcattgatccccacacaattcatgttgctacatttggcccatcatctagagtgtcaagatctttcttttctgcctcctccttccagctgtgactcatcctaaaactcaatcagaatgacatttaaggtacttatgcaaatctcctctttcccaaggtaaacattcccaatgtcatcaaccagaaagcctaagacatttttctcttccccactgacttggacacctggcctagatgctcaccacttaggacagagatgctacctccatcccaccaccaccatttttaaaactttgatgataaatgtatttatatgcaaataaatttgcatatatttatagtgtacagtgtgatcttttaatatatgtgtgcattgtgaaatggtaaatcaggcaaattgatatttccgtcatctcacacaatttttttttattgtgagccttttcccttttaatgtagatcctggaacaggatttgaaaaggctccaatttgttgcataaaagtctctaactagggtttttaatgactaaagtaacataggcttgttgtaaaatatttttcaaaaatttatggaaactcgtaaaataaaagtctcccccatttccaagctcattttcccaaggcaatcactattcacaacttagtggtatgcgccactttacatctctcatctaggctcagtttcatttctttgaccaacggtcaaatatttctgccacccatttcataacaatttattctgatgccaatttaaaattatcaaatcagttcatgactctggctcccataaaacaccatcctcccatttgctcacactgctctgcaccaattccttttctccaaagtcatggatccctttccacctcatggccttgcctatgctgttttgtctgcctggcagggctgccctatgcccaaaccttaactttaagatcacttcttcagggcagccttccctgatcttgtaagactgggtcaggttatctcagcacagcctatgatgactccattacagaggagccatcctgctaggagtttatatactccttttgtgactatttgatcaaagtacgtctttcccgccaaattttaaactctacgagggcatggaaagctgtcttgatagctgctgtggccatagcacttagtactgtgtctggcacataagacagccaaacgatatttgttgaataattaatgaaataaattgcaaagacattcatctatgctaaaaaaaattcactgcaaaaaaaaaaaaatcacgaggatttttataatcccttcaacacaatctctgctccctctaacttggtggttgatgggcattttctcctcactcttattccatatgataagatgtccccatccctgccccaagatttataagccactgagctcttcttgaaaacatattgaagaaacatcaccaacattcaccccattgttccgagggaactcacatattttgagcaccttaccatgtgcgggttctatccccttgcatcttaagttatgtaattttctcagtgacccatgatatagtttcattttttctactttacagatgagaaatctgagacccagagagactaagtagcttggctaagatgatagaggaagtaatggtagggatttgacattaacaggttaatagaaaggatgctggcctggacatgaggagatgtgagttttagtctatcttcttccatgaattccttgggtaaccttgagccattactttaacctccaagttttgactccccgatgtaaagatagtgtctgaagaattggcacaaggcctgcaaaagtttctgaccaaggataaagtacagcatgctgtaaagatgatcattatgcctctttcccctaccctcaagaaccaacagatggccttctctgcatttgaaaatcaaacattcctaccaaggtcagttatgcctacaaatcagtgcaggctttcttctcgggcacaaaatctccagctgaaaatcagctctaattctttctcttgctcaggccttgctctgaataatatattttgaaaatgaactattttggggccaagaatctgtaaatctgagctgattcatcactttcaccaccaggctgctgctctcctgcatcttctgtgttgtgagataaagatgttttttcttcactaacagtttctcagtgggctacatggagagttctccttttgtcatgaaaagattctctgcaaaatactacaaaacctaaggatgagcacattctcaagaaatcatctggagtaaatagaacactggggtgggatgggagtatgcagagagagacacaaccacagaacagaagagctgaaatggaatacaacatggcacctctctttgaatgtggagatggcaaagtgtcaactcctgaccttcctaacaaaagaataaggaagtgaaaaaggtaattccagaaaatgtactatttaaaaactagctccatctagctttggaatagttatcgtttcctccataagatttagctttctatgtttttttgtatgaatgtatattaaaatgaatttgctttttttaaagaaattacagagatacccttaaaaacatgctaggcagatttgtcaaaaattaaaaatagaactaccacatggtccagcaatcccactacttggtatatatcccaaggaaaagaaatcagtatgtcaaagagatatctgcactcccatgtttactgcaactccattcacaatagccaagataagaattgaatgtataatacaatggagtactattcagccataaaaaatgaaattgtgtcatttgcagcaacatggatgagcccagaaaacattatgataagtcaaagccaggtacagaaagacaaataggcacacaatctcactcatatgtggaatctaaaaatgttgatctcagagaagtagagagtagaattgtggttaccagaaataggggattgggagaggttggtcaatgggtacaaagccagttagatgggaggaataagttctggtgttctgttgcacagaagggtgactatagttaacaataagatattgtaatttcaaaacatctagaagcaggaattttgagtgttctcaccacaaagaaatgatacatgtctgaggtgatatgttaattaccctcatttgattattatacattgtatacatgtatcaaaacatcacattgtacccatataggtacaataattttgtgtcaattaaacattaaaaaattttaaacacacaaaacaaaacaaaaaccatgctaggtaaaatggagcagccagttaaagaataaaagcaattggcatggattctcatttgtggataattgagaattggccaatagtttcccaggggcagaaaacactccttcagaaaacctcctgtgttcagtggaattttaaaatgcaatataaaagagcaatgtgatcacaaaagcacactactgcaatattatatataaaaaacgccatgctgtttggggatattttcttcccattactattcctctaggctatacctctactgagctctagaccatatttccaaatccacttgcaacactgatatctccatgtggaacgtcaggctgctcaaactcactgagtcctaaattgacctccgtctcctcccctctccaaatcttcctctgctgctactttcttcatttaagttcctaggactccatccgtcaaattgccaacctagagacacaggattcattctgagcacttctcagctgcaccattgacctagatagaagccctactaattctatctcaaaatatccctctcataaatctccttttccacgccatgccctctgcactgcgctagtcctgggccataccatctctcaccaagattagtgcatcgccttctaataggcctccctccttccatcattccgcctccttgacagtggtacattcagccacaccctggcttctcaccaggtcactcaccacacatcacacacaacacaaccttctcacatactaaaaaatatccacagagaaacacacacaatacacaatctccaacacctatatatatatccacagacaacacgtgcacatgcatgtgcttacacacatgtacaattgcacaaatcctcaaatacatcaacccacctgccatcccttaataccatactcttctctcccatttctagatgtctcttaaggctatttttatcttctgagacctcctttcttcactgtcataccacccattaatgcccccttgaagctctgatttatccttgtagatcaagctcaaagcatgagcccaccctcccatgaaacagctaagcatggctctcccttctctggttgtcacagcactttgtggatgtatatcacaatgtactaaggtttgctagccctgcctctaggcttagccctggagtcctaaaaagcagcagaacttaacagcacaggctttgggggcaaacagagttggggtgaaacctcagtcatctcttactagcttgggaaagtaaattccctaagcccccttttttctcacttcaaaaaaagataatagagttgaaattagaaataagtgaaaaaattctaactaacactcagttaagactcaataaaatggcaactattattaaaactatttagacctcatgtgcctagtactctgccaaaaaaaaaaaagcttaattacatgaatggatttaactttcagctggttcagtgtcataaaaagcatattcaagtatgatgccacattgtaaattcccatttatgcaaagtaagcaaaggaactactaatattcatattcacattttaccaatggcaaaatacacactgacaacgtaagtaactgtgttcagaacacacagtgaatccgtggcccaagtaagactagaactcagcctttgagtgttatttccgtgtaaaacattgtctcacatttcaaaaatgagtccatctaaaaatgatatagctgtccaatcctttgtactatgctgtgtagttttcctaaatatgcttattttacaagaaaagaaagttcgtaaaataacaaattggtaagatgccagaagaaggactggctcctcaatttagagcagagccttgcaaatgaggatgaacatttgaaagagcgatcttctggaaagcataactcagattacatcattttcttgcttctaagccctccagtgacttctccttgctctccaaataaaatcacccatcttttcatggcctccaagcctccatatggtctggatcctgcctaactctcataccactgttgtctgtttcagtcatcatactcaggttgcactggtcttctgtttctcatactctccacattcattactgctccagggcctttgcatttactattttctctccaggaagtcctcattccctaaattttcttcatttttggttttttttttttttttgctttttaggttgtcctgtcaagaatacttctccatctaatatatttgtttaccacccactctctatatccttaacttgtcctaatctctccataccatttatcaacatataaaattctcatttgctttgtgggttcttcctcccacagattattattagaaaagagagaaatcttgatcttgctcacttctttatgaccaacacatgaaacagtgattgatacatagtagatattcagtaaacatttgctaaatgaagaaataagcttcttttatcaccactaaagcaccaagataagtctttccgtgcctttgtcatctagatttatataacctccttaaaactaaaagcaatgcagtccccaaatttagaacttgtaggaagaagtgagcaaattgcaaacatcattcttacatccttgagaaaaaaagacttttgtttttctttatatttaaggaaagctgagtcttttggcaaaagggactgtttggagacactccctccatgtgaaccaaaaggttacacatgcttcttctccagtttggagctcagccccctgttctggtttcaatctggagatttcatctgacagcctgcatatcactacctatggtggacttgctctgtggccagagtttacttcttcttcttcttcttttttttgagatggagtcttgctctgtcgcccaggctggagtgcagtggcatgatctcgactcactgcaacctccacctcccaggttcactccattctcctgcctcagcctcctgagtagctgggactacaggcgcccaccacaaggcccgcctaattttttttatttttgatagagacggggtttcaccatgttagccaggatggtcttgatctcctgacctcgtgatctgccctcctcggcctctcaaattgctgggattacaggcgtgagccactgcacctggcccagagtttacttagacggcacaccacataacgagcagaacgtgcactgagatgggaagaacagattttccaagtagtttaatttcgagaattaacttaaaaattatctggtaacctcattcctaatgtcatagtgccacgtccactttaaagtttaaaatcttggaaatggattcaatcatccatgacaaacatatgttgttcttctcaagcagaagtataaaataattcttctccctaactttctgaattttccttttaataacttgaaaaaataacagcccttagtagcccacctgtgtgttaacagtgatttttgcaaaacatagccaaacagaagtccctgtttgcctcatttcaagttaatttgaaaaagaaaagttggctcaaccaaacttatgctgtaatggtccttgcttacaagtcagcaagtaccatctgaaagcttaggggtagcactccatttccctcctggatccctggtagtagatgtgcatgcaaagtgaatgcaggtacaaacaccaagtgctctcccaacaggtttccactgtcatcttcttcacttataagcagctaagccacaaattcccctctatcagatgtcacaggaagctacacaaagtaggatttgaaatgtatatatgtaattatgtcaaatctgatggcaacataatttactgaagagcagaaagcttattgaacatgaggctatttctattccaaaagcctagaacatagagtcagtctcatcctcccaacccagccttaaaaatcagatggagattcatgacatggaaagaatcacagggaagatgttcacattggtagtgagtttgcctcaatttgtgttcctcatgaccatctctagttttcaggccaataagggcagatactgctggtagagcagccatgttatatgatttccaatttgtgagttagctctttggctccctagggtaccttcaatagctatagaattagcatctattgcttttcatttggttcttatcatcacagaagagggttggccatacatagaatagttgagttttgggggaaagcattgggtaagaggaagggagtatgcactagaaaaagtagactcatgacacacactgtggtagagtggtaatttttgaaacgggctttaacagagatagaaagaaaactgtatgaaaactcttcataataattaattaagcctctcttagtcctaaattgagaaaaatgcaagaatcaatacttttttttttttttttgagatggggctgaagtgcagtggtgcaatctcggctcactgtaacctctgcctcctgggttcaaatgattcttccacctcagcctcctgagtagctgggattacaggtgcccaccaccacacctggctaattttttgtgtgtgtttttagtagagacagggcttcaccatgttggccaggcttgtcttgaactcctggcctcaagtgatccacccgccttagcctccccaaagttctgggattacaggcgtgagccaccgcacccagccaaaaatcaataattttaaatgtttcatacttattgacattaatgaaacctcctgaaaaagcatttaatgcaactccgctgatattttaaatttacgttcctcacattacaaggtcaggtcagttcccctgggtttcacagagccgacgttatcacatagacacgactttgttcatgctgtgtatggaacaacccttcagagggttgctgagctgtccatggtgctgggaaagcagctgtttctcctctttggttcagcaggagacacacattcagaaatgatgtgttatctcacagtgcagtggcccacacttccatgtttatttggaaaaagaaaacacatagtatctcctagtattctgctttcctaacaagctttgatttgtttaggctacctcaataaagtatctctttttactcttttacccttcagatattaacaaccacattgaggtacatgaatttgcacttgcttgcatttctatcattgcacttgcttgcatttctatttgtatcataagtgttttttctttccaaacagactataagtgtaagggttaaagaaatacttatggatggattgaaataactgaattcaaatttaggctcctccacctattagctgataacctggttgagtcaagttactttttctgcctcagtttctttaactgtaaaaagaggtgattgaaagccactaactttttggaagtgctgtagtttaaagtatgcagtgctatattttaaagtattttgcaaactgtgacatgctatgacagtgtgctatgacatgctatgaaagcaagcatttatcatgccactttttttgttgttggtatcacatgtagtaagatattcttgacagagcattaatagcattaataattgaagtttttgttgtctcctccaattcagaacaggcctatgggaatgaaggatccatctcatgccaggggaatcttatgagttatagatataagaagaatttcacttgaaagaaagtagagaagtgtagaagctgtaaaatttatatccggtaaataattcaaagattaatacccaaagtctcagtcatctctaggctcatcatcattgccacttcctcggtacttggcatttcttttttaaaaatgccccagtcatgatttaatctgaacacattctctttaaatgatctaggaataattaaatatcctgcccaacataataaagggtggcagagacaaaacttgacatcggattattctgaattcaaattctcaaccatcatgcctacagccttctaaatctaaatgagtcttctaggtataggttaaattaggagctggccaaaacttcttggatcccttattctgaagtagaaccttagagagcctaagtctagcattttagagaccaccctgaaaataagcttttttaggaggagggggataagggaaaatttgctttgtgaatctaacccaagataatcttcagtttccatgatgtaacaaaccagaggttgcacaagctgctggaatcacaagaacactaacttaccacctaccaatttaccaagtcagtatccatgaaccaactagaacttactttttgtgcagcataaagaaattcaattaaaatgcattctggtggcgttttcaaaactcagcaactttaataattacaccatttaaaaattgcatttagtgccattacttctcatccatttaaatcctccccattcttaaagatccagttgatattcccctccctccaagaacattcacagatggctccaacttacagtaatttaatctttctctgcatacatatcacttctgcctacaccatacatctgtcaacaaatcatctattgccctggaatatctgttttttaccttgctatctaacttatattaattggcttttcgaatctataccttatgttttcaaccttactggaacactagctcatcacaggtgctcaataaatatttgaactaaagttagcacttacattttattgaaactgcttaagtttctgcttcttccccattcttttcccccattttaagtccacaaaggtatggctactttttctgtcataatcaataccgtatccttgggaccaaggatatcataggggcttatgtgcatgcttggaataactacagtaataaaaatatgacctagctgaattgccagggaattaggagaaattttcaaatctctagttcaaggagataagctatgctcctaagtgaatttattttatttcagatgagaatcactttcaaagtaccattgggagatttgtgtttgtaaattctgttctcagctacaacaaaaaatgtagcacagaccatagatcaaggcatagagtaaggtaaaatacaatacgaataaaagggaaagagcacccagaacacatcggttattttcaaaatgtcttatgtaaagactgaggcattatgcttcagcacagagctgagaagaaatttgcatgaaccctttcaagagcttgcaagctgccttaactccatttatttatgtatttttcaggaatgtttattgtggtagatgttagggatagagaagtgaacaaaaccaatatagtcttgccctcatagaatccacattctaacaaaatgagaaaataaaggaaatttctcccattcatttatataataagtattgataaagtatcgactccatgcacagcattgggtttcactttcctggctttgctgctctgatattactgagggtagaagagatgacacaagcagttaatctgatttaataaatcctttaattctgtcggtaaatactgggaaggaaaggggatcatggagaaagagggcccagaaatagacattaagccctttttctgtcgtcttcctacactttagtaatattaagacagttccttgagaaagagagcaatctctgccttgctcaggggaaaaagaattgggagtctccatggcctagttgaagagagagagagagagagagagagacagagacagagacagagacagacaatcatgtacgctttctttcatggtggcgtcctggctgctgcaatagttgcaactcaaggaggttaggagcagccccctcctgcatgatcatgcattatcccatgaattctaccatccataatgcacattctctagttgaaggttttattttcccttttctttgttgtaatggaattttctattataccctaaaatattacttttactttttttaaaaaaaaaaaagacattctcttgctgtttcacatatagttcttagattaatactcagatccatttaacatcataaaagagaaacttctgtatcaatgaccaaatcagtgggtgagatctacaaactagaatcagggctggtgcattgctttcagaatgttccttatttatagacagcttaattgcattaagtgccaaagaatgtactgctttctttgtaatgagtttttatggtcttagtgttcagaagctcagattccatctgtgacagcagaatgttgtagaattcagctattaatagctgctggtacacacttactcagagctaagaggcccaaggctgtagagacagccagatggagataataccagagagtgactgtatggacaaaaaggatgatctttttccccccaacacaaaacagacaacactaaaaacatgacaatcctgttttattgcaagccaaactctctgaagaatttttttccccctctttggaattcttaggtctggttctaaatcacatttgatttatcactgtttctgatgttcaaataactccttacacaggttataaaaccaaaaacatccagatgagttaacaaccattatttagtaaaatgataccaagtaaccacacagaaaatcaggaataatacaatttggctattattcaaggaaaaataaactttgatacaggacagccttccgaatcaggaatattttccttaacatagagaagaacgggtaagtgagctgaataatacagacctttttatggaaagaaaaaattttttaaaaaaacctgcttaatgtgatttagagtgattatggctttagttcatctttattctaataagagtaagaaaattatactgcaagacaagggtgacatgaccaccatatttaatgtcattacattaatgaatgattcttatgggccaaagaacaccaactcttgttttttaaaaaattataatatcctgctaagtaaataagaaaaaaacctattttttaatctgtgactcattggtaaattgaatggctaaattatattttggtgggagtacaattgtaggttgccaaagaaatgtgggttatatgcttaagcatagaaatattaatgggcatgcttgtgtgcaatgaaaaatgatattaaaaaatgggtaagtgttcagcatattttgtttcatttgcaacatgagtaaaatcacattgttcttctgaagccaagcacagctaaaggcaagaggcacagataaggtggggctgtgatggggagcactctgctgtcatgctttaaggaagtttctggcaaacagagaatgtatgttaagtacctgcagtggcctatttcatagagacaccatataaagagtcctgcaaagcaaaactgacttatgtaaaagaggcgcaggttaaggtttcatacaggtgggtaagaaaaccaggatgtctcaaactatccaaagaatctaaagtctatccctacagacctccattttttcacgtaactacccctactttgtaggaaggacttttttttaagtaaaaaacaggcctaaaattttgataatctattttcattgcaggcaaattggctagtagtttaggttctagagtcacactcattgtgtttcatgtttgcctcttactagttgtgtaaacctgggcaagcttttgaagttggtaagcctgtattttctcagaggtaaaatagatattgtgagaatacctacatcataggattgtgaggattatgtaagatattctatgcaaaacatatagtacaatggctagtatacagtcaatgctcaatagatgtttcttttttattcttatttttgttatttatttacattttacttcattactgctatatgtaaagtgcttctaatattagagacatctgggtttgacttctggctgagaaaccatgatgaatcttcttcagtttactcatctgtcaaataaggctaatcatagatatgccataggaatgtgataagtaaactaaataatttaagccacacgtttaacacagtatctgacacaagctaatgcctataaaaaactagctgttaggatttcaatcgtagtcatatccactcaataaggttaatgtgacacttaaatgtgataatgtatataaagcccaaccaacagtacccgaaccttaaatgttacctcactcttcctgcatcttggttagccacctgcatgtatcacatagtatttttaaccaatagtatcttctgtatattggctttttttttttttgagatggagtctcactctgtcgcccaggctggagtatagtggcatgatcttggctcactgcaatccccgactcccgggttcaaacattcttggctaatttttgtatttttagtacagatgggattcaccatgttggctaggctggtcttgagctcctgacctcaagtgatccacccaccttggcctcccaaagtgctaggattgcaggtgtgagccattgcatccaacctctatatcagctttaatatttaccagtctccaagttcattaggtgacttgctaccatactatcatttcacaaagcgattgtggtacaattatgtactgcataacaatgtttcagtttatgatgaaccaatgtgtgatggtggtcccatgagattttaacagggctaaaaatattcctattgcctagtgatgttgcagccatcataatgccagagtgcaatgcattactcaggtgtttgtggtgatggtggtataaacaaacctactctgctgtcagttgtataaaagtagagcacataccgttatgtacagtatgtgatactcaatcatgataataaatgactatgttactcgttatgtatactatactttttatcattatttcagagtgtactccttctgcttataaaaaaaaagttaacctttattaaaaagtctctgggttgctgagcacagtggctcatgcctgtaatctcagcactttgggaggctgagacaggtggattacctaaggtaagaagtttgagaccagcctgggcaacatggcgaaaccccatctctactaaaaatacaaaaattagccgagtgtggtggcaggtgcctgtaagcccagctactcgggaggctgaggcaggagaatcacttgaacccggaagactgaggttgcagtgagccgagattgcggcactgcactccagcctgggggatagaatgagactccatctctcaaaaaaaaaaaaaaaaaaaaaaaaagcctctgggttgataggtacagcaaaccactatggcacacatttacctatgtaacaaacctgcacatcctgcacatgtacctcggaacttaaaataaaaaatttaaaaaagcatcaggttagccaggcgtggtggcacatgcctgtaatcccagctactcaggaggctgaggcaggagaatccttgaacctgggaggcggaggctgcagtgagccgagattgtgccagcttgggtgacactccagcttgggtgacagagtgagacttcgtctttgacaaaagaataagcctcaggcaagtccttcaggaggtattccagaggaaggcattgttattttaggtgatgacagctccatgcatcttattgcctttgaaggccttccagtgggacaacatgtggaggtggaagacagtgacattgataatcctgaccctgtgtaggcctaaggtaacatgtgttcttttgtttcttaaggtttaacaaacaagtttaaaaagtaaaacattaatgggaaagagcttatagaacaaggatatacagaaagataaaaattttgcatagttgtgtgtttgtgttttaagctaaatgttattacaaaacagtcaaaaagttaaaaaaattaaaaagtttataaagtaaaagttatagtcagctaagcttaacttattattgaagaaagacttttaaaaaataaatttagcatagcctaggtttacagtgtttatagcagtgtacaataatgtccttggccttcacattcactcactagtcagtgactcacccagaacaactttcagtcctgaaagctccattcatggtaagtgccctacacaagtaagtgtgccatttttaatctttttttttttttttttttttttttttttgagacagagtttcactcttattgcctgggctggagtgcagtgaagcgatgttggctcaccgcaacctccgcctcctgggttcaagtgattctcctgcctcagcctcccaagtagctgagattacaggtgcctgccaccacacccagctagtttttttgtatttttagtagagacagagtttcatattggccaggctggtcttgaactcctgaccttaggagatccacctgcctcggcctcccaaaatgctgggattacaggcatgagccactgtgcccggccatttttaatcatttatatcatatttttactatgctttttctatgttgagatacacaaatgcttaccattgtgttatgattgcctacactattcagaagagtaacatgctgtacaggtttatagtccaggagcaatagcctataccatatagcctaggtgtgcagtaggctataccaccccaggtttgtgtaagtacactctggtgttcacacaaggatgaaattgcctaatggcacacttctcagaacatatccctatcattaactgacgcatgactgtgtgtatattaatatcacaagccctttgcaaactagatagggaaggtatttcattctcattttcatgctttagttaatatcagagagccaccaacttaaaatatttccacatacttccagctgaaacttcacaggctgctttcattttttacttagtttctaacattatgatttctgaaatttccacattagctcatcacttcaaaatgcctttaatgccaatatatcaagcccatcatcaaacagatcatcttacatatttgtgcagtgtgtgaggctctaagtgaacactttctacaaagggaatttttatctacatccccaagtagaagagagattgtgctgtgctcctttccttctcatggaaggtttactaataatttcattgtcatctttaagcctttcactagtcacagcaagagtacatgcaaggatctaagcaaacaaagctcttaggctgccttgaaacaaaacctgtctgtaccatcatactaaattcccccagcctatttcaacactggcaatgaaaacatggcatttttcaccttgactttactttcaatgtgacaaggcagtgtctaacttcagggcattccgtggttatgaaatcttgacacctcacctactgtgggaatgacatgttgaaacagtttctccattctctgaggcattttcatattaagctctggtgaatgggtattaatgagatggtcattggagtgtcaggcgggccgtgtctcttctttttctgtctctctccccctgcccttccccatcccatcctcctcccccacccccagctgcacagctgacaacttcaaacatttaattactgatcccctcatcccctaacaatcaatagttggcatcccccaaaatcaaataatattcaatgtgcagagctgtatttgttttcacataacactgcagggaaattaaagataactcatcatgtgaatcaggttctctctttatgattaagaagtgactgccacttccatgcacatcctaggggttacctaacgtggctctaaaatgtccttggcaaatgttcttactgcttctccaattacattaaactatggattgtctaatgattctttggaaaaatatacttttatgataccttgaatgctaaaaaggattcttgttatttatgataaattacttatcttttaacaatagaaatagtaacatgtattgagggcatacaccatactagacaaggtcctaggtgctttatatacataatccatttcattctcatagtaagtccatggaggtaagtaccattattatttctcatgttttatgtagaggagaacaatgacattctgatagaatgggtgacttgactaaagttacaactagttagtggcagaactggaatttagaattgttctgtctgaaccaagaatcaaaagtcttaaacactcctttacactgcctttcttggcaagttgaattatatcaaatgacttttgttttggtttagctataaatatttcacttgtctcaactcatctagcacctttgtcattcaggttcagttatcaaggatcacaactctgattggtgctctgagtgataatgactacatttcccatatgaaaagtcatacatctttattatttttatgaaagttcagagtccttggattgtgttttgttgtttttttctttaagtttaggttctgggagtacacatgcaggtttgttacatgagtaaattgtgtgtgttgagacttgtcacccaagtagtgaggatagtacccactatgtagccttccaatccatgccctctttccatccttccccttcaagcagtcctcagtgtctatttttcccctcttttgtttccatgagtattcaatgtttagctccacttataagtaagaacatgcagtatttggttttctgttcctgcattagttggcttaggataatggcctctagctgcatccacattgccacaaaggacatgatttcattctttttttatggctgtattatattccagagtataaatgtaccacattttgttagtccagtccaccactgatgggcacctagattgattctgggtctttgctattatgaatagtcctgtgatgaacaaacaggtgcatggattgtgtgttaaaggtggatttcagaaatcataatgaaaaataatctcgaagatttatgaggatctattttttcacttgtagttatactgtagcagaaaaattttgatgacttaataataattcaatttaataataaacaatgtattatattgttttttcacttatattttgagggaaaatattaaaatatttcctcaaaaatacatcaagaaacatactgaaattatgaaatatggccaagttaaatcagaaatttcagggagtgttttgatttcccaatccaccactttatgaggaagcatagagcccacttcagcaggtcagttgacctgggccccaccctcatgaagcatgttgagttctagcaaacatgtacatctttggtttgtcacctgtccatactgaacttggggcggaaagatcactgcttcacacccctccttttcctcaggtttgccagtctcagagaattagaacactgcataaaaccttagaactcagtgtattccagctctcacagtctactgatgaagaaactgaagccaagaaaggtagccacagtgcctgggccagacagacccaggttccagagccagcccaaccatctcccactatcccacgcttcctctccagcttacactgtactgtacagatatcggtaaaggagtcatcatttgtaaataaggctggcaatgttccctcctcctaatgttgttaaccagaaactactttattgtaaagaaaacagatgctactaattctgcatcaaagacatcttggacattatgctaattagagcctaatgaagtgggttggcatcccagttccaccgatttaagctatgggaccaattatgaaactttccaaagcctgagttccattatttgtaagaaggtgatgataacaccaccaaccgcattgggttgttggtgatatatatatgtaataattcatatatctgacacataataaatattcaataaatattactttatcttatcattttgctaaattgtaacagaaaattccctataaggtcttcagagtaattctgcctactatgccctccccatgcagctgccaacaaatttattatagttggtatgtcactggttacgttttccaatgtttgaaaaaaattctacctcactccccatccttaccacacatatatcccccacctacttggagtataaactcctgggaaaccacttacaatgtacagtttggctgtggctcaccacactcttctcaaggctcttcagtattgggatggatggcaagaattgcatttattttctcacttcttttgtttaaggtgctgagtcagattaagagatggcactgtcccaaattgcaacgaactggactccacttgtattttgtaaagttgagctgacccggctcagctcctaaaagagtgctgtttgcctgcttttccgggatgaatactttagcaactgctgctctctgtgtctggactcacctttcagagagacagagactttgaggttctgtggctttgcctaatgaataacctggtctctgtcattttcaaaatgcaaacatttgtgggactctgagaactgttctttgtagaaacaagtcattgccaaagttcagagagatagctacagacacagatgtagtcttaggacatattgattagctttctggctagatcttttttaatgtaatgggcatactatcttggtgaaagaagttgactttttgacaatttgcagccatggaacttgccttctgcatcaaaatcattggaagattatgttcctctgaagttcctaatacctcagaaaacagctcctgtccatccattcatttcttcattcaacaaatatgtattgaacacttggttttaggtgctacgccaacaactagcagcaccaataatagtgataaatagtatcctggaagagtttaaaatttagaaggaaaaataatccacaagtacagacagttatgacttagggtgatttgatttaggatttttcaactttacgatgatgcaaaagtgatacacattcagtagaaaatgtacttcgagtatccacacgatcattgttttttcactttcagtacagtattcaataagttacatgagctattcgaactttaaaaataggctttgcatgagatgattttgtagtagatgagttgtagtttaatgtaagttgttctgagcccatttaaagtaagctaggcttagttatgattttcagaagattacgtgtattaaatgcattttttgacttaagatattttcaacttaatgatgggtttatcaggatacaaacctgtggtaagttgaagagcatctgtatagtatgttagttgtatgggggtgggagaagaaagtgatgtggctataaggtggcacagtgaagtgctgggacagcactgttcaatagaaataaaatgtgagacacatatgtggtttaaaattttctagcagccacattaaaaagtaaaaaaaggtaaaattaattttaataatacattttctcaaactcaagatatcgaaaataccatttccacatgtaatcaatatcaaaacattattgttgagatattttatatatttttttgtactaagtcttctaaatctggtgtgtattttacactttcagcatatctcaaatgaaatagcaacatttcacatgcacaagactcacatatcttctgatggctatcttgtcgaatagcacaattctaggaagttcaaaagggggaacaattgcttctcaaattgatgaaggtagagaagaatggtatcagagaaactgattaagcagggacctgggaatctgagttgagttccggggcatgtttgttccctagcaccatgacctacatggcagtgtctcttctcatactattttaagagtccctggtaagtaggttctgtgttcatattcctaacagtgagccccctatgcccctgtcctatggcgttaaagaaatctttatatgttgaatgaataaatgaaagaagaatttaaaaaatagttatctacagcttggtagaccctgtgttggtatttgcatatagtctctaatacttatattgtgacaaactttcaaggagctactaacatcaccattttataagagagaaatgtgaaatacagggtggttaggggatttcccaaggttacagacttagaaggaaggaagggaggccgggctcacacctgtaatgccagcactttgggaggccaaggtgggtagatctcttgaggtcaggagttcaagaccagcctggccaacatggtggatccctgtctctactaaaaatacaaaattagctgggcatgatggtgggtgcctgtaatcccagttacttcggaggctgaggcaggagaatcacttgaacctgggaggcggagattgcactgagctaagattgtgccactgcactcctgcccagaggacaaagtgagcctccatctcaaaaaaaaaaaaaagaaaaaaaagaaggaagggagagaagaatgggacagagttacataatgggaaggaaagcatacaaaaagaggaatgaggatagactagacagaagagtgagctacacaagtgagttaagaaagtgatatgctaacacattaatgattaataggtacgaatttgtccatcaaatcttaaatagttcctcatatattataccttggacctctcttctgtttcttctgacaaggttttcttgaaataagaaacaaaaacaaatgactgccttcccaaggcaaagggtattttgggaaatctgaagcagcgttagaggtttagcccagtcttcctcactacagcctcttcaacatttctgaaaagtgaatgtccatcctccctgtgagaaaaccatctcccaagacagtccctgccactctttgataggctgaacactagaaaattcgtccacatactgatttccaaccttcccttcttataacttccaattagaagcttgttctaattgtgccttcctaaatactcttcttcattcagatatcatgtgcctacctagtctattcgatcttgtgggggaggcaggaaggcaaacattacttatgcaatactcaagtcaaatacatatggattcaaactgagtcctaaaatgtatatgtggccgggtgcagtggctcctacctgtaaccccagcacttacggaggctgaagtaggcagatcacctgaggtcaggagtttgagaccagcctgggcaacgtggtgaaaccttgtctttactaaaaatacaaaattagccgggcatggtggcatgtgcctgtaatcccagctactcgggaggctggggcaggagaatcgcttgagcctgggagatggaggttgcagtgagctgagattgcgccattgtactccagcctgggtgatgagcgaaatcccatctcaaaaatatagtaaaatgtatatgcaatttccaaaaaattaaaaatcatgtttttgtgtcatctgggaggtaagtataagaaccagggcttggccctataaaatttaatattatctcatttttacttaagaaatggacttgctaaatctgctgaccatcccaaaaaatcatcagcaacttggagagtcagctttacattacaaacaagtctgaaaactggaatgataaaaaccatgatgaagttctaacttgctgacttcttggctgtgtttggacagccacaacttccctgcctttctaaaggggcagagaatagaatgcgaaatgtcaccatttctacaattttattcatccttctttccaaacatttatttttacttccttagggtatgaggaagagcatgttctaacacaattgttctgagttgttgccaggaagtcaagtgtatctttagcatcacctctgggcaaatagtacaaacagaggaaaatgatgtttgaggccaaatgttgaaaacttgagacttgtgtagctgagctaaaagagcagagagctaaaatgaaaagttaattatgttgattctgtttttttctatgagaatttctatttaaaggagcagcagtagtgaaaacaggatgggctttaagtaccaacagctttgggttcaaatgcaggcttgtcaattgctgcctgattgagttcccttgaatatacataacaaacatttaattgagtgactcctctgtgccaggcacgttgtccttacagagcttaaagtccaagtaagttaattaccccttggaatctttttttttacatcgaaaagaaaatataatactatatgcagggctcttataattaaatgaaatgacatatctaaagttataaagcccagtgcctagcatatagtagttgcttaataaatcttagtttcttttccttgtcttcagaataaccaaattaatctctcctttgagtcaaactgtgatttaaaagcacagccctagtacatcactaaaaataaaatcaacagacagttccacacatctagacactcctaaaatacccaaaggggtttggaggtccatcagctgtgacaggcagacttcaaaaaatcagactcagatactgccccattcaaatagttctattttgactccaatttgtttttatacaaaacaaaaataaactgcttttcattttaattaccagccagcaagtatagtatatgtagcatagaaatcaaagatataaatgatgctgcagtatcagaactgctcattctaaaacaatctattcattgtctgtaatgtgtgagacattgtgatggtattagactaataaaagaaacaaacacgtccttaatctgatagagcttactctgtaggaagggagatatacatctacctttagggaggctaaacaaagagatgaaacaagacaaatatgtattaaacattagtggccaatatgctgtattacaagcattaaattttgaactagagtctctaatgtagggattcaggagaggtaacaaagtcaaggagactttttgggaaaaaagtggaatttgagcctagacacttgaagcttatggaggattattcaatgccttctattattcctgtgcataaagatcaaatgcaccaaaactcaaagcagaagccagctataataatgccttctctttctgaatgcatgtagttctgcatgaactgcttcattattcactagtacaaattttacttgggtcccatctcatccaaaaggcagcattaactactcttgggtaaaaggtcattggtttttatatctttgtagagtttttaaagacgctgttcagtccaactagcttccactgcctcacatacacacaaaagaaagcaaagagaaataaaggaagagagggagaaaatgcactatttgcattttctgattgtgaaaattcctcattcctacctcccaaacttccctatgggcaagacgtaatcacaacccagacagtggatgcttcccctcttactacccagaaatgggagataaagaaaatgtggcacatatataccatggaatactatgcaaccattaaaaaggatgagttcatgtcctttgcagggacatagatgaagctggaaaccatcattctcagcaaactaacacaagaacagaaaaccaaacaccgcatgttctcacttataagtgggagttgaacaatgagaacacatgaacacaggaggggaacaatacacaccagggcctgttgggggttggggagctaggggagggatagcattaggagaaatacctaatatagatgacgggttgatgggtgcagcaaaccaccatggcacatgtatacctatgtaacaaacctgcacgttctgcacatgtatcccagaatttaaagtataatgaaaatataaagaaaaaagagatttgatatcagaaatcttttaaaattttaaattgtacttagactgggcaaacttcagaggtgagtactctgagacagggattcatccatactccctagccacatcactgtgaagccaaaacaaccacattccattcttggcatggaatacaacatcctccccttaaagtactgcacatttatcttcagctaagttgtgtacatttgttcactccaacctttaccttcttccatctgaagtgcttgatcagccactgaggaatcgacttcatgggaattcatagtccaaaattatatggcctgctgtacatttacagctttcttcaaattctccccgctatggagaggagccagagctttaatcaaattccttcccacccccacacatccccaaaagtataagagcctatattctaaatctaccacagtcaacttgctatttatttcatttccaaataaccatactctaaccataattcaagaaaaaggaaaaaaaaaagacatacttcaaaaaaatacctccatgcccttttttttttttttttttaaagttcagggttacatgtgcaggatgtgcaagttttttacatagaaaaacatgtgccgtgggggtttgttacatagattatttcatcacccaggtattaagcttggtatccattcattatttttcctggtcatctaattttacctctcctcctctggtaggccccagtgtgtgttgttcctctctatgtatccgtgtgttctcatcatttagctcccacttataagtgagaacatgccatatttggttttctgttcctgcatcagtttgctagggataacggcctccttatctgctaataacaactaaatactgttagaaggtttgtctctgacagtctcagttagtaaattatattaaaataattttgaaatgcagttttttttctgttctaatactttaaaattggctgggcgcggtggctcacgcctgtaatcccagaactttgggaggccgaggcgggtggatcacctcaggtcaggattttgagactagcctgaccaacatggagaaaccccatctctactaaaaatacaaaattagctggcgtgatggcgcatgcctgtaatcccagctcctcggaaggccgaggcaggagaatctcttgaacctgggaggcggaggttgcggtgagcccagatcgtgccattgcactccagcctgggcaatgagggcgaaactctgcctcaaaaaaactttaaaattatccagatgccagaatcagtgaataatgatcaatttgggtcttgattacatctttttttcagtatctaatgacactttgtgagtatcattgtagcctactgagcactatacaaggtgaagtacataaatccagacttggaagcttacaatcaaattgctttaccaataatgtataatataaaacaactccaccctctctttaccctgcagtgatagagtagataaggtttcaaatagccccaaagggaacttattcccaatgagcttagatcttattttatacattgctaaaataggggatttgtaacagattaatgtaggattagaatagtcacaggtgttctctcacaccagagaaaaaagtacaaattagatgatatcatctcactgtctattttggccacaaactaacccttcacttctcaaaccctcagtttattcttctataacttgggaatggttctacttgcttcttctatcttacagagttatcatgaccctgagataatgatttcaaaaatatactgaaaatgatggtttccaatttcatccatgtccctacaaaggacatgaactcatcattttttatggctgcatagtattccatggtgtatatgtgccacattttcttaatccagtctatcattgttggacatttgggttggttccaagtctttgttattgtgaatagtgccgcaataaacatacgtgtgcatgtgtctttatagcagcatgatttatagtcctttgtgtatatacccagtaatgggatggctgggtcaaatggtatttctagttctagatccctgaggaatcgccacactgacttccacaatggttgaactagtttacagtcccaccaacagtgtaaaatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggcgggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaacattaaaaaaaaatatatactgaaacatccaaaatgccagacaaataaaaggctgtcttctctcctagcttccttggattcttgctctttctccacctacacaaactgttggcaggaccctcagcaagatgtcatcatgcacctgtgagcattcatttcaagaacagccaaccatttatctggaaaatcagaaaccacagatagggcagaagacctgcatgcccggatccattctgtgcaatttagttttttgaaaacaaatttaagattccatgcagaaagcaccctgaacactgaaagtatgcacttcctttacaaagagcagctcaacaaagccagctgggtttagcaaccccatttctttctttctttccagcactttgcatctatagatcaatatgttgtcattccagaactttcactaccttattctatctttctctcaataacctgtgaggttgcagaactttcttccaactttcacttattgcatttttacctttagcctacacagtgacctgaggtcaaggcagtcttcctaatcaagaagccccttcccctaaagctctgtagatttcagagcccttagaataacattccaactccattccacggcttacaaagtccatgagatcccacttttggccacttcttcatctcacaccactttctccttccctcaccagctttcagccatgttcactttttgattctttgcatatgcgacaagcctcagggctcttggacatgctgtttcttctacttgattagctttcccaccaattcttgtatggctggctcattgtcattctttatctcccagcttatgtcatctcaactgaaatcatctaaagccatctcatcattatccagtatctcaacctctcttttgttttcatcatagcataatttatgactatttcttttcttttccttttcttttttttgtttttttttgagatggagtctcactctgttgcccaggctggagtgcagtggcacactcttggctcactgcaagctccgcctcccaggttcatgcctggctaaatttttttttgcacttttagtagagacggggtttcaccgtgttagccaggatggtcttgatctcctgacctcgtgatccgcccgcctcggcctcctaaagtgttgggattacaggcgtgagccaccacacctggccaatttatgactatttcattttctgttttattcatgtctcctccataaaggtgtaagctgaagaacagacactgtgcgtggtcagctcatgattagagctccagtgtgtgaaccatcactcatgctaacatagttgatgctccatgaccatacagtgagtgcgtgaaaaatatacatggagtgaaataggcaatttgagtatgtacactaaattctgtttcccatgtgcatgtactagaataggaatgttgattaacttgttttgaaaaagaattcctccagcaagtgtaaatctaaactatttttgactaactttgggagctccagacctgtactgtgcaacacagtagccactaaccacgggccactattgctcacttgaaatgacaccagtctgaattcaatgtgctgtaagagtaaaatatacactgagttctgaagacaacatgagaaaaagaatgtaacatctcataattgtcattttgattacatattaaaataatatttttgatacattggattaaaatattaaaattaattttatctggccaggtgcagtggctcacgcctgtaaacccagcactttgggaggctgaggtgagtggactgcttgagcccaggagttcgtgaccagcctgggcaacaaggcaaaacccgtctctacaagaaatacaaaaattagctgggcatggtggtgtgcacctgtaatcctagctactcaggaggctgaggcaggagagtcacttgaacctgggaggcagaggttgcagtgagccaagattgcgccaccacactccagcctgggcgacagagtgagactccatttcaaaaaataataatagtaaaagtcaggcacagtggctcacgcctgtaatcccagcactttgggaggccgagacgggtggatcatgaggtcaggagtttgagaccagcctgaccaacatggtgaaaccccgtctctactaaaaatacaaaaatcagctgggcatggtggcacgtgcctgcaaccccagctactcaggaggctgaggcaggagaatcgcttgaacctgggaggtggaggttgcagtgagcctagatcttgccactgcactcgagcctgggcaacagagagagactctgtctcaaaaaaaaaaattaattttatctgtattctttattttttttaaaagtagctactaaaaaattaaaattacatatgtggcttatgttagatctcttggaatgatgctggtctagaatattcctctattctctcatcatttcagagttaatctgattttaatgcttatgactttttcttaaacctgcctataatggtatatattgagagtgaaaaatatttagaagtctcaaagccactgccttaaattcttatgttattctacagtattcttatctcatgcagatcttagaacattgttcaagtatcataaactataatacatcagactatgggtgggaaaacatcttcatataattttagaatcattatttacactactgttcaaatcctttaattctacttccagagctactaccatcatctaggccaccgtaatctctcaactgatctgtatgactgaagtaacttcctaactggtcttctacctctatctcattgttttccaacaatagacagtgtaaaagtcttacatgctgccttcttgcttgacctgcctgtagttgtccactaaccccaggataaagttcaaatcttcaattcagcctttaattcctgacataatagacttacttcctcctcttgcctacttcctcctcctcttaggctcctcacaccagtcattctgaactccactgttctgtaaaggtgccatgcttcttttggtttttggattttgctccttttacagaacccacatccattactctccttttatctggtcaacttctactctattctcagcttaaggttagaagcagcaggtgtgtctggtacataggtgcctgccttgcaagggaaagcatctcctggcctccaggaacccaccacagggcttgtgctctgttggtggtggatgtagaacacaagccacatgcccaaacctaggcgtgcactaagcactctccacaattctgccactgaatcctcaccacaaacctgtgagcagacagcagcagcagcatttaagtcctgtgtgccaagacttgtttcaagtactttaaatatattttctcaggcttcaggaaaactccctaaggtaggtatttactgttttcctattatattattctcttattatccaattcattgatggggaactaaagcccagatggatttagtaaatcacccagccccatagcaggggatacgagctcctgcggcttggcttggcagcctatgttgacttgtgcaggtgttatcaccattttagagatgaggaaacaaaagctcagcaagtttagggaattttcccaaagtcaccatatcaggatttaaaagacaagttagatgccacatcatgtttttcccaatagctgtccatactccgtcattttacctgcgttacagtcgcctaccaacttactggctccccctactagactgtatgtttcttattctttagttttttttatcttattaacagattttatttttaaaaatagatttagattgacagaaaaatggaacagatagtacagagagctcttctatacctcttgcaggatttctcctattgtgaatatcttatgttagtgtggtacgtttttataagtaatgaagcaatattggtatgtaatcattaaccaaagtccatagttcattcagatttgcttaattttctaatgtcctttttctactctaggatcctacccaggatagtacattacagttagttgtcatggctcctcaggctccttgaggctgtggcagtttctcagacttaccttacctttgatgatcttgacagttttgaggaatagcagtaaggtatactgtaggatgctcctccagtggaatttatttgatgtttttctcgtgattgaagaccacagagataaagtgccatttccatcctatcacatcaatcaaaggtacctatatcaacatgccttattttcatgttggacttgatcacctggctgaagaaatgtttgtcaggtttctccactgtaaagttactcccctctcctccaaactgtactctgcacccttagaaagaagtcatgatgtacagctcacccttaaggcttagggagctatgccaacttgctgtcttccttgagggtatgttatctgcacaatttatctggagttctgcatgggagattttctcctcctctcctatttattcaattatttacttataccagtatgaatttatgcatattgattttatactttgggatagaattcaatgctatattttattgctcggattgttccactttggccattaggagctcttccagttgatttcggtgtccttttgacatacctccatcagtgcaggcttttttccttttttttcagtacttctttactttctggttctataagaggctccagactcatatacttcctttgctactagtagcatcagacatttcttcaagaattcctggttccttttattaaagaatggttttagaaatcaagatctgggtgctagttgctactgggatgccatttcttttaggccctctcagctgacacagaaagaaatatatgtgtgcatataaccctatgtatatctacataaatatttctatatgtagtcacttgtgaatatataaagttaagcaggggttcttgttgatgtctctaactttaattcattaccacatgtagcattctaacatcctcctcttgcttatctgtaaattctcactccactagtgagaaatgactgtaagcttcttaaaggcagaattagtgctttaatcactgctgtatcccaagtatagtgcttggcacatataatgtacatgttgacttactgttgaatttactccataatctcaattctggaagggactacagataaatttgcaaatgttacaaaatacggatttcaaagactaaaatcacaacaatttattagggcaaacagtacaagagggtgcactaacaaaggtctgatttaagtgcttttattcaacccagtgaagggaaaatgacagtaatacatctaagccatgcaaaaaggattcaggcttccttgaaaaggattcaagtggcataaaatggtttgtttctccacagcaatttacatttattaaaatagataataggcataatcattgtcaaaatagagcttctaccctgtataatatcttaatacatcctcgaagttcctgacaaacaggcacaaagccatggcagattagagtctaagtggaggatcactccaatagcacagcagaaaaaccaatctcacacttctaggaaggaaaataagacctgagaacagcctttgaaggtggagggtaaagtacaaagggaaaggtgctaaagtgatgcatcagctggaagtataactgggctctaatgtgacactctgcattaacgatgctaatttatgtctgggtaagcgtgtgtgggtgacacagaggaatttgaagaggtctatattataccatgggggagctcatcttgaatcttttgccagggtacatgctttatgcagggactgcttcacgtgggcatatattatgtacattttgtgtcagtttcatctgagtaaatcacgtgtctctttagatctattctagaccctttccaatctattctttgcactgcagccagaatagtatttttgaaaagcaaacttggtcactttccccaatcttccctacatttaagcatttaaatggcttcctgttactcataagataaaaagcaaaaatggctcatatatttttgcaagactctgcaagatgtggcttctgtctaatgtccatcctgtgggaacttaagccacactggccacctttcactttttgaacacacactctctctactgctactaccataaagcccttgtacatgcagttctccctgcctgggtcatcttcccatctcctcttcaacagagctaactcttattatgactttcggatttagcaattattctttcaccagggaagccttccctgtctaggtccaataatcctcttattacacactctcagagtactactaactccttcagagtgcttgtcacggttgcaattgtacatttatctttattattctttattaatatatttccccagagggtcttgtcactccatattcctggtatctaaccccatagctggtatacaataagtgcccaataaacacctatcaagtaaatgtctgaaaaatgaccacgcaatctatccatactgctgtaaagactttctagaatattaaagtcctctttggattcagaagaatatgtcacttcacataataaatttgattggtcaccccaaggatgagtaaataaacatcactgccaggtttggtagtttccaaataaacatgaggtcctttttatcatatcgaaatgaatattattcaatattacatagaagtggacataagaggacatgaagaaacaatctcatgcagtaaaggttcacaatggtgccaatcatctcctaatcctgtccctcagagatctgtttattaagtaatttttctttatttcacaatatctcaaatgctactattgggctcaagctctcatcattggccttggatttcattcaacatttaacaaatatttactgagcatatttactagattccaggcactgtgttagagcctgggatacacactaggcaagagagacaggtgctcaccttcaagaagagaggataaccaacacacaaatgagtaaataaaatgattgctgattgctattagtgctaacaaggaaagagatcctgttccatgtgagtgagatcatgcccattgcttcatcatgattgtaagtgatccaaatgcctcactgggataacctgcatcattattgcttcgtggtaccaggtagatcacagtcttttctttttacttgatgaaggagtaaagaattttctgttttaatgccatggtttcctataagaatttaaatatactcactttctcaaattaaataagtgtaggcaaaacacaaggtataccttttctaaggagtcactataacacctcaaaatctctattgtcagctttgatgcaccccaaaagatcaaagtgccttgctctttaagatgcatatctcaacagagcagctgtttcatttcaagagagtcttcattttttttttagtgataagtttacaagcagttgttagtggtacagaaaatcttacgacatctgtggagaagttgtaaatttttcagattgggttaggattctcttgataatcattaaaatccttgaggtctaggatagcatttggagcataatttgacctcaattatgtgttaaatgtttgctgaagaaatggtgatgctttgagaaaattagctatttgaagcatgagaccagagtggagctgaaagaaaaaaattaaaattaaagtggctcacttatcaaaaaccaaagccacagagaaaggggaccaataacagcatcctcttcattccattttgattaaggctgcaggcttatgaggggacaggaagctgggagaatctcaagaaaagaaaatgcagtccctaaatgccacagctcaagaggaatgctccagcctactgtctccaatggagaagaacaatctgcagattgacaaagccctctgtttacactcctgaacaaataaactaatcatgcctttgtttttaacctaacaaatcatagcctgattacaggtcattagtgaccattaatatgtgaaactgtttgcatttcactagtatatctgaataacagtcttgcctttcacactagctcagtcaagtttccaaaaggaaagccccgttatcaggccacgagcaggacttaaattaacaattagcctctagaatcgaactatgatgcagaagaattcattattttggttcattgtggttccgcctactgtagaaccagtctttgcctttgtagtggagacatgctctttgtgccaaaagattgtgtgaccacctctctccaaacattctcaacaattcccaatgactgctaatgtgttggccagcaacatgaacctgcttatgtgacaatagtatagacggtcctaagttcacaatacgatggctgattagagtacagataaatgcagggagcacattgggaattatcagaaacatagaagtgacaggaaaaaggtctatttgacaaaaaagcggaggcagagtagagagtatgtatacctgagtgaacctgataatctagaatttttaaaagtgcaattagagctttggattatcagcattaagaggcaagattcttcaaaggaattggataattgccaagcctccatttcattttgtgctgagcagtcgtcacagaggggcatggagtgattaacagagattaaagatctcaggaatgtttgagaactttctaacatagcagttgccatttaggagcaaacccatggtccaacttatctaatgttctgttgcttcaaaaaaatgtcccctaggaaatgccacttttgactactaatgtgttgaggccatagaattagaggcattgctaacaaatcaagaaatggcagcccatatattgctgcaatcatttttactttttattctggactagctaccaaccacgtgattcatgccccagtttaaaatgcataatgatagtatagagttccatgtagtttaaaaagtccttttaatccattatcctgctcatctctatatcagcttatgaaagttagattatgaatagtatagtaatggtgcaaaacacaggttctaagttaaacttgtctgttttcaaatcctggcttttctactgctaataaggtgactttgagcaaatttcttaacctttctgagcttctttttgcttatctgtgaaacagataataatgatgcctacctcaaaaggtgatttcaaaaccctaattgagtaactaatgcatgtaaagggcttagtacactacatggcacataattagtgctcaataaatattaactgctatcattttttttttccaccagcagcagtatccactatggccaccatctccatcttccacagaataaggaaaataaaatatctacgatagactttttcctgaagtcacccaattactaaataactgaggtgggactaaccatcatcttgactaccattctccctgcttggaatacttttcattcttcttccctcctcctcatccttcaggtctcagtttagccatctgcttcctcatgagccctgctctgagccctcttatgtcatttcacattctcttgtacttcctccatcagagaacctctcattctgcattataattgcctgttgtcctgtatgtgtcccctactaaaccacaggttccttaacagtagagaccaggtctatatactaaacctttgcatccccagcaccgagtacagcaccagacacatagtaagtgcacaataaatacttaataagtaaaaggatggatgccagactcttcattcccaatctgctgacacacattaaattattatttcacactggaatggattttagaaaatcagagagagccctacaaggcttcatgtcttatactgctcttaaataatcataatctcatgtcagaaattcaaggcaatttttaaaatacataatatgttacatatttatggggtacatgtgatattttattacatgcatagaatgtataatgatcaagttatggtattcgggttatttatcaccttgagtatttattatttctatgtgttggggacatttcaaattctctcttctggcttctttgaaatatgcaatacattgttgctaactacagtcactgtactctgctatcaaacattagaatttataccttttatctaaccgtatatttgtacccattgaccaacctcttttcatcaaggcagtcttaaccagattctaatagattcaatttctgaagaaagtaactaaacttgtgaaaatgacaccttgaagtgattcttacattatattaaaacacaagcacgtgtgtatagacacacactcaccttgtacctcacactgatcgctaagctgtgcacaatacttatatagtcaccaaccctccaaatttggagaagggcactgtctttgtactttgaagggatttttcagaaacatttggacttgatgaggcacagtgaaaagcaggtatttatcctggctattcttcacgacaagctcttaaaatttggactctgaactgtctctcgcagtttttatgtttttagaaattttgagtctgatatgacacaagtcgtaaaatttgaccaaataacaaaatacttccattttttttctccctccatcttggaggaggaatagggggcataaaagttggaagctccagggaaatccactcaaagctattcagtttcatctcattaaagtaacatcatcaagggcaaaccaaataaaactcaaacccccaatcaatattatattagaatgcactgaaagtgttacttagttggtaggaaggaaaaaaaatcgtacattgaaattacaacagatgtaagccttttattcaaatagaccagagagcaaaaggtaatttttcaatagcaagggaagagctgaactctacctcacatcaccaacactatttaaaagcaaaacctgctcttattattttatataaaaacacatttaaaaatatcacctgcatggagtctctataaatgcataatgctaacattgcatagttcccttaggacacaaatgcctcacacatctttatccatagtctgatggagaatattcacaaacatatatgcatacagacacaaacacagtatacatacacatacacacatacctgctttttgttttcttccctttttgaactgtgaccaccttttaaattttattagctctatgataaaatatttatctagagcctttttccctcttcgttccttttattaaagggagctcttctcttctgaatgttgtactctttgatctctctcagggttcatacaaactctgttacaaactccacctctaaagagaatctctgatgattctctttcttaaatcaaaatacagttcttttgtattaaattttattttccattatcccaaaatatagccaaatgtggaggctgtaaagctaaagcctcaccacacactgtatcgagaaatgaataaaaaagcctagcagaagccttcatgctacttcatccaaatcaagtgtaactacttaggagttaataatgaaagggctttagaatatttgatacaggtgagaagttgtttttcctacacagtgatttctagatctattttctcattggaaattacctgttcagtgataccttttattcttcgttatattcaaagtaagatgcccatattgtctttctttgcctcttgaccccaagctctttttctttgtgtcttgaccccaagctctttttctttgtttgagcagttaatatatctactttgttctctagcttattcaacaaacctaacatcaataaagcaggctctattcttgtttagccaacactctctctcctggtaattttataaccagttatatcatccccatgtacatttggtcaaaatatgttcttgttcttaaaacagtaaatcaaactatgcttcctatgtacaataactatttaaaaaatgtaaattaacttgtgtcctacggaacaaattttaagcaactggaactatttaaaaaatgtaaattaacttgtgtcccacggaacaaattttaagcaattggaactatttaacacttctatactgctactttatcaagaagagtaggtataaataataatacgaatacctttatttccataggtgttttcatctggataattcatgcttcattattgggccactattctctgtcttgggttctcccttggctcctgtgacaaacatggggttcagatccagactccaggaggtagtgatgcttcaacttttggtaacatacaggtgcatttacatactttccacataccccctaccatctctttgggagagtttgctccaggcctgtcaaaatccaggctaacaaggtaacacaatcaacactgtaaaagcttccttgcctcagccccgtcgacctgaagtggactgcctactcacttgagaagacagacagagagccacggtctcaaagtgttgctcctgatcatcatcagcagcagtaggattacctgggaaactgaaaaaatcaaactcacaggcctatagacctattctaagcttgagggggtggagcctggaaccttgtatttaacaaatacttcaggtgattctaatgcacgttaaagtttgaaaacagctgctgtatgacctctagggagttttgaagaggctgtagtgatcaggagagctggcttcatatagccaaagtagggtcctgtggacaggatactcagcgtttggggtagggttttatggtgcagggctaggagcagtgggtgaaagagaatgctctggtgcagaacaacttctatgcaataggaactattcaggagcagaagtaagtcacctcactcgttagaaatggccccatttctctgcaagcgttcagaagtatgaggttatatcctacgagaaactatgaaaaaggtgatataagaagaaatattcaaaataaacgtgtaagattaaaaaaaattaggccttaatgggaagcttcaacataccactaatatagaacaaaaggttcataattagtccattattgttaattttttagtatcttaaatttattatccttaaatatcctgctgatggtgcatggagtagataatgagttttagtttcctcaatgtttcatttcatattcagaaaaagaatccaacctaacagattatttaaaagagataaaatcaccaccagccagtactgatactggatcaaagattaaggttagtgtattaacttatttgtcctctgttttgtaatcaaaacaactgtcttctaacggtaatatcttaagacatatacataactgtactaatttttttttttttttgagatggagttttgctcttgttgcccaggctggagtgcaatggcacgatctcggctcattgcaacctccgcctcccaggttcaagcaattctcctgcctcagcctccctagtagctgggattacaggcatgtgccaccacacctggctaactttgtatttttagtagagacagggtttctccatgttggtcaggctggtctcgaactcccgacctcaggtgatccgcctgcctttggcctcccaaagtgctgggattacaggcataagccaccatgcccagccaactgtactaacattaataaaaatacagcttaacatttagcaattactacctactattttcctgggactgtcatgagcacattacaggcaccgtcacttttaatacttacaatagccttatgaggttaagcattgttatctttattttacagatgaggcacctgggcttagagaggttaaataacttgcccaaggactagcaagtggtggagccaggatacaaacccagtcatctccagagtctgttttcttgactacttttttcatataattctaaactctagggttgggagggtaaaaatgtatgtggtccagtgcaaataatacttatgaccacttaagtcttctaaaactactaaaaacaaccaactactcactgaatgtttaatctgtgtcagggactgaactagccatgtacaagtattatctcacttaatcctcacaacaaccatggaaagtagttactactattgtcttaactttacataggggcaactgcagttagaggatttaagtaatgagcccatcttcttatcaaagatttcactgcttacataataaaatggaaatgaggcaaaaaaaatacacacagtactcagtaaatgttgtttactagtcactagtaaattagtgactagtttctggggatcagaatggtgttggtgatgatcaatccattgtttttcttacctattttcttgctcattccaaatggtagatatctgtgagttagatacttgagcgcaatatacagccatgacataaaagtaaatccactggcttctctatgtctttattatcaccaaaccctagtgctttaaggcttgcaccactgtccaggaatgtggttccagagactcttccacttggcaagagtaacaatgagtgactttaggaatgagacacaacccatgcccaagccccaaaatcaaaggtgtaaagcacaccaagttgttccacccaaagaaccttgttctaaaaatgttagtggtcagtgtcttacagagagtcagcaagcagatgcacttttttccaagactataagatttcatctagttgggagtttattgatttatctgatattccaatatcatagaaagagctcggttttatgaatcagtctctaaacctcagtcttttctccaccataaactaggtatgtgatcatagacaagttgattaactccactggatctcagttttctcactgaaaaaatgagaataaaggaaatttactctttatatttgttgagcagagtagataagagctgtgaaaatgctttgcagaaatacaaaacccctcccacaagtataagatgacattactattttacataactccttccttgcctaatatttagctgctaatgtatcaacctgtttggagaagttggtttattgaagaactaatttaaaagcaagaggaaggggcaattcttaagagttgaaaactatcagcagtgccaaagacaactgaattgtttgatcagttgttttgatggttaagagggagtaagatatttattacctgggtaaccaaataatgtgcatgttgcaaacccctgtgacatgcagcttatctatctaacaatcctacacatgtacttctaaacctaaaataaaagttttaaaaaaagagggagtcaagagccagtaagcgtggcaaaccccccagataagttcatgttggtatgaaatagcctgagaaacctttctgtgaaagcaacaaggaatatcacaaaactaccatgtaaatgaacaggacataaatagcagctcaacaacatgggctctttgggtttctattcaaatttcaaggtgccaagtctcttgcttgtctacatcagagagtagaacgtggcctatgtatagattagaacatcagggaaaggaggtagtatgaaggacagttttgtgtagggaaaaaaaagaaattctatctgaagtttaccttggagagatgaagaaaatatggtatttagcactattaagtgtttttccatcttattggagagattcaaccaaaaggtataagagcaaaaacacaaaaatcaggaaaacaatttttctagtgattttacctttatcttggactatggtttcctctcaaggtatctagcagattaaaattgctttgtgatgtggcaccaccatcctgcttttccttttatagctctcatcttaaaacgttttacaggtccacacaaacaggtaaaacaaaagccatcatgctattttaagtatacattttccctgggcctatcaaatttagaaaagcatattcactctttcaagttgctagttgtggcttgaactgattgcttgattaatcactcaaactctggctctagaccatcttacccatgttcccttttcagtatatcaaaaacagaggtcatgagattgcttagatcatgaaaccaagaaaggaaatcaagcctttgacacagaaaacacaccacactttctaaagcaagatcatcttatgagtggatggtagtattctcctatgtttctctgacaaaatgtacccatactctgtctttaacagcctcattgccatacactacacttgacctgctgccccatatgcagacctctccagtaggtccgatagtcactaatccactgactaaacattttaaaactggctttggcaaaacatgccagaaattccttcagggtaattaaaaccaccctctgtgtcaataaacacagactgaaatctttcatgtgcagaggggctggctctgacccactggctctaggacattttttcttagatgagttttccatcattgcaattgattttcactgactcatccagaccgttgctcagtccccttataaaatgattggctgagatcagagatatagtcttagctttcttgtcgcagccaagacataaggaccaaaggggctataaatctaagggccaggctcattgctaaagccttttcacccagatcttcaggtgacagaccttaaaaaggattcttgctatagaagctgacagtcacagtgttcacttatcactcctcttccagcattcaaactgaattttttcttttttttttttttttttttgagactgagtctcctctgtcgctcgggctggagtgcagtggcgcgatctcggctcattgcaacctctgactcccaggttcatgtcattctcctgcctcagcctcctgagtagctgggactacaggtgcccgccaccacgcccggctaatttttttgtattttttgtggagacagggtttcaccgtgttagccaggatggtgtcgatctcctgacctcatgatccgcccagctcggcctcccaaagtgctgggattacaggtgtgagccaccgcgcccagcctaatttcctatatttttagtagaggtggggtttcaccgtgttaaccaggatagtctcaatctcctgacctcgtgatccacccagctcagcctcccaaagttctgggattacaggcgtgagccaccgcgcccgtcgtcaaactaatgtgtcttcaaagtaaaaggaagaactcaggtgaatattcgctacattaattcccagagactagtcacatagcagacactccatgaattgtttctcaccacaatggcagccttactgtttttattatataaacaatgtatatatttatttaaaactgtcatacattataaacaatataaaaacagtagaagttacctaaaatttcatcagcctgagttatcaatatatttttgttgccatttttccatggaattctttgtctatacaaataaaattttatataagagaaatcatactttacataccctttttatcatggatgaagctacctttgactttctttaaaatacagcattgtttttttttttttttggcttgctgctttcatccccctcatagccaatattaataaactttcacataatttttcttattgatattatcatgtaataactcatataatatgaatgaagtttcagttgctcagtaaatacctgctgaatggttaaagagtgaaagaacacacgcataaacacgagtgaatgaaagaataaataatctattatgatcttaattagccagtacagtttccaagtgattgcagaaatctcagatcacatcttttgacatctcccctgcatctttaaactttagttggggtaggaggacctggctttacctcattcagagggacctgcaagtctaaactcccaagaaaagaatatgtaactggctgctctcctaactacagaaatgctgttaatctactctcaaattgaaatcaaattcaaaaaccattactaagcacctgtgtgccaagaaccctactgtcctttgtatggtaaactagagggaaagatgtggtcactgccttcttggagtgtctgtcttgttggggagatgacgtgcaggatctgtgtctttagatctagctgtctgaacttggacctcagttgccacattcgtgaaatggggaaaatatctataagctcataggattgctgtggtgatcaaacaacttgaggaattcaggaaaaacttcacaggaaaatgtggactggaggcaggccttgcaggtaccagggaaggggaagcaggaatggcctggagtagtgaggacccagcacaagccagcctcaatgctttgaagatcaattaggagagacttaaaagatgagaggacaggcaggaaacatgaaggtttataagcacaggagaaaactgtgaacagactaatcttcttaaagggtcaaagaaaagtaaatttttttttttttttgccttttcagcatgtgccaatgtctacatcaaggccattcatatgagtgactcaaaggcaacctgcttgtcaagtaattggaaaaaaaaaaaaaaaaaaccctggcttacataatgggctcaaatccaagtttctaagacttataggaaaaattctgatcagaaaatttccatctcaaattgtgctgaggaagcttgaggactgagtaagcatgttgccagctgaagtacaatacgataatcagactgcttttgcttttttttttttccacagtgcacagagatttgtaggtcctggtgggtgcttaccaagtttctgatctctgaccccagaaggggtcagagaacctacagaaaaatacatcttgttcacaaatggaactgcacccaaaactttccctctatatcctattaagtgaccagaaggtcttgacttctaaaacatagtatgtcagtttcacccaggctaatcctacagaataggaaaagggattagaaattagtcattgcaggatatgtcagctggaaacactaaactgtcctaatctcttctgatagttcagggttctagggaagctcttctctgcctgtcatatcttctccttttaaactggcaccattgatgagttccagtttgcatgtccctacagatctgcgctactctaattaatcccacctacccttggctccaagacagaagaggaagaggatgaaaagtagattttaatattgcacccccaaatctccattgaaacttggagtttctagaagatgctttaacacttttagtcctctgagaaggcaactgggtcacctactaaccaccacaaatatttatccattcaactgcccatccatccatctatccatccatccatccatccatccatccatccatccatccatcctttaaattttatgtgcttatcctgcgtataatttttaaaatattgtataaacttttttaaattaaaaaaatgcctcaaagagcttaatatttttatttcaataacccaagacacttcaaagaggaagaatgttctaaataaatactcaggctaaatgaattgagatttcacaccgactcccaactgtaacccccaaagactgctgaaatgcagacagccaatatactttgaaagtggactaaaaatcgctcactgaaaatatggacagaacaaaagtggaaaagggccatagcaattacaaaggtattccttggaacagcgattttagaaggaaatttattcctatcatctagaaacataattgttcataccatttaatccagtaatcttgcctttagaaacttgttctaaaaaataaagacacggtttagagtcatgccattatttatctatttcacaattattacagcaatattggaaagaatctaaacttccatcattaggtggctagtaaaattatggttcaactatagaatgttaactacagtggtaatttataagatttgtactttttatttagattaaacaatagtgccagttttgggagaagactagagatgtctggaagtctaaagtcattgatagttaaagtctaatttttttcagatttgcctgggttcaaatttcattcaaccacacatagtattaaccaaaaaaaaaaaaaaaaaaaaaaaaaagcacagctttccgaaatgtcaaatttgtaccccatgagagactagctcattaaacaaccatactggttgtcatactgggtcaatcattctttgaagttacctactcaccagtttgaagaaaattaacatttctgggtcaccaggttccatatactcatctacaaatgatgccctggaaccatgaaagtaattttatttaatataggtgggcaactgaatcccagggtacaaactactcacccatgtgcttaatggcagaggctgagaattgagcctgcctctcctctcagaaagggtcgaagtacctggagctttgcggggtagaagggcaatgggatcaaattaaaattcaatggctgtatctttaagaattttttctctgatcttcaccccacataagtttcctaggataaacttaagcaccttgaaaatttgtgacaatgtgaggtggaagcaaaatatggatagaacaaaagtggaaaacgcctacagtaattacaaaggtattccttgggatagccattttagaaggtaatttagtcctatcatctagaaacataattgttcataccatttaacccagtaagctacttttagaaacttgttctaaaacataaccaaagacatgatttagagtctataacataaccaaatacattatttatatatttcagaattagtatagcaaatattggaaataatctaaactttcattattaggcaacaggcaaaattgtggttcaactatagaatatcatagaaaaatgctaacagtttgtgtctggggcaaaagcaaacaaacaaaccctatagatgatgttgttttgcatagaatcctagcattctccattcatctctctctttgtctctgacacacacacacacacacacacacacacacacacactgagcctggaaggaaatatagcacatcaaaaatgtttataatgactgtctctggcacagctagaagtaaatttgattttctcttttagaattttctgtacagtcaaaattttcataatgaacatgtactttattctcttaaaggatcttccttctttaacaggtttcatattcatattcacgtgtgttttttaacgtatatattcccaatagaaggcaagttctgtgagagcagggtctacatttaatttttaaatattttatacctaggttttttagcacagtgcctaatatataataaatgtttttaaaataactactgagtgaactattggacagacactgattagaagggatatggctatgtgtgaggactctaatgagctgtcaaacattcattccattacatctctaatctccagctcacttgttaaaacaacatgccaccttcctcgcatacttttgcctcctaacatcacacaagactctgcctccaatgaggaaagccattgccacccatctctacctgccagcatcctaccaaggccccacctccccacttaaccacttctggtgaggtgagcttccctctagcacttactgcagccactcacttagacgattaatactgtttggacctctattaggttcccggtactcttctagaacaggggtcagcaaatgatggtctacaggctactccttgattttgtaaatagagtttcactagaatacagccatgtccacatactacaatggaagaattgagtagctgggacaaaggctgtatggtcagcaaaggctaaaatacttatcatctgaccctctacaggaagagtttactgatccctgctctagaacatcgacataattttacaaaatggagataataccaaagtttcattctattagaatattcataggcaatatgagatccaaagtatatgtccaataactttgtacagaaaaattattgtattgtacgtcagtttgctcttaataacatatatttttatgtcagacatacctgcattcaagtcctgggtctgctgattgatactgggaaagatgacacaaattctctaagcctcagttttatcatcagcaaagtagaaatctattttctctttcactccataagtgtgtaatgagtgctttttcaccagatactatactaggagatggataaacaatggtgaataagatctaaagtctcacctaattcagctctaattatacatacttttgagggttgtggtgaagattaaattatatatatatacacacacgcagatacatacatatatatacacacacatatatatgcacacagaggcatctatatcatatatacatcatatgtagtataccatagatacataatacatagtatatcacatagagtacatccagaatacttaacctgattcctgctacattgcaagcactcagtatatagtggctcttcctcatgatcataattacagcagaagtccttttaacagacctccaagtagctgacactccaagaagaaaaagtgccttccattctttctgtaaaacaggcctacaacatcctttataagtactcacagctaattgagtagactaatctctggtacataggcaaacttctgctccttcaggttgagttgcatgtttactgagagtcatttgtgtttgtttccaaatctcctgatgcaagttatacttgttagttaattaaatatcatgaaaggtaatgagaagaatagtgttaaaaggaggatgattgtttcatatgaaaagtcagttgaagaatttcaaaagacttgacaaagcattgtcaaattaaaagtaggagatataaaaattggggaacaattacaaaaatctagaagtattctgtagtaagattgcttctgcgatatctatggtcttgttcaacctcaaggaaatcaaaattgggcatggtctttgtcatttgggggacagttcatgcaagaaaaatattacaacccctaatcagcagatccatactcaaaggtaaggtcttgattcttcatcgggcctttcattgaaattagtaaatttaaatggtatgttattttttatgactccttgccttaacttttcaagtttactgtcaactattggtcccaaatgcatggagtagagagggaatcttttgtatttatttatttatcacatataaatagtaacatgttgcctcatcccctgccatatttttgttggcaagaaaacactcagcaagatgaagtgacctgcccaaggccacagaactagcatagccagaggtgtgtctagagccaggtgggctctgattccaccacttcggccacctcatgataacagagagataaacaggacacagtttcacgcaccctggcttctgtggttaattatattttgagaaggacggagtgtcacctgcccaaatagatggaaagacatttgagaacaagactataggcttatacttcaccatatgccccagaacttcctacatagcacttggcaataaataatttttgtttgaattgttaaattttctttcctactttataatagtggaagaaattggggccttcctggtttctgaaaaaattatgctcccttggagtttataacccccaccatggagtataaaataacaggagagaaattctattgtgcctgtcagatcatgtcattgagagcttaacctcattgattggcacttgctcttccccatcagtgtggcaagatgagcagcaccctgctcaccagatggttatttgttccaccagccacctttgctgagtccctgattcactccagcccaggactgtctccagcattcatgctgcaaggcagctcctgccaacaactttgccaaatggctcctctcaaagtcatggctgcccagacagactggctcctccatctgcagcagcttttggcaaagagaagtttccctttctggctctgcctcttggctgcaccagaaccttcttgccagaaggatgatttgacccaggaagtacagccagacctggaatttctggggtcatttaaagcctatggccatgttttcccagtctcacccctgaggtgaacatcagaacatatcaaagagacctagatgatcacaaatacagaaataatgcctcatagaaactgagagtcagaaaagtctgtagagagcatgccttccctcccccatcttcaacctcattatagtagcttaggaaactgaagcccagagaataaaagtgacaaattatggtagcaggactggaatcctacccaggtcttctgatgtgcattccacataactgcttacgatactgcattgcctttccatttccccccagttcattttcaaatccttggtagaaattggacccttgtattgattgattcagaagaatattttttagaaaaatgaatcatcttttccctatcaacatcataactgttcttttaaacaggtgttcatatactacattgtgatgaatttttgccaagtttaagaatacagggtttggaatcagatagacctggatgtgacttctgttctactcactgttgtgtaactatggactagtaatcatattattctgctttaacttttcatttaaagggggataagaacagtatcagcctatacaagtaaactggattacatgagaaaaatactttaaggctctaagcctgtactggtgcacagaaagccctccataactaccagcaatcattattaattattaacattcaaatccacaatggttttggaagacacagtactgggcacatatgaataggtagatcaggtattctcattctctacattaggaaattcaggttcttggtttaaatgactgatccaaggttacacagaaaacaaatagaagaccacagatttctgattttttcttgccattttgctaagaaatgggaactgtcatctcagctttaaagataataaaatcaggaaggaggacatttaaacaaaaacacatatacacagataatcactgcagcatcttatgtaatataaaagctggaaacgattttctatccacagggaactactaaataaactgtggtactgtcatactatggagcaccgtgcagccattaaaaggcatgagacagatgtaggtgttctgatatggaaaaatcttgaagacgtatcactagtagaaaaacaaagtgcaaataaaacgggcagtgtgtactcatttatgcaaacatcctccccaactatatatctgtacatgtatatttaaatgtatgaatagaaagatggctctgaggaagtctaccaactactgataatggtaacctttgggtaggaaagtgggatgggcatgggatggagggtgattcatgctttatttacttatcatgcttgaatccttttaagtaagaaagaatatagtattatttgacttataaataaaaacataaaggcagagggaaatgtgaattataataatgcagttggcatgaaccaacagacctcccaacttgagtgtctctagccctaacctgacttctacaaagctacataagcaatgttagtttcactgagtttcctgtgtggctctcccactgtggtagggtccttcctggtggtattttgtacttagggacccaagttctatctttcagaccacctgggaactctcagcagcatcttgctacaatattccctattagagacatttacagctttgccaccctctacacccttgtgtgtctgtagagggacatcaagctgatccttctacgtcaagtggaggaggcggcctgccattctttgaccacttcaggttcattgcttagcaaggattcataccagtgtgataagcaatgcttgatggaggaggttttcagttccccagtgttatggaccaaattgtgcccccctccaccccaatctatatgttgaagccctaactcctatgtgactgtatttggagataggtcctttaaggagataattaagattaaatgaggtcataaggataaggtcttatggggctggtgcccttgcaagaagaaaaaaaaatgccagagattgcgctctctcttttcacacttgcacacaggagaaaggccatatgaggacccagcaagaagttggctatacatgggaagagagaactcaccagaaaccaaccatgctggcaccttgatcgtggacttccagactccagaaatgtgagaaaacaaaatttctgttatttaggcaacccagtatgtggcgtttttaaaaatgcagtctgagctgactaatacaccaagcacaaaggccagtacacctgaaacacatcctcccacaggtaaggtactcttcgccacgctccgtccaacagaccccatccttctcaggttaaaacctgttcataagggcccctctagattcctaaactccatacatcttttttccccttacacacagacccccaccccacttcatttaacatttgttgtaagcgatcaagtcatttacctctaaagcacagaagtgaaagtctgactacccccatacaagcacacaccctttctcattacccaggatgaccctttctccaaagaaagctatgaacattaacaattaatatttcccactattaactctttccacagtgaacttggagcaggagaactcaaaggttcctgggttatttctgacaaagttcctagtggacttataaaaataatctgtgctttctgcgagatagttatgttggggctgactttcagcctgattctagagttctattggagtcaaaagaaggaaatttggtggtaaagatgacaagttgggtgaaagcaaaatcgtcttcttattaatggaagatgaggggaaccagctggagagccactctggccaaagtgaagcctcagacatctacatatttatgtgcaaaagaacatctgccatcccacagctgcctccgtcatatttctcttgctgtggcccaggcaactatatgagttgtcatgagctgggaagagtgggtgcctagatggcccagcgggaccatctcagctcagctcagtctgggagctgcatgcttactgtcctacactggggatgagtgacatggagaaagctattcaaaaaactccagctagttctcacatcttgattgctcaattccataaacatttttttctgttcttattatataacagaagaaatctacaggagtaagtcagctaagaattctgttactgggtcgtagaattcagcttcctccctgtgggataatggaaaaggcccagagacgtgcactgctgtgctaggagaagatagatcaagtaaatccagcagcaccgaccaggcgccaatgggatatatgtggagggtggagcacaacttgcatttctccaaaagatcctgagcagcatgggtgagcaaagaacatgtgccaagaatccacacagtcatgagctctaatctggttatgccacttacaagtgagtatgtttgtaatacatgtgtatttgttatgcaagttcctttggttctctgtaccttgaaatttcttattttaaaaatgaggttaatgcaaccattctctctgggttgttgatggagattaaatgagtaaacataagaaatacctaggaaaatgcctggaatagacagtactcgcgataccttagtttctttccctcagctaagtgtcgaaattggacccctatttcttcttaaatgcaaacgccaaagtctaggaatgtcagtctacagctgtgctcttttcattgggcattaccaatattttgacaggactggcctaatattattcaccccaggatcattggtacatttctgaccagcactcataaagggcttgggattgcccctggggacctggatgctaataatgaatacttgctagtgattttcaatgcattctggttattatgtttagtagcagaacatttcccatccccagaaaggtcatttacaatagtgtaaggcagctacttctcacctcgcatttcaggtttctctgagaacagcagagagctcaaacattcatccatatgcattggaaacagcattctgatctggcatttgcatacaaataccaaagcaacttaaggaactatgaggcagctctccatcatatgacactacccccttttattttttcaatgccttcccagcatcttcatatcaaaagccattttcatgtaccttcccagctttattcattataagtttcccctttcttgagcttatttggaatgggggatggaggaggaatctttacttcctcacttttactctctgtggccctaaaaagctaatgtatttcacaaatcactcagatctcaaacctggagacgttctaaactcaactcatccaagactggactcttcttatcctaccacattgctgagaaatggccatatattatagtattacttgaataatatcagtgtgtggttatttatgcttaccaaggccctattctattgtgaggtacttttttgctacaatttcttcataccaagccaagatccacttccttgtactttctcactcattggttcaaattttgccctgaaatgttcttatctgaggcatctcatctattcatacagttttaagtacctttaatatgctggtgatgtttaatctcaaatttattatctagtccaggtctttctcttgagcttcagacccagaaatccaattgtctacttgcaagtctcactgtgaaactagatgtctcactgtcttctcaaactaatcagttttcagtctgtttccgcttttagtgatgcgccccattatgcatccattttcatggcaaaattctgggagttgtccttgacatcaccttctccatctgcacccaatcatagtaagtaagtgcaatgcaatctttctctattacgtatcttaaatccatctaattctctccatctctactgatgccaccatcctggagcacaccatgacctcctaattatctcccaactttcattctttttcattacatgcctggctctctaaccccatcctacacagcagccagattaaacttctagaaaaacaaatctgatcatgtttcccttttccttaatggctttccattcatctttggatagagtccaaactccttgtggtcaacaaggcttgatatgatctggtccctgaatacttctccagtctttttttcccccaacattttattatgaaaattcaaacagactgcaaagtggaaaaaaaattacagtgattatccatagacccaccacctcaatttagttattaactttttttttgagatggagtctcgctctgtcaccagactggagtgcggtgtcgcgacctcggctcactgcaacctctgcctcctgggttcatgcgatttcctgcctcagcctcctgagtagctgggattacaggcatacaccaccatggctggccagtgactaacattttatacttgctttatcatatgtctatccatttacccatccctctctcttagcattaatctttcttgcttctggtacatttcaaaatgaactgcagactccattctcatttttatcactcttctccctgttcctagccatagtcatctttccattccttgaatcagttaggctattttatctctctgggcttttgtacctattgtcccttctacctaaaatgctttcaggtcttgttaattgcaaattcatcctttagttctcagtttcagctgtctgagaggctgtccttgaactcccgatctaaattagatccacctttccaccttatgaccccaaggcatcttgtgcctttcctaaatatcacttatcacaattggtaactatatatttatttgcaaaattatttgtctcatactatctcctttgctagattgaaagatccctgaggacagagaccacgtctgtattggaacatcccgtatcacctctgcaaaacgtcagtatttgttgaaggaattaaaggcagaatgaatcaataattgaaaggagctacttggaatagtaaacttgttcttcctttaatatgtataaacaagacagttttttaaaaaggcttctgagggaaggtggaacccacttgttgccagaatataaccaggaagtacattaagtaacaataacagctataatgaattaagggtgggctttgtattaggcatatcccgagtgcttgagtgctttctctgcatcaaataatttttctttggcataggttctattgttattcccactttccagctaaggaaactgagaacagagcagttattttaaaacaccccatctatgtagaatatttggtctatctgtggccccatttgaaagtaggaagattaatctagaaaactcacagactgctataatggagatagggttttacttggctgtaacagaagcctaaaaatatagcaggaaacccacatatagagagatttgagagatgaatccctggttaggaaacctggggttccatatctgaaaaaaaaaatcaaaccattgtgttgactttatttttgtgggaaatttcaaccctacccaaggcccttcctctatataaccccatacacacacttcaaattttccctgcaaaggattttatgcctgatggaaatatagcttatacactgagataaaaccattgcaatctttcccagaataagagctgatggttaaaggaaaatgaagtagtgcagaatttcctagtgggagaacctggccttcagacactggcttgagtttgaagacaaggttttccattgaatgtgtgacttttggcaaattagtaacatcttcagacctcagttgcatcagtttccttctttgaaaatggaaatgacaacatccatttaacagggtttagatatattgaaatgctatacataaagagctcagcacagtgcttggaacatagaagatgctcaaagatgttaactttaaaagaggaggaaaggtaggggagggtggtaattttcatgctcagaattaaaaaaaagtcctaggaaatttatttattaaatgcacaccatgcattcttttgagaaagacagagagagagaaagagactgagagaggggagcttgggtgaaagtgtcctttagcatttgcattgctcttagctggatgaacttgcctgcagtcaccacttacaatgcaaattgagtttagagtccttcacactaactacacagcaaaaacctttcagctttaaatagaacactgcaatgtggaatgatctgagcaaacagaagaaaaattcagaaatacatgtgaaggagatattttggaggaaaaaaaagaacaatctgacataactgagcaggtaggaggaaaatgtagaaatagtaaaggaaacagaaaagcaagatctatggaaggactagaagctaattccccacccagtaagagggtataagttaataagggggaagaaaacttgtggggcaagtccccagtgaggagaatttttaaaaagtcttttgatctggtgctttttcaaggtatactaacacttcttaaggaattcattggaagaacagggactcttccccctctggcaacaaaattgcatgaatcttccctgaaacgaataggtcaaaactgtagggaacttcttgttctatccaacttctggtatttacatcgtttaagttctattttccttttcttttcataccttctctaagatcagattttaaaacctagaagcttctgtgaaataaaggtttgttagttttgagtgtgattagtatgtgtgtgtgtttgagaaagagaaagaaatctgagaggttgattctcacatgccagaaatctcattgctataaactcatatctatttttgactatgtgaacctagatattctatccagaatcagagttttcaaaaatggaataaaaataagaacaacggtaatatccagggccctgaaaacaataaagaatgccatttttaactgatttcttcacttcacaattgacactcctgtacacatagctccactctgggcattttctcagcttgctaagtttctcttgcctgcataatgtaatatacaagaaaacatgaaggcagctctctttctttgtggttacaaacagaaataaatgttcccccaaaagccaacagacccaaggccaacttctctcttggatgacatgcttagatacagagttagtcatgtgctatcaggtcactgagtcagtgacaaagcactaagattgagggagaacatcttacaatcaggttgccatcatgcacagaaaaagaatcggtaagtatggtgctctgtataggggagggatgggctgcacatcttaaaagccatctctaagctcctggaagccagagcttacaactctgctttatctgtctagcaccatgggcatactgggcttgatgctctccaaaaatgatgacaaatggagaatatactttcaatagcactggacattctttctgtctagaacttccagggatgtttatagaagatgccacctttacccccagatgtgtgtgtgtctttttatttctttcagagcttgaactcttttactccccccatcacatttctctagcagtcttttgatttgattaaatattacagaaatgttagcatccaagaataataattttaaattaatacaccttgcaacattgtcctaaagcatttccacatacattttctcgcatggatattacaatgtgataatgcaacactttgtatgagtggctaaggataaaaggcctacaggtagaaaatgaaagcaaaaatgcaaaagttttggcactgggggaaaaaaatgcctctactctctattcacacacaaaaggcagaatgagattccacctgctgactttcccttcctgcccgcacagcactagtgcttatgtcagaacaagctgggagagagggagagacgacaatttcacctcttggcaaagctcagcttgctgaacccttttgctttctgctggctgttgattcagcagaaactactgctgcagaattcataatggtgatttttaaaggccccaccgatcgcgttgctcaccccacgtgtcagcctcattcgctgcccgccagagcactatttccccagccacctttttatttttgctaatgcacttccaaaaggaaagaggttcgcccgtctgcaaagggctttttggggttttgattgtctaagcaggtaacctggccggccggggagatgaatgggcaggaaatgaaaccttgccctccctgcagccactgagagacataacatcgtttcgctcagggaggggggaccaaggtcctactgggcccctcccttcttatctccccccaagacccctgcgaacatctcggggaaggggtcatctgccttcctggggtcatctttctgggcgagagccccaccctgaaaaagcctaatccctgagggccattttaactcccgtgggcgccgggtccacctgctgctgaacgccgagctcgcctcgcggagcccggatggatgcgaggtgcactggggctgccggggccagccgagcccccgccccagccctagggcccggaggagtctccgccactacgcgcccagctgcccaggaagcacagtgatccgcaacttgcgcccggccccaacggcggaatgcggcggggctggcgttaccttcggtcgcatagctgtggtcgcgcaggaaactgttgttgattttgcgggtatcaatgtcctcctccattgacagcaggcttacttgcgtgggaaccagaagccggcagacaagtatccatgatccctccccgcagccagtctcacaggagaggggggcaggggagccagtgggactgcaccatggtccgagcctgaggaggagacggggaggcggagagaaaaaaaataaaaacccggcaatggagctgtcacctcctccactcgggttctgcgaggctgcggcggctcctcccgcgcggtgcgctcactccagctccagttcccagcgaggatgctgcgcctgcctccgctgcctccgggtgccaagatacgccgtgccccgaggggtctggtcccgcccgcccgccccggaggcgctcacaagcgggtctggggagatgcccaacaggttcccctccttggcagccgctccaaaatgcaaaaaagatccctcctccccctgggagagcgggcagccgcgacaaaatggtgcctttctggacccgagctgcagtggcgagatggcagggacaggattcaggcttgcctggccggaatgagggtgctggtcccacgggagggcggctccggcaggcgggggtagggaagctggcggggagctgggcagggcgctgcagccggcgccagcgcactcaccctcacacccacacgcgcgcactcgcagctgctgctgctgctgctgctgctgctgctgcaggaggctggaggcggctggtgcattaaaggcgaggctcctcccaaccgcgtcagcagccccacgactctttcccagcagcagtggtggccgaggcagaggctgcggctgctctttgctgcagtggggcgcatgcagccgcgaatcggcacctgggcagcaagcgactagcttgcaggttcaggtggaacgcatagacgcgctcttccaacctcctcccctctcgcgccactcagctaagggccacgtctacgctagcacccagagcccctagctccctgcctttctccggacgcctgaacttgagaacagcaaagagaagtaggttcctttggatagtcaggaagtctacatccaggtcccttttcctcacccttatatgatgcatgtggtcccttggtgaatttaaagggcgaggtttggggctcgaagcttcagaaaaagaggagaaagtgggaagtgccgctcagagcctatcttaagccctctagtaggaataggagggggatcaggggccagaactttgcaactggttcccccattcctaagagtcaaaataccttctaactgtaggaggctggtgttcaataaagcatctgtgtctacacaggtggaggaaagcaccagactagtaaacaggatcagtctgaaaaagtccactctcccttgcagtttgcacttcgttttggacaaattattgcagcctctccgttaggttttgcttgtgcaggaacaccttctatttgctgtcagcatggaaggtacattgaagcacagaaacataagcataagagccctgtgcccacagagagccactgctaccctgggggaatttcaggagtccaattaatacagaaaagagacctgtcttcctacttcaactaggaagaaaatgtagaattccctccccacccatgttttcccaaatttcaaactctacttttgaaagaaaatgagattactattgttatgaaacaaccaaaaacatttaatgaagcaacccaaatcactagaaagccaatttggaaaagacatcaaccccaatcagtagaaagccaattggaaacgacatttcctaggtttcatcttgtagaaggtattcatttcaatgggtaccactgtagggagagacatcagcaaatgttttgctcagttaagctccacaagtttagctagatgggcccagagggacctatgagttaattatatacatacaatgcttcggctaacacaatttagaaagtatttgaagttcagaaaaatggaaaaacaagtccttaactgaggttgggaattgtcattagatttccatgcagtatggatacttctggtagatagaaaatgacatcttcctcatctccagaaattgactgcatatccctgggagaaaagagcagaaatgttccttgacatagttattttgtgtgtgtgtgtgtgtgtgtgtgtgtgtgtgtgtgtgtgtgtgtggtggggggagttcagttcaactttcaatagattctattttattttcatctagtgcttaagacttatacacttgtttgttcaaaatccacatttaaaattttagtaacaggtgaagacgggtacaagttgatttaatccacttcagtacaagttgtcgtggctggttcttccatgggatgagctgtatctatcaccgaggttccaacattcagtccttttgtagttacacattgcagcttctcttggatattggcacaatttggagtaggagcagagtggggaaaagctaagttcatctcttagtgaatcaaaatgatgagaagacattgtgccttcggttggaatgatcttaaaattgtttcaggaggccttggaatagtatttgggaaaatttcccctgtatctttctgaatcaagggctagattgggacagagctgtgtgatgaatcaggtaggcccaggctcattggccaggctgtgcttgaggaattttccattgtaaccaatggggagaatgtcccttccacagatcgagtctctgggtttatttatttttcttttcacatatgctgcaaactttctcctgcatttattcaacagtccaggcatttttcctaagacacatgttctgagaaggcagattggataggtctccattgtttaagtagatttcaaggtttccatttggccaactactcttttctaatatgagagaactagctcatccacccaaaaccaaggggaaaaaagctgttggctctgtgccataacacaacgacctgtggtggaggtaagggagtgaaaagagccctgtgcaccactgtggagctggggggcggggtgggggagagagtgggggagatgggagtaggctgcagagatcagtcttcaaaagactcactggccacttctcttttcctctaaaatgtcaagttctttccaaaagtggtgggcatttccgcatgctatgttctttgccacttcctcatgtcttggcattcagcctcttaactgtccctgcttcgttgaggcattccctgaccacacgatagtcctgacttccggtgttttctgcctccacattttttttttgtctttttcatgtcctacagcgttttataatatttgtttacttattattgttggccattttcactagatcttttatttttattttctttttttattttatttattttatttttctgagccagagtctctctgtcacccaggctggattgcagtgacacgatcaaggctcactgcaacctctgcctcccaggttcaagtgagtctcatgcgtcagactcctgagtagctgggactaagacatggaccaccacacccagctaatttttgtatttttcagtagagatggggttttgccatgttggccaggctggtctcaaactcctgacctcagtgatctacctgactgggccttccaaagtgctgggattactggcgtgagccaccatgcctggcctcactagatcttttctattgactaactgtcacttagtagatgcttaattatatttgttggagacaaacatttcttaaacaaatgaataaattgctgaatatcttactttaatatttaggtttcatacctccccccttcttaaaattcatattaaaataatctgttgtgagctggaaattttctagctcataagctgtattcctattgaaataattggttcgatttattcctgtatgcatatatacgatcaaaatttaccaagcaattatgtaaagaattattctggccaggtgtggtggctcacacctgtaatcccagcactttgggaggctgagtcaggcagattatgaggtcaggagatcgaggccatcctggctaacatggtgaaaccctgtctctactaaaaatacaaaaaattacccaggcatggtggcacgcgcctgtagtcccagctactcgggaggctgaggcaggagaattgcttgaacccgggaggcagaggttgcatcgcaccactgcactccagcctgggagacagagcaagactccttctcaagaaaaaaaaaaaaaaagaattgctctaggtgccaaggatatagatttatataaaacagaatttctttcttcatagaacttaaattctatcatctaattttaataacgtgaactttcttagcaatacagcaaatgcattctatatcgacagactatagtgcaatgttaagtgccaaggctccgatatcattttctgtcacttatttttctgtcctcaagcaagttacaagatctccctaaagcatcattttcttatctataaattaggaaaatgaatagtatttgtttcatagagttattacaaggattaaatgagataatacgtggaaaaaatacattgctattactatgagtatttactttcgtcatcatcaccatcatcaatgttcagcaaatgtgcaagtacttaactatgtcagacactgggataggattatagattcagcaacatcagtgtataagatgtagtcagtctctgatgtcatggaacttagtgtctaatttacagtttatgtaaaaggggccatagtcttcaaagggggcagcagagggaactctgaaagactgacctatttcaggcttgtgctttacatagaaaaggccaattacaaatacacagccttcttatgttacccagttcagtattgacagcatgtggatacattcgtttttttaaccacccttgtcatggtcccctcccccaacactcacatacccactcttccttccttaggctaatgcttcctacacaggaaacttttgggtcaccctgtccaattagcacattaaatatctataattttattaaaacctttgacctaagccagtctggagattcttaatagaggctttaggtgtcagacagtcctggtttgtgtcccagctcaggcatttataaatttcatgacctttggtgagtagtttaacatctctgaacctctatatttgcaaaatggaagaaaacaatagttgctacttcacagggttgttgggtggcttcagaggtaaggaaagtgcttagtccaggtttggctcagagccagccttcactaaaatgacccttcttcctcctgcggtacttcatgagatctcccacttgcagagaattggagagatgcactccaagtcaattgttcatgtgaacagaagtgacctagaaacctcagttttactgcctatcaatctgtcttaatgaacaattagaaactggatacatgaaattttatcatcttgcaaaaagccctttataaaccatgaagtctcctgcaaatgaaaggaatcaggattatcttctcttggactttctcattatgtatgtgcagacctagtcacatttctctattgtggaatcatatggaatttctctctatgatcactaagcaccaattgcacaactctctctctaaggtggtttacgtgctgtctagagaatgacctcttgaatttctagcaagtttgcaattcctgtttgtgcatgctacaacatgtaatgccacataagtgatcctttaacgtggcatttaatctgggaaaagaaaagaaaacctcttgccctcaaagtgttgtattaattctagactctggggtcttaatggattttaccatgtaaatgtctctgcaactgaaattcaagtacagaaacttatgaaaatacacagtggtacactgaagctggtaggtactggctattgagagctgattttgctgatcacgtacatgtctttctagttctgctttgagtgacatcattaacatcagaaatctgccatggtaggatatttatatcacagaaaattaaaaaaaaacactatgtaaattcagggtttttttttttttttttttttttgagagccagttgttaaacatttaccagcctaccagtagaaacacattacttgctgatgtgtctttcccctcatctctgttatcggtgcaaagtcccctccaatttctgtacaataaatctcccaagttatgtcagttccagagcattccaccattcaaccaaacttctgccataatgttaaataactcttaaaatcctacctttccctgagggtttcccatatccatcagaggaaaattgatgtcgttgtctgatcctttccaggttggttatgaaattgccatggtagacttgtgagtaattgcttttatagggctcctagacctaacaacgtaggaatgttcggtcatgcccactctcaaggaatcattccttttgactattcaggttctattgtgaccttagtcttgcccttgatttgcttcaatactaaacaaaaatatctactgtgcgtgatttcactgacagctgttttacttgtctagttaggatattgatgcaaagggagaaaagttacaaaactcaagagtctagatctgagagcatgagataaaacatcttcttgtacctcttaccattcattggttttagagttaaatttaggctgtcctgtgcaagaaagttttagtttacagtatatttgttaggtataaggtgagaatttccaaaaccaggttagcaacactccagggatatactagtacctgactacattgctcaaagtaaaattttagtataatttaaacaagaataactattgggaaatgtctttcaaacctttaaaaaatataccaagaaataccactttacagaatttattctaagaaaataaccatggatgtgggcaaaaatttagccataaaattatttctaaagaacattgcttataatcatgaaaaactggaaacaacccaaatgcccaacaaaataatttgttaggcaaattataatgagttcatatgatggcaaattattgattcatttatatagtaattatagctaacactgagcatctattatgtactaggcactgtggaaagggttttacttgcattgtctcattttattctaacaacagcctctatacagtatcatctccattttactgaggctaatagaggtaaataatataaccaaagtcagatagatgagagcctggcgccaacccatgatctgtctctacagcccatgctcttaaccactgtgatttgagctattgtgagtgtgtgtgtgtgtctattgcagtgggtttaggtcacaacagaatcacctggaggtctctttccaaaccattcaccgctagattcttacttgtctctcttagggataaatattctctcagttgaaaatcaccacaattgtgttggtgaggatgtggcaaaaatcagaaccttcaaatcctacattgcttctgggattgtataacaatgcagccacaaatagtttgccagttcttcaaaatattaagcacagttaccatatgacccagaaatttcacttctatgtatatattgaagagaattaaaagcacgtgttcccaccaaaacttgaacacaaatgttcatgtagtagcattatttataatagccaaaaagtggaaacaacccaaaatgtccatcaactgatagatggataaacaaaatgttatatgtccatacaatagaatattattcagctgcagaaaggaacgaagtattgaaacatgccacaacatagatgaaacttgaaaacattatgctaaatgaaagacaccagacacaaaagatgacatattgtatgattccatttatgtgaaacgttcagaatagacaactgcttagacagagaaagtagattagtggttgccagggactgaggataaaaaaaaaaggggtgggaatgactgctaaagggttcaggatttcttttgcgggtgttgaaaatgttctaaaattagataggggcggccgggcgcggtggctcacgcctgtagccccaacactttgggaggccgaggcgggcggatcacgaggtcaggagatcgagaccaccctggctaacagggtgaaaccccgtctctactaaaaatacaaaaaaattagccgggcgtggtggcgggcccctgtagtcccagttactcgggaagctgaggcaggagaacggtgtgaacccaggaggcggagcttgcagtgagccgagactgcgccacagcactccagcccaggcgacagaacgagactccgtctcaaaaataaataaataaataaataaataaataataaaactaaaataaaataaaataaatttggagcaatagctacgcaactctgaatataattaaaaaccactgaattgtatagtttaaaagtttgaatcttatggcatgtgagttagatatcaatacagctgttattaaagataaaaatatcatcaccatcataaaccactgttacttatggggagtatggagtatgctatatccttaaggtatagcagtgcagaaacgcttaaaagtagtgacaaagatagatgttcatgatgttcaaaaaatcataaaccagaataagccaactgctacaattttttggttaaaaaatgtgcatatgctaaaaggaatatatcaaaatattagcaatggttatgcgtagttttcttttgtgttcatgttttcgttaaaatattttagaacatgcatcattttagattttttagattatcattttaaacttttttagtaaaaaaaaaaaataagtatttttaatgccatgaaatactttataggatgaaacttgtatagaaaagattaaaccattttcttcccaccaggaagtcaagagacacataaaacaattctggtcacatataaaaacatatatgtgaccagaatgtatagaacggctctgtgcaatagaaatataatgcaaaccacatttgtaattgtaaattttctaatttccacattaaaaagtgaggaaaaaaagatgaaattcattttaatatatttatatttgaattttttgaagataaaattatcttatttaatctgtcaaaatataatttcaacatataatcaataaagaattactaatgacatatctaaattcttttcttatatcaaatctttgaaatctggtgttttacactaaaagacctctcaaatctagctacatttctaggggctggtaaccatggttaccatattggacagcagaggtacaatggaactgtttcaaaatttttattccatttgcaaaaagagttttaatgtgttctttaagaaataaatttttacctactagaaacttgaatgtaatgctaaaaccaaaccaaataacattaatctgataagcctcaaaactatttaaagttatacaaactgaagacgaaaatatatacagacatacctatatatatatattatgcagaatagtaattttgaatccaatctgcattttcccctaaaactagtaagctgaataaataaattacaaaaagaccaggattctaatagtaagatgataccatataacaaactcagacaagaaagatgtgatatataattccatcactgttatagttaccatcctaataggtcaaccatttagttcaacatgtataccttcaattccagctaagagaagaagccaaatagccagatgtcactgccaaaagggcactttcatatctgggcatctggacactattataaccaatgaaggtggagaaatttaaaggtacagtttgtaggcatctagtagagaaccattagtagtcttttagattgtactggagagtagaatgttgtggtcacatgatcagtggattaatttctgaggacttattgaattaggtattccattgtctttaactcatacatgcaaacagtttgttttgtatgcaattgagtactctctccttcctaatacagttttttcactgattcctgggcattgctctctctttattctcctactgcctcagtgtacactcctcaggctcacttggtagctcctcactgctgtgacctctaaatgtataactaccctagagttcaaagttcaaagtccacagtcccacagctcaccactcacataacaacaaaaccctaaatctgaactttgagcataaacctctccccagacctccagagcaatatcaccagcagccaagctgatatttcacagggtataaggcatctcaatccctaattctgccccacaataccctgccccaccctcctgttccttcattccactctctcattcccatcttttcaatcctgcctgctctaactttgaaatatgtccagaatcaaccactactcaccatctccactgctgctaccatgctccaactatcatcctatctcaccatgattatatcaatagattcgaaccagtctctgatcctccttcacccccaacccctacagagtagtttccaggcagcaggcagaatggtccttttaaatgcaaatcacttcatgtcacttttccgctcaaaggcttttattggcttcctacacattcagactaaaactttcttaaaatgctggaaagatttagctccagctatagctcttttttttaacttatcaaatgcagcaccaccaaatttcacctcccctcccaccaccaccactccctatagacatggaaggaagacaggacaggaagacaggagaacactcccactccaagacctttgcatcttatgttccctctctttcagacaccagcatagctcagtgctttacttcttctggtgtctgttccagtatcaacttcactgggataccttccttgactactctgtataaaataaattagcacctccatctctgcccgtcactctctatccctatattgcaactagactgtatatatttatttggttttggttattacagcagtagaacataatttccagggagagagaaacgattttgttctctgctttatatgcagtacctggaacagtgcctggcactactagttatgctaatatatcttttaaaagaataaaagagtgaatatgtgtttgctcaataataaggatgaatcacaagggaaaattaatgaacaacaaacctaggatgcttatgtagtaaagggtttacccttgcctgaagagaggcctgggttttgccctaggcttcttggaggtaatctgtatcatatatgacagcaatgtctttgtttagggtgaggactggctccagtggaacttagggtggggatggcaataccagatgaccatgtgacttagggtggaagctttgggtcacatggttatcaggtgacctgaacactaagttcaatcttgtatataatcagtcaatccatcatgtctacataattgagctctaataaaaactctaaatacgaggttcagataagtttctttggttgacaatactttatgcatattgtcacatggcaggaggttaatggcaggggggtaatgcatgaggtcaatggcaggagggtaatgcatccaacaattgaaacgttgcaattggaactctcccaggctttgccttatgcatctctttctttggtttattttaatctgtaacctttccgtataagtcataaccttgagtataatcactttcagtgagttctgtgagttcttctagtgaattatcaaaactgagaataattttagaaaccctctgaatttgtaattgttgtcagaagttagggcagttttcgggattccaccctcaaacttagcagttgtctaactccaggcaatgctaatcatacatctggcaaagttatagctaaaaaatgggcttagagagcattaggtctagcccgtcattttgctgatgatgaaagcctagagaaaagatgcgacttgcccaggttacctggtaatttggtgacagacgagcatgagacctggtgtcctgaatcccatgatcacatccgcacacacacaatggctcttcttaacttttgttttgcgtcatatgcaccactttttcttaagaaggttaataaaaatttattggacaattaagttggcttaactctccagtatgttaaggtcagtgtcaaggggagaaattactactgtctttcaaaactcaccagggccagccctggacaaaattgtaaagtaacacagttcctcttttctcccttgcctctgcttttaagccctgtgatgggccagggaagtgctgcaggaggagctgtatcagtcctcctgagccacggctgtagaggtcaggttggaagcctttatgctcagttctattatctttaaccagttctattatccttcacctacaccatcatggtttgccacactctctttctttggaggaaatctgaaaagtataggcagctttagaagctttgggaaacagcacgtggtaaacttagttcatcatgtgggaaacatgttgacaaattcaaggcattatgcaaaaaaggttgtcaatctggccattactgtactagtgtgataagttacagaagccagaattcaagagttagatggaccttgaacttgtaagcaaggttgtatatattttaaaactcaataaatatttaaggaataaatatagagtaaaaataataatattaaacatcccacaaatagagacctttgcaatttccatttggtatctgacagccctacaaggactgaacaaaggatgaaaacccaagtttataaatttacaattgaaaagtagcataggccctgagccatgactttaacattttaggatcatagatccttttgagaatttaatgatttctctccccaggaaaacagcaacagcaacatagtttagagcacttcctgcttccaaatgctgactcattatgtctatttcacagataggaagaaaaagagagagagagaaaaaaataaggcctgggtccaaagaaaggtacacagttgagtgcaagtttagaattacagtgctatcatgtccccagcaaattttttcgtagagaataaaagtggctgtcacagatacagcacttaactggtaatgatataaggccagatgtgagtctcctttctatgatgggtcagtaaagtgtaataggcaaatggttaaaggcatgatttttgagaaccaggctacttgaggtcaaatctttactgtgggcaagtttcttaatcatgttgtgttctaatctcatttgtgaaacaaagattataataggatccacttgtagagtagttgtaaaaatggaatgaaatgcctaaagcaatgcatggcacataatccacacccaataaatgtttgctcttggtattaggtgttggatactgtcatttttgtgaacactgtcattgtctacatggatgctagatttattcacttgtgtagtcttcacccttgaattatgttagcagatttgctctttttaattttttttaagttaactcaaagacatggtttcattataaaggagtatgaaactcatgtcagtgggcttctaatggaggtatattcattcaacatcaaatttttattacctgcctactatgtgcttagcactaggctttctagttgcttgtaaggagattatgacttgattgcaaagataactgttagtaatttatgtgcgaataagagaccaaccaagtgtgaactaaccacaatgtaaaaatgtagaggcatctagtggaatgagaatagctttgacagataaaatagatgatcagaatacctaacctaggccttgaagcaagactggctacataatttgtggggcccaaatcaaaaaaagggggcatcttttgttcttaaagtatttggaattttaagacagcaacaacagagcattaaaccaagcacaggacccttctaagagtgggtcttaagacactacacatcacatgctctgccttgaaggatgggaagactcatggagcgattaccgtcattagcagagtgacactttccagactgtcagtcatgccattcacatgcctctgtgtcctttcttgtactttttctctgaagcaaaatgtttttacttactttttcaacctatgcaaaccctacctatccttcaaatcccagcttgagtctgagctcagagggaacacaatagaataaaaagagtcccagacttagaagagcaaaggtcaattctgcattccatcagctctagaactatgagcaaattctcttaacttttctcatagtgggtttgcacacatgccacacagggggatcaaaaggcatcagaaatgtaaaatagcgttgaaataataattcctcatattgacaaagagctttacaatttcctgtaaacccttccctagcttctgcaggctacaaatagctcttgctaagtgtccagtgcctgattaaaatatacatgcacacatgcacgtgagcacctctctgtccctcccaccacctctctctgcttagcatatatgatttttcttattatctcatgtaacttcttaagatcatcaggccttcagtctttaccccttccaagccacgctcctcactaagtcagtatgatctttctaacttatggttcctcactgcctagtgtaaagtttcctaaatccaatggcacagaatcagtgtcttttgaggcatttgttaatcagtgttctgggaaaagaggtgcagtttgaaaaaaagcgtcatgctatagccctctgttgtaggtttccaatgcacatgtaaaacttctgagaaatcctgcaataaaaaagttaatttaactttgttcaaatcagaatttttcatattaatttgtgcatatttacattttatacaatacctaagttctgcagaaacattttgtcaaatgctggcctgcactcaggcattctgcttgttttatagaacctctaggatctattgctaccctaggtttctagttcattttctgtcacccctttcacaaaccctatgcgcagaaacagtgggccattttcagtttcttgaagaactctgagctctgcacctgttgtgctctctgccaagaatgtctttcctgtcactcatccatccatttattccctcgtgatgtgtttctcttcactgaagacccagctcacttgctctgtaaagacatctctgacattttcagtaactactgtctcctacttccagtggttaacacctctaaagaacttcatatacaaaaatgattcctgagcattaatgaatgctttctttgtgtcagttatgtagcttttattttgatgtagacaaccatctaagatgattaaaataaggtctactttacagattaataaatgcatggattaagaaacccacttctttttctgccttttgagtggtgcccaccatcgacctagctgccccattccagaaacacagaagacattttgaaaatcttcctctaccctacatccagtcaggtgtcatgtcctataaatcccagattcctaaacaaccttaaaacctgtccataggccaggtgctgtggctcacacctgtaatcccagcactttgggaggctcaggtgggcggatcatttgaggtcaggagaccggcctggccaatacggtgaaaacccgtctctactaaaaatacaaaatgagaacacatggacacagggagggcaacatcacataccagaggctgtcagtgggtgggaggaaaggtggggagagcattaggacaaatacctaatgcatgcggggcttaaaacttagaagacaggttgataggtgcagcaaaccgccatggcacaagtatacttatttaacaaacctgcacattcagcacatgtatcccagaacttaaagtaaaattgaaaaaaaaaaaaaaaaagccgggcatggtgatgggtacctctaattccagctactcgggaggctgaggcatgagaattgcttgaacccaggaggcggagattgcagttagccaagattgcgctgctacactccagcctgggcaatagagtgagactcagtctcaaaacaacaacaataacaacaacaatctgtccatatctatccatttacgctgctactaagttagcctggatcagtatcatctcttggctgtgttcctgcggtagcttctgggcaaatattccacctccatgttaccacaagtacaatcatttcctaaagtgcagatctgatcatgccaattgccctgcttaaagttcttgagtgccttcccataactcttaggaaaggaatccaaggcccttaatacaatgtaacagatctttaaggattagctactctctgcttttcacctatattttgttattaattaggatctcatagtctacacaggaaggcttgcagagcctattgtgatttataggccttgccaaacattcttttgcctctggactttatttttatttttatttttgagacaaggtcttgctctctcacctaggctggagtgcagtggcacaatcatggctcactgaagccttgacctcataggttcaagaaatcctcccacctcagcctcctgagtagctgggaccacaggcgtgcgccaccacacccagctaatttttgtgtttttagtagaaacggggtcttcccatgttgcccaggctggtcttaaactccagggctcaagtgatccacctgcctcgatctcccaaaattctggtattacaggcatgagccaccacacctagcctgcctctggacctttgtacacactttttctacttcttgaaattctcttcattctcctcctcactctgctaattcatgagcttcctaaatgtaggtcaaggatagtgctcttcctctagggcgcatagcatcttgacatctttttctctcctgtaagctctttggggccagggctataccttaatcatgatcttatctgtacctaatatggtgccggccctagaactggcatggaatagtcatttgttgaatgcctgaatgaatcaaataatgaataaatgagtaaatgaaagcaaaactaaaaggacagcttggggtattacaagagaaggaatttagagcttcctttcacacatcctcctgcctttgtcctctatgtcaaaatacattgtcctcctttcaactccccgaaagctccatgtatgctccacctgaaaagcctttgcatctccagagtgtttcttcttcattcacccacagttaatatctctttatccttcacatttcagattagtcatcttttcaagaggaaagaattcttgctgatgcagacaagtcggccccctgccatactgctctcatagcaccaagtgtctccttcattactttcaccacagtgtagctctacatctatgtctatgaatgtttatttagcaaaagtttcctccaatactcagtaagctcatgaaagaatcatgtctgttttttattcactattggattcccagtgcctaagtactgacacacaaaagtttgttaaactgattcatgaattaaaaacagtagtttttaatctcatcagcagttttttgtttgtttcatcaccgtgtacatgcatagtagggttcagtaggtaagggctgtttgttaaatgagagactataactgatttctttccccagtttataaacagttgttaactagtaatggttgagataaaaaattttgttcctacaaatttagtaatatttgcatattttcatactattttgtaatatgtttatggcttctcttgaaataaatgtcaaaagaattccatctgcctagctcctggactccacctcattaggaaaataaagaaccacaaagtccatctccaccacaggaaaggacaatagctctaattcataaattccataatgtgtacataattggaagacatcaaaatatgtcctgtcacagaccagtccgtgattcttcaataagaaattatgaaaatcgcaaaacaaactgtccaaaggggtcattactgtttgacaattcatcgggctaaataatattgtctgagtggtcgcctggctctgtttgaccttaaacgaaggcagaggaactgagaaatacattaaagaaaggctatggtcaggcttttggagttacacaaactttgatatgtctgggaagaagtgcttttttacccccataattttaagaacagggtaggcaatgacattttaaagcctgtttacctcataatcaaatcatccacaatttgataggtgcttaccaagtaccaggtattatgcatgtctttatgctcacattaactctatctctcaccatcaccctgaaggaggtattattaactatcattgaggcaactgagactcagagacctgaactatcttagagaaagtagaacatgactgatgtggggctcaaacccactgttacttgactctactcaataatgattccacttacatttctctatgcaaatttctgttccagccttccactcagtaagtacatactaagtatttatcaaaaagaatcaaagtgccataattcccataatcatttgaaaagaacacctaaacagtcaccaggatgatttttctctcaaagaagctattcagtttgaaatgccctgtggtggtgagatcttacaaaatgataaataaacccgtagacattttgttgtttaattttttaagcccatttctttcttccttttttttttcggtgattcactttcctgttattcagaacattacacacctacacacatcaaataaaactgaatattccaagatttaaaggcgttagtgggggttgtcaatacatgaaagcagagaagctgtttagtataattggggaaaagtggaggctcagactgtcaaaaaaagatggcttttgtactttaaaactaaagttccaggatatagaagtggaccagctaagaaatgctggcttagcctcttaagaaggtaatgatcctccttgatttagaacaagcagaaaaagaaaattaaggtcaatgatgaactgagcatatatttgtcatctccttttcccaagatctctttaaaatgatagtaaagaagcaaagcagatacagccccagaacaatgaaaagaatataaagagggtcattaagtgaacgatgcatttcatgtgtttctgagagaagacaggtaagtggaggaatgatgacagattgagggcacagccaaggagggcccccatctatcttgcaaaaacctagagagagttaggatttagaaatgccaaagatgatgtgggatgaagggtgaaaaatggagcgggtgtgaaaagggatttacctgccccccgttcccactgtttaactcttctcatcacaccctgggtggatacaataaaaagttcttccttttgaaagaaaactaaaatggtctggggtggactaaggtcacaagtgtgggagttgggtcttcagagcaaagtgctctgcattttggaattagggactacaaaatacaagataatctctgtgcctactcactgtataatgaaacccaccagttggtaagtcctattcatattcatttgacagttctactgattcattctcacatatgacttggcaatggaagatcatctactcaattgagtgaaacctacactgtgaggggaaaaaagaacaagataaacaaatataaaaacatatactggagacaacagggatacttttagggccagaaataaataaataaatcctaatttgtatgtgcagaaacatttaaaaggagaataaacctacaattcaagaaccggatgctatacaaagaaggaaaacatagagaataagaaaaaaaaaacatggaattaaaaaatatggcaaatttatttttaaattattagaaggttaaaatatactggtcaaggaaatctcttaaaaagtaggaaaggccaggcgcagtggctcacgcctgtaatcccagcactttgggaggccgaggcaggtggatcacctgaggagtttgagaccagcctggccagcatggcaaaaccccgtgtctactaaaagtacaaaaattagccgggtgtggtggcaggagcctgtaatcccagatactcaggaggctgaggcaggagagtctcttgaaccagggaagcggaggttgcagtgaactgagattgcatcactgcattccagcctgggcgacaagagtgagactccatctcaaaaaaacaaacaaacaaaaaaagtaaagatcagatagttgtagatatgcagcattatttctgagggctctgttctgttccattgatctatatctctgttttggtaccagtaccatgctgttttggttactgtagccttgcagtatagtttgaagtttgacaaacctgagaaaaacaagcaatggggaaaggataccctatttaataaatggtgctgggaaaacgggctagtcacatgtagaaagctgaaactggatcccttccttacaccttatacaaaaattaattcaagatggattaaagacttgaacattagacctaaaaccataaaaaccctagaagaaaacctaggcattaccattcaggacataggcatgggcaaggacttcatgtctgaaacaccaaaagcaatggcaacaaaagccaaaattgacaaatgggatctaattaaactaaagagcttctgcacagcaaaagaaactaccatcagagtgaacaggcaacctacaaaatgggagaaaattttcccaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaagaaatgctcaccatcactggccatcagagaaatgcaaatcaaaaccacaatgagataccatctcacaccagttagaatggcaatctttaaaaagtcaggaaacaacaggtgctggagaggatgtggagaaataggaacattttacactgttggtgggactgtaaactagttcaaccattgtggaagtcagtagggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaagtgtccaagaatgatagactggattaagaaaatgtggcacatatacaccatggaatactatgcagccataaaaaatgatgagttcatgtcctttgtagggatgtggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtggggggaggggtgagggatagctttaggagatatacctaatgctaaatgatgagttaatgggtgcagcacaccagcatggaacatgtatacatatgtaactaacctgcacattgtgcacatgtaccctaaaacttaaagtataataataataaataaaaaagtaggagaaaaagataaagccaaaatatcagagatatacaaattaggaaattattctatgaagactaatatccaattaatagaagtatcaggaagaattaggaaatcaaaaataaggaaattattaaagaaatacttgaagagctatttcccaattgaataacaggagtgttcgagattaaaaggagccctttgtatacccatattggttattttaaaagatatataactacataatcattgtgaacactaaggatacaaagaagatcctaaaagtttcctggaggaaaacacaggccatatctatgttagtaactatcagattgtcactggaaaatttcttcaacattggtccctaaaaaacaatgaaatgacagcttcaaagttccatgaaagaacaactcaaacaagatttctatactcaacctaccaactgactgaatggctggggctggggaaccggaaatttattgagccatgcccttcctttgctagatgctttattgtgattattaacactcctttaaaggaagtattatttttgccatgcacagacaagatccactaataggtcgacccaaggaataagtgtcaaaaataagtgccacagtcagaaaacatacctgagccaatctgctattcttcttccagagtatatcactgggcctttgaacacacaaagacaggccagctcatagggaaaagaagatacaatgtagaaacagggagaaccatccactcctgggactttgaggcaaggttagactgttgccatatgtaaaggaacattatgtcattgttgctaccttggcaaatttcaaaggttattgttccagcttcccttccttttctttcctttctcctttcctttctccctttctttctcctttcctttcctttctttttccttcctttcttccttccttccttccttccttccttccttccttccttctttccttcttttctttcttttctttctctcttaaattttattttaagctccgggctacaggatgtgtgcaggatgtgcaggtttgttacttaggtaaatgtgtgtcacggtgatttgctgtgcccatcaacccattacctaggtattaagccgggcatgcattagctatttttcctaatgcccccctctccccgtgccccatccccatgcactggacaccccccagtgtgttattgttcccctccctgtgtttatgcgttcatttcattcagctcccacttaaaagtgtttaattttctgttcctgcattagtttgctgaggatgatggcttccagctccatccatccccctgcaaaggacatgatctcattcctttttatggctgcatagtattccatggtatatatgtaccacattttctttatccagtctgtcattgatgggcatttgggttcattccatgtctttgctattgtgaatagcagctatattttcttatgtaaacatagctaaagatattttacaaattgaggcacacccagttttgaagttgaatatgaccaagaagcttccattacagatagttaacttattggtgctaacataaaatatctgtacaaataaattcaaacagtggctcactcctgtaatcccagcactttgggaggctgatgtgggaggatcccttgagcccaggagttcaagaccagcttgggtaacatagtgagacccaggctccacaaaaaattaaaaagaaaaattagccaggtgttgtgacatgcacctatcatcccagctacttgggggactgaggtgggatgattgcttaggaggtcaaggcttcagtgagctgtgtgatcgtgtcactgcactccagcctgggtgacagagtgagaccctgcctcaaacaaacaaacaaaaaccaaaatacaaactcccctacatttccaatgctatttcaacctatctgttgaatctcattcataagctcatgaaacaaatattcattatacctgaggtcctagatgctgtgtcaacaacacaaattccctatcctcatgaagctttcagtctaggaagataatgaagagaatttggtgaaagagaagaatgcaagcaggaggaggaagatttacttggttagagtggtcaggaaaatactttccattgaggtaacaattcagtcgattcaaataatccagttatgtaatggtcggtgtgatgagtggttgcattagaaggaaatggaatagtagtgcaaacacctcaagatgggaaaatgcttggagcgttcaggaactgaaactgtgccaaagtaagtgagagaggatggccaaagatgaaattgaaaaggtaattagagccataattcacggggcctgtaggctattgtaagaaattagaagacaattcaaagtgtgatgaaaaaatctctgaagagctgaaagcacagcaaggacatgaactgatgtatggttgcatgtttgacttacctaaagacctcaccatgtgcacactccactggcatctcagaatcaacaaacacagacatcatcttccttgcccccaaagtcaccatttctttctattcctctcctctccccattccttttccaaatatttattgaaaatcaactctgtcaaaatacttcctgagtccctatagtagtcaaacagcaaaatattgtcatctcagcattgttttatttcctcacccacacacccacacaactacatcctatgaactgttctgcaaaatgtctctcaaactctgcctagttcaagcttttattacgactcatctaatataaataataatagcaataataatattgctactacccacaacaattattacaactacttctaatacaaataatgcttaccatggatcaggctttgttatatgcattttacatagattaacacatttaattgtcacaaaaatcctgaggtctggctctagatatacaactacacacggcctcgttaaagtgctcttaactggttgccttttctctgtcctctttctaatccatcctactcattttattgacagactaattgtccccacacaaagatctgatcaagccaaaagccatctgtggttccccagtgcattgagaacaacattcaaactccttaagctgataatcgtcctcccaagatctggtcctaatctatacttcccaattcagagcacacctcttctctacacataacaaagttttgctacactggaatcagtttatttctaattattttcaatgcactaattctcaaattgtggtatgagcacctctagggatccctaaaattgctttaggaggtccatagatcaaaaccattttcataatacgaagatgttatttgcttttgtaactctcattctctcatgagtgtacagcagggtttcccaggcactctgtgatatgcgatattacaacagactgcagaagcacatatgagaacctgtcttctattaagccagatgttaaagagatttataaaaaacataatgtaatgctactcttctattttgggggatatatatagtaatttttcataaaagcatgccattgatgttaatatgtaatgagtttattattgttatttttaattgaattaataaataatttaactgtcaatagacattaaccacattaattaaagaactttgaggttctcaatcatttttaaggttataaggtggtcctcagaccaaatagtttaagaaacactgttttttttgtttttgtttttgcttttgttcttttctttcttgctttctttctctttttttttttttttttttttagagacagaatttcactctgttgcccaggctagagtgcagtggtacaatcttggctcagtgcagcctctacctagcaggttcaagtaatcctttcacctcagcctcctgagtagccgggactataggtgcatgccaccacacctgtctaacttttaaatattttttgttgagatggggtttcgccatgttgcctggactggtctcaaactcctgggtttaagtaatctgccacccttggcttcccaaagtgctggaattacaggtgtgagccaccatgcccagtcaaaagaaccactgttctaatgcttaagagtacatgctttaaaatcagattgacctggagttcaaatcctagtgatactgataatttttttgaccccaggaaagttaaagttgtatcagaatactcagttttctctacagcaaaatggggataataattattgaccttacagggtaatatgagcaaaatgcttaagccagagttggcacacagtaccaaatggtgccaaatgatagattcttcccatttcatgactaacataatgatcattatattgtcatcttctaaacatgctccggggtttcctggctcagagtaattagtgatattcttgtctctgcagggattgtcctctcagagacttgtctaactactgagagccaactgtagtaggctagtatttgtagaatgcagacatcactctctctctcactcctatagaaccagaaagaccaaagtattgtatttgttcttgagtttctaactcatgaactgtaagagtctggtgcctaagaaggagaaaaaaatttttgaagatcaaaatcttgcctttaaatactgatccacagttcctaaaagtatgaaaggtcagtattctggggaagaaaaaggaaagaatgcaagtttattatataagaacattattataaaaggagaccaaagtttgaccaagtggcagaaagtaggaaatcaataggcttagtctagagattaaatatctactcagcctctcatgaggcttatcaagcccagtcctggggtaggaggtaactaatggaactagaggaaagttgtagaaaattccacaggcagtattgggagcgtgttccccgagtcctaaagtatagcccagagaggttgtaagcttcttggagaaacctcatgtctaaccaatatggtgcttgagtaatggttgtaaccactgatcatacagactggctgaagacatctgcttgaagtcctgtagcctcagtatagaatgaaagagactgctaaaagtagcttcatctccttgagagaaaagcagaaacagttaagaacacagtgatgaacccaaaggtgccaggagtcaaaatgagggcacggacatggtactggaggtcatggtaacaccacatttaacagcagcaggttaacattaacatgaggaaccagatacaaaaaagtcacacccaagccaagactgggagaaaacatatacaaaacatgtttgctaaggaacttatattcagcctatttaaaacaacttttacaaatcaataattaaaagacaacctgataaaaatgggggcaaaatatctgaacagaaattttaccaaaggatatatatgagtggcaaataagcacctgaaaatatgctcaacattattagtcattaaggaaatgaaagttaaaaccgcaatgaaataccattgcatctctactagaattgccaagactaactatgtcaagtgttggtgaggacatggagcaattgggactctcatactttgctggtgggagtggaaaatggaacactggaaaatatttgttattcccctataaaattaaacacacaccattcaatccactcctgtatatttattaggaagaaataaaaacatatctcaatctactcctctcctgcatatttattagggagaaataaaagcatgtccacacaaacatttgtacttgaatgttcttgtcttaagtttgaaatttttaaatttttaaatttttataatagagatgggatctcactatgttgaccaggctggtggtcttgaactccaggcctccagtgatcctccagccatgatctcaccttgacctcccaaaatgttgggattaaagacatgaggcactgttcctggcctgaatgttcttaacagctttatttataagccaaaaactggaacagcccaactgcccaccaactagtgaatggtatagtacatctatacaatgtaatactacttagcaattaaaaggaactcactcctattaaataccctctaaataaatctcaaaatcaatgtgataagtgaaagaagtcaaacaaaaggctaagtgcaatctgattttattcatataacattatagaaaagacaaaactatagagtcaaatggcagatcattggttgctagtgcccagtggtggtaggttgggattgatttcaaaatagcaggagtcagcttttggggatgatggaaatgttctctgtgctatccagtatggaagctcccaagccacatgtagctactgaaattttaattacatataatttaaattaaataaaatttaaatggaaataaaagttataatggaaagcttgtaagcaggattgaaacaatttggacatttgaacctattttttcagctgtgaattttataagttctaaataaaaattaagtatttctagtaaagatatattgtctgagttgagatatgttggaagtgtaaaatacacaatagacttgaaagaatggatgtgaaaaaagacataaagtagctccttaatatattcttatattgattccataacaaagtgataatatttgaatatattaagttaaagaaaatatattattaaaattaatttcacctgcttcttgtaccattttccatttatttatttatttatttatttatttatttggagacagagtttcactcttgttgcccaggctggagtgcaatggcgcgatctcggctcaccgcaacctctgcctcctgggttcaagtgattctcctgcctcagcctccctagtagctgggattacaggcatgcgccaccacgcccagctaattttgcatttttagtagagacggggtttctacatattggtcagactgatctcgaactcccgatctcaggtgatccgcctgcctcggcctcccaaagtgctgggattacaggcgtgagccaccgcacctggcctttttcttttatttttaattgacacataatgattatgcatcatcatatttatggggcacagagtgatatctcaatatatgtatctttcttctactttttggaaatgtggccactggaaaacttttaaattatgtacctggctcaccttatacgtctattgggcagtactgttctacctcatgactgtggcagtggttacaacactgtatgcccttgtcaaaacatattgaattgtacatttaaaactagcacattttttgaaatgtcaattgcactttatgcagctgattaaatttaaagagacaatctacttctaagaagaccagccgagttacactgtagcaggagacaggatgagtaacacaggaagggggcgctgcagggacagaggcctaaagggaagaccaggaaaggcaagaggctccttggctgattgtggtgaggacagaagatagcgcaggatgccattccgacagggaagtaggaaagtacaggaggcttttgtgggtgtaaaatggaatgtttagagcctaaattatcagcttaagtctgaaaacgattgtataagcatgaattggctaaattacatttttttttccatcagcagatgtagaagttaaaatctagaaataaagctgcatttttgcacaagcgagctgggggattattacaactacgtattttaagccatctatgtgcattttcctgaagctcagctcaagcagctcttctcccagagcttcttcaggacattggttaaaatgaatgtgttcccatatgagcgttcccaaagttcagcttatattcctattatggaaaatttcatgtacccaggagccaaagaaagtggaattaatgtccttacagaagggcaaagtctacaacagcatctctgtgctgcctggtcatcaccaagttggagaaagggctaagggcaggtgtacctgaacatcccccctgaggccaacccatcagctatagtgtggaacacactgtgcctcacactgtttaagttctctacttgggagaaacccccttttccattatcctgtataaatgctgttgatttgtcaaggcccagctaagtttttgtcttttcccataccactttcattttctactgctttgaaatcctacactactttactgtttagcaattgtgagttattaactattgggtcctgtgtgtttattctgtctcctcaatcaaatggtgaggttcttgggggcatgcctttcatttccatagtatgcagtggtttgttagtctttcaaactggctgatcaaatgttggcagcattgaattccctagaaggaaaaaccatgttgttcttccttattaataaatatgatcatagagaaaaactgccgagcagaacagcagcagcaatgattttatgagcatacccacagccacgttctttacattaattctcacgttttgtcttctaaatcaaactacatgatacctataaccatggttcctcaagtgactggaggtaccccagggcaccacagtgaacttacaggaaagccaagacagattttaaagttttgagggaaacacttctgtgatacaccatgcaaaatattagcttgaagtagatcacagttgcaacattagattgtactacatgacagatctttgtaaaggttggttgtgatgaaaaccaagtatggtgcaaaattcaacatggaagagaaaagtctgattccaagtttcaaggaattatgcagtactcaacaggcacacatattctactagtaagttcttggtgtttacttaaaaattaaatttttttttctttcaatatgtatatttttcaaaagactcctaaattttttgaacatacatatgtatacagctgtttgggcctagctacgtaataaagaaattgttagatttttttttttttttggcataggggtgtgttaaacaattactgagacactaagggctccattaacagaaaaagtttagcagtctgcaccctgtaaggctcacatcattgttttcaggttgtagttgaagaaggtgatgacctagagtgttgagaaacttcccaaaggccctacactagtcagtgtcagacctaggattcaattccagcttcccctcaatataaaactcatgccttctttcttcctttcccgccctcccttcctcccttcctcccttcctcccttccttccttcccacccagggttttgctatgttgcccaggctggagtgcagtgccgtgatcacggctcactgcagcctcaaactcttgggctcaagtgatcctcctgagttgcctcccgagtagctgggattacaggggtgggccctggagctcagatcgtgtttttcatcctgggtttactttaagatccttcagatcagctcctggaggcagccaccaaagagaaagcagatggtccatggagaagtaatagtgggagaagatttcccctgcagctaagagagggcagtgggaggtcacagaaagtagcagggtgagtgaccttgactgtttctgaccaccagctattaccacaacataaatttacactgaggaattaagagactaactaggggttccatggggagctcatccatcctcctagaccatgacattcccccacactaacatcagagggaagagtgggtaacttatcagtaagtagagcagttcttgaattcagttcatttgcttctgggatattcttggatttttattccaaccccaatacacttcaaagaatgacaatgtgacccttttcttgtcctaatgatctgggagcattttcctcaccattatgcacatgttactaccctcttaagaggtcagtaaagctcttcatttcaaaacctgatttatttgcattcataatctccctgttagctaggcaatctgcataataacctggcatgaaatatttttaaccaggctttccaaaatatagaaagaagccttcctaataatggaaggcattcactatcttaaactggaatccatttacagattaaatttgccaagaggtcagcttgcagctgccactgtgttgcaagcccgcatgtcctctgtgtcacatcctgtgacatatcttgagaagagtcagggtcttttccagtctgctggttctgtgtttcaattagaatagatttaagagtccccaagctctggtttctaggtggctttgcacaatattattaataattcaatcatacctatgctgataacagattacatttctaccatcccacaaaaaagcccaaacagattaaggactacccctatggctaatttctttagcagtttcatatctgattgacatccatttatctaattgcagctagaagatttaatttccatttcattggcttaaaattaataggaaaaacctgtttactttttaaatatttgactcatcctttctcatctcctgaataatgttgagatagtccattctatgggatggattctacaacttatcagttttcattctctgaattcatttcaggcaagcctagctatttacaatttgaagtctaacataaaatttaatctttcattgcaagtaatttcatttttcacgagcctaataacaagaaggtagcagggtgttcatttagaatttcaaaaaattttgcagatagaaaaaaatttgaaggctatacagctatggatgcaaaagctagtttgatcatttatgagctacaatgcccagaataggttacttaactcagatttgagacaaggatgagacaagtgtagtgcctcaagtgcaagatttaaaggaagtgctcactcttggtgttatgcaaggttgggagagcacatgtacaaacatgcagtgaatacctttatccttaaattttgtgccatatgattgttgcttcctttactctagtcctgggaagatctctgaccattagttgcctcatctgcaaaagggtgatggtaatagcaaccttcttcatggtggtgtagtaaggataaaataaaataattcacttaagcacttagaatattgcctggtacatagtaagcacttaataaatgctccatgatgttactgttaataatacattacattgtattgtacaatttgatcatgttacctatagtctttcagaagtttcttacttttttaagaaaatgtataaaatcatatttttaaaaagaatatagtataaaatcattagcatgtcccccaaacctagcataatctgactccatgtacttttctgtcaatatcttctaaagctctccctgaatatcccactggtcttcctttgggttcttaaataatttatgttccatattcgtctacctgtcacagggcttctacataggctgttcccagtctaaaattcttttccatcccttttcatatagttaactctgcctcatcttttatatcatagttcaatcatcatttccttagggcccagatcagattgtctgttagacactttctttttttttttttgagatggagtcttgttttgtcccccaagttggagtgcagtagtgtgatctcagctcactgcaatctctgcctcctgagttcaagcaaagctcctgcctcagcctcctgagtagctgagacaacaggtgcacaccaccatgtccggctaatttttgtatttttagtagagacggggtttcgccatatcggccaggctggtcttgaactcctgaccttgtgatcctcccacctcagcctcccaaagtgctaggattacaggggtaagccacggtggccagcctcttgacttttaaaataaatcacagttggtacttatggatttatttttctgattattggattactttctctctatgccactagatgctaagttagttccaagagagcagagacctttctgctttggttggcaatttatcctcaccacagtagcctgcaatcagtaggtgcacaataagtaattgtttaaagaaggatataaaaataatattgccactggctatcctagccagggacgaggaagacacttcttcacatgggagactattgccttttggattaagagttcttactgcttgtcttcctcatagtgaacccaaatacctcttccctctatatggccacacctaggtccaattttatttcataagcaaccactttctttgaacattttattagttcacaaatacttgtcaagtgcctagaatgtgtagcacactaggtttagttgggtatatacaatgaataaaggtacacttcctatacttagggttttttcagcacagtggaggacgaatcacatgcacaaagctctgatttaagaaagtgtagagtgtatattcagttccctaagaggccaggtgcagtggcccacgcctgtaatcccagcactttgggaggctgaggcgggcagattgcctgagctcaggagttcgcgaccagcctgggcaacaaggtgaaaccctgtctctactaaaatacaaaaaagttagccgggcatggcggcatgtgcctgtagtcccagctacttgggaggctgaggcagaagaactgcttgaacctcggaggtggaggttgcagtgagccgagatcgcgccactgcactccagcctgggtgatagagtgaggctccgtctcaaaaaaaaaaaaaaaaaaaaaaagttccctaagagaggtacagcataccctaaagagagtgaccttatcatctgaggaatcagtggccacttcctgaatgaggagattttctgaggtaacatctgaagaatgagtgggaggtatacacatgaagagtagtggggagagagtgagcattctgaaagaaagaatagaggggggatatttaggcattctgcatacttgcagagttgacatatccacgatctcttgttctttcaacttttcttttttctttttttttttttgtttttgagacagagtctccctctgtcgcccaggctggagtgcagtggcacgatctcggctcaccacaacctgggttcaagcaattctcctgccttggcctcctgagtagctgggattacaggcgtgtgccaccatgcctggctaatttttttttgtatttttagtagagacggggtttcacaatattggtcaggctggtcttgaactcctgaccttgtgatccgctcgcttcggcctcccaaagtgctgggattacagacgtgagccaccgcacccggcctctttcaacttttgattcattcattcatctgcttattaattcataacaaacaccaagtaagtctcttcaatgtgtcaagtactaccgtcatatggaaaaaagactagtccaagctcttctggggattatatgctggtaagttcaaatcctatctatagccaagaaactctcacctaacttgcagaaaatgttgttaaaaacactatgtgttcagccctgtaggcagatacttgcctaatgctttatttcaggcttttttggaatgcagctgtcctctggaggccctgtctgcccatgcaggtaagatgttctgaaggcaagaatgagtttatattcggcggaaatagtctatttcctgtgattttagaagcatagagtcaagtgcttaaaacagaaacagtgccaaataaatgtttgtccttgttattattattgcctcttcaggatggtaggagaaggcagagggaaaggattgatgctttggaagaggtagtcttcacacgcagccatcccatgtttaagaaaggcagggaggactccaagggtcttactctctcccattacagtgtctggccatcttagcccacactttcaaagtagccctacatccaaggcagaaacatgcaaggaagttctatgcttagtaaaaattgaaagaaatagaggccaacatatagttccagtaatgactgaaattctatttatattctaggcctctttactttttgattttctcattttcaatgttttttttttcaaacatcacattaaaacagctcactcggtctcttgatctccactttgcctttagctgaggaccccacaagacatggttcttggtttgtatgctcatctttattttgaaaaacataaactgaattgagagatgcaaaatttgaggaacgctctctaataccataaatatacattgattgctgcccaatcattcaactttaaggactaaaagctaaactcttaaatcctttagtgaattaaactgcaaaaagggatacttaaaggtgatgggactatttactccccatttacctcctacgtcctactaaaatggacctagctcagtgcttttcacttactacttacgtggtctttggtaggatttttgttctggccaacccaacttcaaatctatgaggttataaggaatcagcaaacaaaatgacatatggtggagagcaggtggctttgagaggcaatattaactatgtatatatgaaatcacaacaactataaatatttaatttccaatgtttgaaagagaaaagagggtttctttgaaagtggacttagtgcatatgtaaattaattacaattcatgacattcattatttcagaaaatgatgcaataatttaaaaccaatattgacagtttgaatgttacaatacttttaaagatttattgccatacattttcttttcccgttaaagaagaccttctattatgagcaagatgaaatgcaaaatagaggccacatgctttctgcttgtcaagcttgtgtaacttggactcagaggagaacatccatggggtcctttgggaagcagtggttagggtggtggcagtttacacaattgtcccactgcactgcatcctggtacgtcattacaacctatgtaaagatcacctccaaaattaatgatttgtatgctttcctgggcaccattctaatctctggtgatcttcaactttagtatgcatctgtatcaacaaatttgatctcctgacataatcagcttttaaaagcacttaaaatctgggaaccaattaggcattcatatggtgtaaaggagctattgctgcaaaaaaatgttgttggccaggttggccctaatttgaggatgagacatgagtagatggggacactggcaaagaataaaggtcatatgttgatgaataagtatagggttgggttttatgaacaaagccatttctttggctacataatgtagacagcagatttggtagcccaaatggaagatccaagacctagtgggagttggcatatcttgtgtggtacaatttagggccagggtacttaaagtctttctctagctcaaatgtatctcccctactagtcctccactttcagtattcgaatcgacagtggcttccaaaaaggtcattttcataaagatgttctggttaaaatgcacacattagagagctaaaaaatcaagatgttgttttttctcttttcttttattctccatatcaaatttaacagaagattcaaggttttatgtactacattgctctcagatatatccttatctatcttcactactaccagtctggtccaagccaccatcatctttcatctgggcttggtaacagcctcctcactggttttcttacatctaattttgcctcttgaaatttgctgtactctgccaagtagccaggaaaaaatttttaaaataaatgtgaatcagatcatgtcattcttctacttaaaatcctccaatgtctgccacttggattcggagaaaaattcaaattgctcaccctggcattcaatgcaaaacattcttcttacagccctttgcatgcccagctctctctcattcatacatcatcttcccctcctactcaataaatccaaagaagtcattctacctatgtacacacacacacacacacacacacacgtacacatgtgtgcaatttacatacccctcccccactgctattccttcataacaattgccactatgtgaaattttagcactccaggcattcagccctctgtcctgaagatgttgttcctttaccctaagtttagctgtcacactcaggtgcagagttagagaaagaaacataatatttccttaacgactgactcatagattcactggcctttgttcctttccaggttaccattctatttggtttatatattatgctgcattctgagccactacaacaaaaatcactgttattgggcccttctcctctgcccaaattcttgtgcttgcctcctccttgctaatatttaaaaatcattaaccaagacaaaaaaaatcaatttcaacactgttacaacatctttgtcttctcatccttttttgcaatgaaactcttttaagaaaacttactgcctcattactctgaattctcaccctccaggggtgatggaaaagtcatgtttttagaaaccggacttgtaagacacgtgactttcactttggggtgagttatgtttcccattaaactaaaagctccttgaagacaatacattagtatagcatctctaaagaaaataaaaaattgtatcactttgaagaggtttgtacagcatctgacccacggtttgtacttaaatatctgttttgaaacaccacattacccacaacaaaaaaatgcaaagggttagtacttttaaaaggcatttcaatttttgagttattcaagttcttttcatcccagaagagtgaaaaaaaagaaaattctaaccacatgttaccaccgttttttttttttttgacgactcagaggaagttctatctctttgagtatatagtaggtctcattatatatttaatcaaatgatttcaagtatgaatgctgggcagagagtgacagagagaactaaagcaggtgactttccttcattcttctttatctgtcttggttgctattgtactcctacagccaaactcaatatctgacacgtgactggcacctgaggtatgtgaaataaatgaatgaatgcatgcagctaatacatgacagagtattccaagccaggtttttttctgattaaaaacccgtatcccacaactaaactgtattgacttccctcatccatctgagtgagtccatactcactcagctccaaacagtagctccagattcttgctatgtagttgagtgtttaatgtttaatctgtagactatgccagaatagcaactctacaggtgaaaagctcagtagtttcaattttgtgacttgtagtaagaaaaaaagttgggcactgaattaaacatttatttagaaaattaaattgaaccagtttgcatatcatggcagccactgatatagctctgcctcttaatagctgtgtaacttttgataagttacttaacatcttaatcatgaatttgctcatctaaaaattacttatacaaatataagtaattaccaaaggtatttttgtgagaagtaagaaaacgaaggtaaagtacataatgtgtggcatgtaatcaggccttaagtgaaggttatagcaattattacaaataatccctatattataggaattatttgggtttctgaaaaggtggctgggcagaaaagatgaacaatctcttcctttgagtctatttgctgatttaaatttagtggcaaaagcaagctgcatcatagttgctcctgtaataaccagcgacatgggctctacaccctgcctgcacaggctgtctttgctgtgcactataaagcctttgccaggcccaatacagtgtgaggcacacagtgggtgctcaagaaatgcttgtgttttccgatgccactttttgatccttgctatataccctcctcgactgccattatctatgtttgtgcttttgtcaccaagcgcctacctcagtaaaaggtcattccttgtacagcattatatatgagcctcagagccaaaaaaatgtttattctgctcattggtgtctatcaatttaagaaatccattttataaataaggatcttcatttatatagaggttcaaagttatgcccaagggcacacaattaatggtagagttggttctagaacctaattgacttggtcccttcacattttttataaataaggtgggttacaaataaataaatatgtatcttctgcctcccagttaatattctaataccacagtggctggcaaaatcaacctcttcaattctttagttcaatcttatttcataatctatctgtagcaagatctgaggtgaagcaatgtgagcagtctaatgaacttagaaatgatacattttgctttcctcaccttttactgagtcctgttgttttatttgctactcaaggatgcgaagtatctgtttaacagtaaagtgccaagcaatctgacatctcctcctgattaaaacagagtcatctcaaatacagatggatacatgtcattatgcaagctatctgcttttcagagctgctgcctcaaacttcctgcagtaagatgccccctcacactccctgcagtcccccatccctggcactggctttccttgaaaacatataatcttgtctacctgcatttttgtatgtttaggctcaagcaaagaatccattatgaaaatgacagaactgccagaaagaattatgacttcactgcttaacaagctgtgaattcactgtggaggtagcaaggcagagaagcaaagaaacaggaggaagaatatatatgaagggaaactcgccttgggctctgcactactgcaagttgagaatggttttcccagcctttcaggatttccatgtttgctccaccacaaactacctaagtttctttccatagtatggggcaggatttttgccttttacctaaagttggtaatacttagaatgatgaagttgatgataatggcagcttgcatttattgagaggtaaataggtactaatagtaggctaagcatttgtgaatattattttattcaatattcacaacttctctatatagccctctcatttaaatcctttaaggacttcccattgcctttaggataaagtccaaatgttttaacatagtttatgagactctctgagattccacaaacttttgcctctctctcaacctcatctaataccactctgcccctttctggatgggtctggtctcatctatacttttggttcttcctgtgtttatactttgtcttgccaataggcctttaaatatattcccttgtaaccacatttctcccactagtcacctgattatctcatacctccctttaagaccttactattttttttcctgaagaggctatctccagttttccctgttgtttgcttccaaggttaaaaaagaggaaaaactcttttgtaactcaatacttgaaatgactatttaaattgcaccttttctgctagatttaacctctacgaaggctgacaccgtgtctactaattcacagttgtttcactagcctctagctgaatgcctgacacgagtagactttgaataaataattagaaatcaattatatgcaaaacctatatatgaaagttcccatttcctagatgaggaaacaggttaagaggagttaaataacttgcccaaagacataattagcatatggtgaagccaagctttgaatcaaagactgatgtcaaaacccatgttcacaattactctacagcactgtcttctcaaaattccctccagctatcacaggaaaaataaagaatatttctacaggatatttgtcttagagaaaaatttagtagaaaaagctcccaggattcagggaggtgatctttttcccaactaatttcagagctacataaaagaagctcagtgatttaatatctttctgcaccctgggcctgatggtttacctccccaaaatctggtttctgtttctcaactataggtggtagtggataacaggcaacctatagctacagctgttagtccttcccacagatcaacatgcaaaagagaaagtgagtttctcacattctgagagagatgttgcccaggcaacaaagacaaagccagagcaacagaccacccagctgagacaggctctgtcttccgcacattctcccataccagcgcccacttctgtggggcagcagatgactatgttcatacacccttttaatggggtgcccctgaaggactcacctgccacaactggacacagttggcaaagacatctccatggacagcccaaacaatagctccagattcttgctatgtagttgagtgtttaatgtttaatctgtagactatgccagaatagcaactttacaggtgaaaagctcagtagtttcaattttgtgacttgtaataagaaaaatagttgggcactgaattaaacgtttatttagaaaattaattaaaccagtttgcgtatcatggcagccactgatatagctctgcctcttaatagttgtgtaacttttgataagttacttaatatcttaatcatgaatttgctcatctaaaaaatgggcttacaaatataagtaattaccaaagatatctttgtgagaagtgagaaaacaaaggtaaactgcataatatgtggcacataatcaggccgtacatgaaggttatagtaattattacaaataatccctacattataggaattatttgggtttctgaaaaggtggctgggcagaaaagatgaacaatctcttcctttgagtctatttgctagtttaaatttagtggcaaaagcaagttgcatcatagttgctcccgtaataactagtgacatgggctctacaccctgcctggcacaggctgtctttgctgtgtgctataaagcccttaccaggcccaatacagtgagaggcacacagtgggtgctcaagaaatgcttgttgaggctgtcaaccatgggccgtgcaggcagtttaaagcacagtaggcatctggatctttaaaggaaattgtaccgttctaagagtcattaaatgagttcttcagggagggcagtaacaatatgccacctgattgctttgttcagaagtgctttccgactgagttaacctactaaagatgctgttctttgctacataacttcatgactgccagtccctgctaggaagtggcttttcatgatggcttgctggtacgtgtgtacatggaaggaagaggctggctacgggggagagagccccagagcagaatgaagctcctgccaacctgttccagcacactgctccagcacactgttgtgtccttttatgctgtgtgtgtgtgtgtttgttttgtaggggagtgggtgggtacgtctgcagtatcccctacgtttgaaaaacaggtctgaatctcatagaattctgttagaaaatcattcctcaagcataacttaattttctgaaagtattttatcctttgaccaccaaaacctctttggagagaattaaaatggaaaaatgtgttaagtaagtacatctctaaattaaaccatttctgcctgggcagaccaaattagtcttttctagggtgcagggtacagtatgttgtctctggtctttgttcttcagtaaaagacttcagagggaaaaactattctagagtgaataacctccaaatgttaattttgcaaaactaatactagtgactcattaatatttgtaaatcatctagattttgctattttgaaaaaccccataaagtgctaattaataaaagatatcatgtcttattaatgttcacatagtaattaccaaaatcacaaattcatctgctaagtagtcagcaaacaagacaaatgactgtgctcagctgaacagattatcaaatgcctttgggagtacaacctgatagccccaactaaaccatgaatcaagcagctactccttttgccacatggacaggcaacaacaatttcatctctcatgtgaggtgggacagagcagtggagacatccagcaactcgcattccctagagcacacgtgcttatgcaagtgtcagcattgctcgtgtatctttctcttacaagcttttactgacacttaagatttcgtttcttagagagacatgagaaaagactcaaaagatgtcacctaaagttaaacataatcctgctagcttctgcatgtaaaatacatattggtgagccttctcagctctcaaaatggagaagaaatttcatcttcctgtgaacttctatatcagttcatctctgcttctctgtatcagttcatctctgtttctcttctgacactcattacctgtacacattccacacctcctcccctagaaaggcatcttaagaacagagaccatgtctcactagccattcaagtataacaacaagtactactactattaattatttagatgcctaccatttcttatggctataaatgtgcaagtcacttggatgagtgctttaatttatttaacttttatttcttcttgtcatttaatatttacaacagccacttaaggtaggtatatcttcactttaccatgaggcaaatgaggctcagagaggctgagtgacagaactgggattcatccctaggtctgaaagattctaaagcctttgctaaactgtatgctaaactgtacctatgctaaactgtacctatccaatatggtgcctagttgagggttaagtacatagcagacattgataaatattggtagaatgaatgaataccttaatatcaattagcttctgcatccccttggtggttaagattaaacctttgcagtttctacttttctgttttcttccaagtgtgcatgatatcaaggattattgttagtactgtgtatcaaaatgaaagctcaccttaccttttttatatcagaaaataaacacctctccaggactctccctcctagctcagagactgccgggatgatattcactattggacacatttgatggcttttcatttgtattggtgttactcacatgttggactgtaagctagatggtaggaagcagcctagtgttcttggcatctcctcccagctctcttcaacatcctagactccacagcacatggggcggggagctcagggtctggtggccactgacttcacaatagtcaatgtttcctaatggtgggataataggcttttgctagtttaaccctctcagcacatagcattctcccactatcctggtaacagtacctttacccatatagcccatgtgcttggaggaagtacaccctactctcagttctagagtagaactctgggtggtttaagcccatcagcacatcccattggctttgctgcagtgatcagttaaaatcagaagactcagttcaggccagtgagaaacaaggaggtgtttgctggggcttctgggaaaaaatgcttcctggctcagagaactacgagggaagaggttctctctccctgttggagattcatgtagaacaataaagatccggaagatagtggaaataattttggaagtgtaatggaattcagctttaggagtaagcgagatgtcataggaagccaagaagaaaaatggaaaaaagtatttcatttgatgacataggtgagccatgtaatcaagccttgctccaaagctttgacagctccaggtttttccgctacatgagagtctaaatttctttttttgtttagccggttttgagccagattttctctgacttgacactaaaagattctcaatatatctaggtgacaactttgattgtttcatgctcatcctcatatttactcttctttttccagaaaaacaagtatgacagaggtctgaaggaccagaggggaccacttattagctcatcacaaacttgaaacaggcaaaatgtacctgtcagagcctaagtagaactggattgcatgatgtatggcagtgatcttccagagcgctctcaagtgtgtttgacacgagtgaactgtgttcgagttgattctccctatggcagtcccaaagcctaattatgaaaacacgataagatcattgcacagttagaccattgcaccattggcattcctaataaacagatcagcttagcccagcacgatccctagtgggtttgtcggaagcccttcttgggtttcacaaatactaaacattttcaaaggaattagtgaatggtaggagtgcaaattaattcagccattattgaagacagtgtggcaattcctcaaagacctaaaatcagaaataccatttgacccagcaatcccattactgggtatatacccaaaagaatatacatcattctatcataaaagacacatgcacacatatgtttattgcagcactattcacaatagcaaacacatgaaatccacccaaaggcccatcagtgatagactggataaagaaaatatggtacatatacaccgtggactactatgcagccacaggaaagaagaaatggtagtttgttcctttgcagggacatagatggacctggaggccattatccttaccaaactaacacaggaacagaaaaccaagtacagcatgttctcataagtgggagctaaatgatgaaaacatatggacacatagaggggaacaacacacactggggccttttggaggatgaagggtggaaggagggagaggatcaggaaaaataactaatgggtactaggcttaatgcctgggagatgaaataatctgtacaacaaatccccatgacacaagtttatctatgtaacaaacctgcacttgtacctgtgaacttaaaataaaagttaaagaaaatatcagctacttagataatgatgttcttctctgacacccctgtgctgtctttgcttacaaggacaactgcaactgaaaagcacaaagtcagcacaaataagagaattacaggtttcaatgcaaaaccatcttcaccaaagtataatggtagctgcctgaagttgaagtaacagcttggatctggtctcttggacttctgattgtgaaggatgggcccttcccaagtactggagattttaagtacaaggataagaaaggacaggacaacaggagtcaccaaagggggttatccagagagtgagaaaatgggatacagtagcctcttgctttttattagggccagcttcatagatgaacaacttgtgcagtcacacaggaccctgtggtcagaagggcctccttgtttaggtttatgatctgctttcaccatcctgaaatttgaaatactttttgaataagggaccataacttttcattttgctttgtgtccagaattatgtaggccatcctgcttgttatagatttttatttccctctttactaaaaatcacaaggagcaaaaagaatgtgttagtttgctgagaatgatggtttccagcttcatccatgtccctgcaaaggacatcaactcatccttttttatggctgcatagtattccacggtgtatatgtgctacattttctttatccagtctatcactgatgggcatttgggttggttcaccatatgcgttttaatgtatcatgatcttcttttggttaacagtaatttaactccagaaaatacaagaagtttgctccaatatactgccattccctcttccctcctttgtgctattactgtcctatatattaaatctatacatgttacaaacccaacactacagtgttaaaattattgtttcacacagtcctatgtcttttaaagaaattgggaaaaaggagaaaaaatatattttatggaatcttttatactaacatagttatcatttacagtgctcttcattttttcctgtggatttgtgctatcatagagtaccatttccggaaggccttccttcctttggtacatcttttaaaacagggctgctagcaatacatttgctcagtctctgtttatccaaaaatgtccttattttgccctcatttttgaaggatagttttgttagatacagaattcttgtttgacattattttctttttgcagtatggatgtgctattcttcttccttctggcatccatggttttagatgagaagccagcttaattgcatggatgctcacctttctatggtgcgtgctattcttcttgctgctttcaagattttctctttggatttggcatacaacagtttgacaatgatgtgttcaagtgtggatctatttgtatttatcctgcttgggtttctttgagcttcttgggtgtatagattaattttctaaaaaatcaaattttggaagttttggccattattttttcaaataggttttctgtccctttctcttctctccttccgacattcccctgacatggttgtttctgtgcttgagcttgtcccacaggtttttgagggcctgttaattttactgcagtctgttttctcaccattctctagattgagtaatttctattgatttatagttcactgattccttgtctctcaaatctgttgttgaactctctagtgaaaaattttaaattaccattattgtacccttcagctacagaattttcacctggtatttttaaaataaattcaatatccttattaagaatctatttgttgatctcttgttaccccacttttctttaattctttaaacatggcttgctttagttctttggaaatatttataatagctgccttgaaatttttgtccacgaatatttggtaacacagagtttctattaactgtttttcttttcttgagtatgggtaacacttttttttcttaaaaatgggacatttaagataacacattgcaacgactctgaattctgatattttttttccctttatggtggttgttgctggtattttgtttgtaactttcctggactaaatctgtgaaatctgtttcccctaggctactaatgcctatgctagtctaaaatatatatacattcctgattttatttatttatttatttatttactttttttttgttttcgagacggagtcttgctgtgtcacccaggcagtgcagtggtgcaatgtcagctcactgcaagctccgcctctcgggtttatgccattctcctgcctcagcctcctgagtagctgggaccacaggctccgattttatttttaaacttggcttgctagaggttgctcctgtgtctgtatagccttagtggtcagctaatgattgaacatcatttatgttcaaacaccttaaaccactaagatttccatcctttgccctttttcacctattttcaggtagaggagcatatacaaagttcaggctcttttcaagctcccctgagtctgatatctgctggacctttttgagtctcctatgcacatgcattgagactttgggtaaaccagaagcatataaagggcttctgtctcttcagtctccactgcccatatgcacagcctcagccagcaatatgctgtctctgatcacaactgcaacttcaggctgatggagctgatggccctcccaactcactcccatccaagatgatcatttctattgacaactttgcttggtgtctgcactgcccagctcttcaaactggttgagtctccttcaacatctacagagaagctactggtcatcatggcttgctgtaccttggcagaacctataggctgggttgaggtggatgagaggagccctaggtcagaacatctcagattcccagtgttcctgagtgatgtcccatgatttttaaaaaataaacacgtctcaggttgtcataggcctttggctgatttccagagcacaaatagttgaagtttccaactttgcacagctctatcattgcattttgggaagaggatttacccaacctcctcctagagtcatagctaaaagtccactctttgccttgggttttgactcgtctctctcttcttccttcattttcccctttcacacacttaagtccaacacttgctagtggctctagagcaataaaatctttcttgcacatataagataacttcagcaacagattatatagtactattgatataaaccacgcagattaacttgcggcaagtaaaagcattcagtgaactctctaaacaccgcttgccatctatccttaggcttgtggcctttcctgcaggcaaggagtggtggatatctgatgctgcctgcatgctgttacacctgtcacaactctagcacacatcactaaatgactgcaactttcttccccactaaccctagacatggtctcagaatcttcctcagacagaactccaggcagccattatatggatcagaagatgagaccttgtagccatactttcttctttttttttttttttagatggagtctcactctgtcacccaggctggagtgcagtggtgtgatctcggctgactgcaacctctgcctcctgggttcaagcgattctcctgcctactctctcctgttccctgagtagccgggattacaggcacctgccaccatgcctggctaatttttgtatttttagtagagacggggtttcaccatgttggccaggctggtctccaactcctgacctcgtgatccacccgccttggcctcccaaagtgctgggattacaggcctgagccaccacacctgaccaccttcaagtccccaaagctgaaatgtataattcatcgcactatctgctgtgcttccacatatcagtcaaggcttggggttggtttcctgaggaacatgtctttttttacttgtgcctcaagctcagctcctgtgacagtttttcttctgaacctttgcacttattcctttggtgatttcatcgattttcatgattttaaatcccatccatttattggccctttttaggtttatatatatatttttttagatcagatctctcccccaaactccaactctctacatgccatctccacttggaaatctaaaggacacctctaagtcaccatacccaaaactgaactgttcccacctggggcctcttccacctataggctttttccatcttgattgatattaatttatctgctcagatgctcagaccaaaaaaaaaatcaagttattcttaattctcttcattctctctcataccatcaggaaattctgctggttttactttaaaaatgaatcagaaccctgtgccttcttaccacggtcactgctaccatcctagtctgagaaataccatctttcacaggactattgcaactggttttactacttctaactttgatctctcatattccatactcaacatggcacccagagtgatccttaaaccctggtatactatactcagcatcgtagccagaaagatcattttgaaaaatgaagctgatcatatcagttttctactcaaaacattctggtggcttcccattttgcttagggaaaaagccaaaggcttttcagtgacttacaatactcttcatagtctgtcttgccaccttcttcaattcactcatctttcactacactgcctcttactcctttccagccttgctggcatccttaatgcttccggaaaacatgatactggctttttggagcctttgcattggctattttcttttcctgaaatcctctttcttcaaatatccaagtgactaattctctcacttccttcaagtctttgctcagatatcaccttctcaatgacgcccaccctgtatttataattgcaaaccctatccttcccatctgtgtgtccccactgcccgcctacctctctcttcttccacatccctctcactcattcccacatttctgttcttttcacagcatattactttctactatatgatttacttatttcctatccttaatgtttgtcatctgtctcctccttctctagaacgtaactcaaaatgggtggggacttttgttcagtgacatatcatttcacagtttctagaaatgtgcctggcatgtaatagacattcaaaaaacatctgttgaacgaacaagtcagcagtggttctatggttctgatatagttttagaaaacatgcaccaaatgtgagaacactttccaaagaaatgtcaggaggagcataggtaaaagaaatgtcaatagactccatgaaaaagaagagtccatggcaaaaagaaaaaaagaaaaaaattgattgggaaatgatggatataatatacttatcttggtcaatcatggggtacattagcatagtaaaagttatgagaagtcctacaggaaaaaaatgggcttaattttattatttaaaaaaagaattcaacacaagctcaaacttcaaaaaaaagatctctatattacattgtataaataaaataagcagcagttttgcgtgtgggctctggagatagactactagggtttatatcttggcttgccatttacaagagttatttgatatctctaagcctctgctcttttatctgtaaaataaggtagtatgtatattacaggtttggggttagaattaagataatataagtaaagagggcctaatacatagtaagaactcccacaattttacaaattaaacaatgatataaatgcctgtgatctgccagttattatccttgattctggggatacagattagaaatcggtccctggtctcacagaatttatgttctgtaggcagaagacagactagaaacgcataaaccaatagatgaacattttctgatagtggcactattatgaagaaaataaatcagggttatgtgatagaaagagtggaatggagggccgctttagattgaatagtccagaaggattttcagaggagtggttgcttatactgagagctggtcagtgaggatccagtcaagcaagggtctctctggagggacagcagcacaggcagaaggaacaacaaggacagatgtgtcaagggaggaataagcttggcttgctcaggattagataaaaagtccatgtggctggtcatgtggagtgctggagaaaaatagcattttttgtagctctaaataacactaacccctctgggtctttatttgtgggatgacttttcaatttataattctttcttgggggaaagaagagaggccctggagggattgtggcaatggcccagtggtctggatgggaagagagaggcaatgatcacagttctacaattcagggagaattgactagcctgttttgaacaggcttcccaggttaaggtggtaatcttttctctccaccattcacaaaaagggcagtggggttaggtggacatgaagtgtcaactcagaggataagggaatatgaattaaaaatgcagaagaaaaagcttgtacctgggactcattgacattgtggtttctcttgaaccctgatgctctcattcttgttgaagcctaagctcatttctctttgtcgatattagaattttatgtctaaaatttcttttttatgtattctcattccacctttctctttttggaatgcagagactagtctcttggaaatagctaaacatccaggagaatgcttagcaaataccacatggtattacttttaacttgcaaaagcttaattgctcaccatattataataaagatcccctcacgtgtccagtgaatgtaaattctcactggtgttccagctagttgcctgaatattttgtttgctattgtgccaaagataattttttttttagtgctcttctatactctatagttctatactctatacttctatagttgagctcttctatgctcaactatagttgaaaggaggagaaagtgatatctctgtaacgcaagccagaaccttccgcaataatacattggcaagtggtaatgtgatgaaaatgttttaggtttaagatgtttcccatcttagtgtttctgagtgcagatccaatctgcttgttattcttctgctacacaatgggaaatggaggtaagaagattgctgacctccctgcagctttgagacaaaatttcttgactgctagctcacaataggccttcttggaactgtccggaaatagcaccctctctcaataatctcttctttctaaatgggcagtgctgttttgatcaacttaaccccagtcaagggtaccctatagcaccaattcaaagattcaagggttgactgtttgcttatcgagatttactcagatgtcatcttccttccttcttggcttttgaggcatttcattattcctagcaactctagtcgagggtaaacaagaggcactgggaataaaattgaagtcacttttagcttcttattagcaggtatgggaaaaacctggggataagttgggtgggtggtagaaaggactgaaattgtccaaagtgaggtttgagaaatatctatgtgttctaattagccccaccttagctttttctttccataacatagtttacagtgagttgactataaatggaaaacacttcttaattctcttaacaattaataaagaagttactttcctatataatgtagaagactaatttaaaagagaattgtgtgtgagtgcacgcatggcatatgtgtggatgcatgcacatgtgtgagtgaatggattcccccaacctccagcagcatatccatgtctggtcatcagcaataatctgaaatatttcctgttattcttcctgaaacaccaggagaatttcaaactctttgaaccttccttagtatgtttgaactgaatcgtttagattggcccacccattcattcagtaactatttacaaacatcactcccttttatttgtttgttttccttaaattaggtcaaagtcatctccagggaactgggattcttgaattcaaggcctattgtatttaaggtttatcaaggtatcagcctgtccctcagctttctatcctggtttgaaaggataatttgaattaccaaagatattaaattgatatggtttggctgtgtccccacccaaatctcatcttgaatggtagttcccataatccccacatgtcgtgggagggtcccagtgggaggtaattaaatcatgggtgtggttacccctatactgctgttcttgtgatagtgagttctcaggaggtctcatggttttaaaaggagcttttcccctttttgcttggcactttttcttgtctgctgccacgtaagacaggcctttgcttctcctttgccttctgccatgactgtgaggcctccccagccatgtggaactgtgagtccactaaacttctttcctttataaattatatttcctttacaaagtgttgggtatgtctttattagcagcatgagaacagactaacaaacagatctttggacaatagattccatgaagagactgaagactctagtggcccaggtggctgaatcttctcctagctttcttcttctttatatacatcccatttgtgatcatgataaacaaggtcaaagagcagtgagaaaaggaaaactaaccacctagtatatgcagagagatatcaaatgctgaagtagatcaagaagacttccttgagcaagggggcagaggagaaagctatatctagcagagatattacagctgtggaggtatcaaagaagctttgagaatctggaaggacagcccaggaaactgtttctttacctgtaccagcactaagcatgctaaaatattcacgtgggaattatatcatatgctgttttaattaaagctggttgtattcaaccttggaattgtaactaattctgtttgctctttgagaaattcttatatatatttttaatatcctttgcttcagcagctgagatttcaagtaacagggattggaaaataatcccatgtgtttccaaccagatgaattttttggttgtaaagttatttcctaagattttttttcaattaacatattagatccttgaggaatatcctggataaacgcccaagttgctctttggttaagtagaatagcacaaagtctgtatccagggaacccaatcctctgattacagagcaggtcaaagctgcaccttaattatttctttaaaaaatcaaaagattttgaaaatgattattagggagtttttattcccattctctctcagataagtattttgtctatgacacctgattcttgagaaaaaaacaagagaaaaaaataaaacctattatcaaccacacttgggataccattaagggccacctcactttattctgaaatttctacttcagggagattaccaagcttccagagagaagcaaaatgagacccatttaagaacatgtgacctatcgtgacaaacggaagttcttttttttttttaagttttttttttcttttattattatactttaagttttagggtacatgtgcacattgtgcaggttcgttacatatgtatacatgtgccatgctggtgcactgcacccactaacttgtcatctagcattaggtgtatctcccaatgctatccctccccctccccccaccccacaacagtccccagagtgtgatgttccccttcctgtgtccatgtggtctcattgttcaattcccacctatgagtgagaacatgcggtgtttggttttttgttcttgtgatagtttactgagaatgatgatttccaatttcatccatgtcactacaaaggacatgaactcatcgttttttatggctgcatagtattccatggtgtatatgtgccacattttcttaatcaagtctatcattcttggacatttgggttggttccaagtctttgctattgtgaataatgctgcaataaatatatgtgtgcatgtgtctttatagcagcatgatttacagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatgataagcattttttcatgtgttttttggctgcataaatgtcttcttttgagaagtgtctgttcatgtccttcgcccactttttgatggggttggacaaacggaagttctgaggtgtcctagagttagaagaggtagtttttcataagaaaaaaaaaaaaaaaaaaaaaaaaaaaaagaacgtgtttggtgcctggggagactttggcctcaacaaatatacctgtagcttttctaggtttagctgtagcctaaaatttaaaactaaatatttgaaagttgcatccaatttcctcaaagctgaaagagaaatcagagaccaaactctttttttttttgattgaaaggtgttgctgaggtgaacaaggactattattctaacaacatagagcacgttcttccagatcaccagctgataatgtctgtaaataaggaggggtaatctgaatgtagaatgatggagaagatagaatttgcctttggtatggaaaaaaagatgggaaattatcacttttctactgcaaagcattcatactccatcagttaccattgattaatttatgcatttatttattttccctacaattatgtattgaacttatattagtttctaggcattgaagattcaacagtaaatcagacagacttagatccagtcctcaaagtacttaaaatctatctgtgcctctcaaaattcatatgttgaaatcctaacctgcaaggtgatgatattacgaactggggcctttgagaggtgactagatcatgagggcagagccctcacaaatggaattagtgccattatgtaataggctccagatagatcctcattccttccatcatgtgaggtacagctagaaggcactgtctatgagccagaacacaggccctcaccagactccaagtttaccagcactttaaccttggactttccagcttccagaactaggggaaataaatttttgttgtttataaggtactcagcttatgatattttattatagctgcctgaatggactatgacactgtctaatgaaggacacagacaatgatctaagagtaattatgccatgtaatccatgccaatatgggggaatgccaagtagctctgggagcacttagcaaggccacccagcaatatgtggggatggtggtaggctgtcaggaaatatattccctgaagtggcattttatctgaggcctgaaagtgtgagccaggtaaaggaggattgaaagtaaagagggcaagaaaagagaaaaaaagttctcatagtatgttggagaaactaaaagaagtttgatatgtcttcagtgtaaagtttggaaaagggtagtagaaaacatggctagaggagggagcatgtcttaaagctgtgccaatctgagacctaacttttgaggtctgcatatgcttggactcagatagagctgggtttgattcccagttctcatctttcccagcaacttaggcaagttatgccacttctaagactcattttccttatctatataatggggaatatacctacttcctaggattgcttggaaaattaaatgatggagcatatttgtacctggcagattggaggtattcagtacatgggagctacagctgttgctgttactacagtcaaatagaatggcattccaacaaggaataatgtatcaggaaagtaagctctgctgccatcagtttaggcatcagcagagccacatatgttgacattttggggtagggtaacttcctgatgtgtctcagtatcttatcttttgagagtttagccctatcctttgtttcaagaaagcaaagatttcctgctgtaagcagtggagtcatttgatacaatcattgtgcccatccattattacactttgtcctggtcattcatgctgcctaagaagatgcctaaatgatcatcccactccccctctgagtgggcataagaagtaaatgaaataaattaatgcagtggttgctaatacctatgttaccttctttttgttatcagcattaagactccttgtaagcaggaaaagaaaaaaaaaaaaaaccctagacagttatgaaggatggtttctcaaaaaaaaaaaaaagaaaaaacaagacatgtctattgagatttttacagtcgttttgattgcttttcacatcactaggctcaaacaaacagaacctctctgtacagagagatagtaagaggacatgcacaaagcactaaagctctctctgagccaaaaaaagaagcctgtcatttcatttcgtttagcccctacggctgtgggcttggtttttctatgttaatactctaacacacctgtactgagaatttactccttgccaggtaactggggatcatagaaataaaagacatactctaagccctcccgaggtccttgttctgttgtgggagacaaaccagtgagccagggtttttttttttttttttcttcaatgctgtctaatggacagtccctgtactaaatgcttcatatactttattaaagtcctccaaatcattcttcgaactagacagtataaaattccatttgtggataaaacaattgagatttaaaagtggttactaggctaggtgtggttgctcacgtctgtaatcccagcactttgggaagccaaggcgggcggatgacctgaggtcggcagttcgaaatcagcctggctaacatggtgaaaccccgtctctactaaaaatacaaaattagctgggcgtggtggcgcctgcctgtaatcctaactatttgggaggctgaagcaggagaatcgattgaaccagggaggcagaacttgcagtgagccgagatcataccattgcactccagcctgggtgacagagtgagactccgtctcagaaaaaaaaaaaaaggggggttactagtaacttccccacagatagataggtagtaagtggcagagctgggatggggccagggcagtcttgcttttgcactttatgtcacgctacctccacactcctcacagtctgtcagtgggttactttgatatgtgttattaaggggttacttaaatactaagtactgtggaagaactgtgggtccacagagaggaggggcttttgacagaaggcagagaaagagaaagatggagtcagaacaacttgccaagggaggtggcctctgctctgagatttgaaggctgagcaggggttggccatgtaaaagcgtgaggaaaggagacatcctttgagctagagtgagccgcagttacaccttcacggaggcttagagaacaggatgtcttcaaggagctgcaggtcgctcggtacagctcttggttatctgcaacaatagagggaatgtgtgggacagatgatctgaaatttatgtctgtttggcttctgtatgtacaatgtttttatttatttatattctgccttgttccacaaaggttttgaaagaaaattcattacatggtttttatgcagtgaccttcctaattaagtttttctcagcactgtcatgttcgtctttgtattccctgagccatatgcagagagacttgaacaaaagttgaattgaatttacatactttgagcactctgtaagcagttagcaagggcaactggtcccagaagcttgtgggtggaaaggaaaaattttactgggccaaaacgtaaaattgcttagattgaggtaccgtatttcatggattccaacacactattgattatagggtatgctgttattaaacttgaagtgctatcaaaaaagaaaaaatcctgttcattaaattatagcacaatataaactcactatctattgcaagatgtactctgatttcagatatattaaatgtggaaaaaaatgtgtctttaaagagaaaatgcatggtgatgatattaactcccaccccaaatggtcagaaattctaaaatgtactgattccctggttgacatgagagaaaatgagaagtcttacacatttctggatggcaatttgcccaacaacctaagcccaaaagattctgcaaactctgacctagcaattatatctctaagtctgtgggttcagtttttctatgtaaaaaataattaaagttaaagaaatactaatttaaatttaaaaagttacattgcattttaaaaatcaggtaataaagtatttgttataaaattactcctgtgaaaaaatatatttacatttcatgtttacataggaattaaaatcttgaatgacatatcaaaatgttgacagagattgtctggatgaagcaattttggttgatcatttttatgttctaatttttcaaaaattggaaaactactggttagataatagcctttttttttttttttttttttttttttttggagacagagtctccctctgttgtccaggatggagtgatggagtgcatggagtgcagtggtgtgatctcagctcactgcaacctccacctcccaggttcaagcgattctcctgcctcagcctcctgagtagctgggactacaggcgcatgctgccacacctggctaattttttgtattttagtagagacagggtttcaccatgttgcccaggctggtctcgaactcctaagctcaggcaatcagatatgggcctttaagtagacaatacacatgtgaatattggaaaattaactcccttgtcttagcaactttattttttatgaagtaggctcctgaatctttcctgtctcatcaatgagtctgtccaggctccaggtggttccaactgaggccctggttaaaagggtgtgaagattatttgattcccaattggaaatacagctttatcacctggaattttcccttaaaagttgatacctaaaaggagaaaataaaaataaatacttctacctcagggtaccagagggtctggggaatgagatctttatgatgtaatcttagtctgaggcaaactgtgagaccctgagcacatgcaagtcacgttcaaggtcctgcgagtgggaaagagggtgatgagcagaagtcaagcttaggcttcaacttttgccatcgcttaaatggtaaatcctccatctctaagagtcacactgctacaaattcacaacttttgttttgtaagtcattcataattcttcataaatgttttttctaaaagacaaactttttggtggcctaggctccactttaaggggaaaatgcaacactgactatatctatttatgaggtgaactggacctcctgcttcatagaggaaacatttttgaatggtcaaacatagtattcctgcttgaataggaaaaattgtaacaatgcatttggtatttgtattttatccccaaattagtgagttgcctttttgacatttttttcaaggtagctttatatttatgtatagcttgcttttaaaaaataagctgttcttatacttcccaacattatatacctaactgttccttaatttaaagctcagctcatgtacaagttttattttgcaatcaagttttatttacttgtttatagagtttggcttgtcattgctttttgtcagctctgcaaggtttgagccatttgtaatctttgaatatttacatagtatctatctacctacacctattttttatataatgtatggcagttgtaacctaaaagagtaaaacaaagatttcaagtgccatggaagtctaggtcaagaagagatgagttagcatttggtgaacaaaagtattctagtgggcatctactgtctgtctttcttgcatcattttcttctttctctggatagcagaactccatgttgatctttccactccactttgtcttaatagagctacaagtctcagagccctgccctcctggctgcagattcaggcctggatgattgaagcgccacatctacttggccaggatagttgattcaaatgtgaacatctattccaaatccaacagagaacttctctggaatatttatatatggacacagagaaaggagaatttttctcccttttttgctttcattttggattgtgagccataagaatgccagtcaggagttatacctacttgttctggccagatggaagaagtccagatggaagaacatttgctaggggaaaaaaaaaaaaacataaggctactgcccaaggagaacatatctaaaaagggagcacagtgacacatatttaatgagcccttagagactgaatgccacctctaccctttgatttcccaacaaaatcccttttccttttcttcgtataaacttgatagaattgggtttccgtcatttgaaactgcccaagtgcttgactaatccttggccccttagttatcttccaaatcacactaggtgcatacatatcctccccatgcatccacagttgtctgtgttccactgaattctctatcatatgagcatccaaacaggtatgattttattaaattagtatcagtgtagttactctaaagagaatatgagtgatttcagcctagtatattttccataagccgtagccttctcctggaagtattccttgttgaatagttctttgccctagtgttcagactttagtactggactaggacatttgtccaccgctggtgcatttagagcctcgattttacattgctgaagacctagcacaatcagaaggaatgagtttcctggagacttgtcttctttgttctcaagattaccaaaggccattttagaaagaaaatgattatgaggctacatgaaatgcaataagattttatagcaatcaagcctgactttggaaggcagctggaaaacaggacactcctcctcccaccctttcttctccccaacaaatgccatatgtctgttcacaatgcattctggctaactgctatgtggttgaccttcgatactgaaaaaataccaaaacacttgggacctaattttcctttcagctcattgttatagtcacatttaatatggttgagggaaaacatgaaaattatgacaaaccggcctgaaattctttaaggtagtccatcaataagacagatctctggataattcataatacttgtgatggttcagagaaggaggagtctttggggcccttgaaaaatgatgcttctgttgcttaggggtgtgttcagaaccacatcagcatttatgtcatctgtagaaaaactaaaaaacattaggttggtgcaattacttttgtgcccacctgatagaacctttccacttcctttttctatgagcaattaattcaatttcagattactatattggatgcagaacagttaatagaggagtttgctagtccatgtgtggcatagcagaatgaagagactttttattgcatctgtatagtaaatgaaatttcctccccaaattaaaatagcttttgtgttggtttcttagggctgccataacaaagtcacaaactaggtgtcttaaatgacaggcatttattctttcacagttctggggactagaagtctgaaatcaaggtgttggcaggggcaaccaccctctgaaacctgtagaggagaaccttttattgcttcttccagcttttggtgtttgctgccaatcttggcattctttggcttgtagatgcctcactccggtctccgcctccccagttgcatggccatcttcttcctgagtgtctctcttatgagtacaacagttatattggatcagggcccactctaattcagaatgatctcattttaacttgatttttcagattacatgcgcaaagactcttttcaaataagatgacattctgaggtgctatgagttaggactttaacatattttggagagaacatgatttaacccttaacagctaaattgttgcctgattgtaaaactaatacaattagtgaaaaagagaggtataaagaagaaattaaaaatcatctagattcctcccaccaaaaataaccatgttaacaatttggtggatgtcttttcaaatatttctcaaaacaaatgttcttttcttataccgtcagaaataagtcaagttcaaggacagaagcagttgaagatgtctacagttttgtgcaaattataacaaatgatgctgtgatgtgtctttcttctttcactttttagttgcacttgtgcaattacttctttaggataaatgcttagaaatacaatgtctgtgtagaagaaaaatatgcatttttatacatattatcaagttatacactagaaagaatggagtaactccattcccaccaataatgcatgagaactcctgtttctcccatcttctttgtcctttagattacaagtattagtatgatatatgttaaaaactttaaatttatgaatatttctatgttctcctatgtgaaattctaaatcatggcatttctttattcttaggtaataaatgtgaatccatagtttttttttttttgagatggagtctcactctgtcacccaggctggaatgcagtggcatgatcttggctcactgcaagctccacctcccaggttcacaccattctactgcctcagtctcccgagtagctgggactacaggtgcccgccaccacgcctgactaattttttttgtacttagtagagacagggtttcaccgtgttagccaggatggtctcgatctcctgaactcgtgatccgcccacctgggcctcccaaagtgctgggattacaggcgtgaactactacgcccggcccaaatccataattttaatctagtattttcacactttgataaatttctaattctgacccatccacacatgtttttagtacagggtatggaattgcaatccagagattctgattgaactgagttttatttctttattaagtcactcaaaattacattgtttgggaatgtgaatgggaaatttagtgtgtttcctgtttgcctttccaagagatcagtttcatttaatcaaaggccttgtactaattcacagaaaaatgcatactcaaaaagtaatcagggacataatgttgagccatggtaataagcagtacttttagcttcagtactcatagttaattgaatttatcaacattcttgctgtaactaaacccttttctctcccattcagcccatgaggttgtaagaaagtaaatgacattacagggttaatcttgactccattttaatgtgttttctttaaattgcaatcttggcacatttgggccttttgattatcagtagttgaaattacttgccaaccatctttcaactctttagaatggacttgatgttaagacccctggtttagagaggcactcattttttttttttatagcagaaaggcataagctcagagagaagtattctttccccagagaaaatctgtaaggagttatatgagaggatccaaatccagcttactgaaacaagcactgttttcagataaaatgaagacaatatcccttcgtatctctttccgtgatccttcacatggattcactattgaggaacacttgctcccaaaatacgcccttcttcacactggccttttactgctaactttgtattggattggtgggtgattctgtctattctttcagcctcattgacatgtgttcaaggagaggcagccccaacaccttgtctcaagtggatgacatttcctgtcagtaacttgctatttagctacagagaccagcctcctcatccttatctctttaaaggagtaaatgaatacaaattaaagttttaatctcagactgtaacatcaatagtattttcactacaagtagttccataatggtctcattactgctcctaagtgcaatacgctgagacgtctaaattgccgattgccactacatatattctttgagaaaaggtatccaggtaaccatggcaattgtgtctccaggcaggatgggagtggggtgggaaactatttcattaattgaagggaagagattgaaaagagattttcaagctttagatcagagagagaaagaaagaaaaggtagatcccacaaccttattttgttttcattattagattatgcaacccaaggaaacgccaaacgatttgaaaggttcagagaaatcacaagattaaataacagcagcattcttagcctttccacattattacagtggttgacctgtaccagattttctttggctgggttttatatagtttgattgaaattcaatatatctcctgagaaagcagaattgtgtcccatgatttaaagagaaaaaaaaaggaagaatactcacaggagcgggaagactgtgtaggtggtataagagctctatttatttcaagttgatagcacctgaaaaggctgattttatcagtaaaattcatttgcaaccttgcttccctgcccttcctccacccttggtagtcctcaacctttaaaacaatttattaaaggtaaagaaatactgtgatgaaaaaagggcatctagataatagggaagaagaaaacgaatgtctgatctggtctctcagaggagtctaatagtttgttttcattgaaaaggtatggcaaattagtgattagatcagcttctgttatttaaccaaagatgccctcttgtaacttactgtgttgactctttgacaaatatgttctaacttaagatttgcaaaaccctcatttacacagatagacaaactgacttctagtatacgttagccatagttggggaattatttttcaaattaggccaacatacagcactttaatgacccatgttaaatctctgtaactcctgatgaatacctgctttgtacttcctacacactatactatctagttaattcaggaagaaaaatagaagacattagatgcaactattaccaaacagggtagtgaggacttggatatgttcttcaggttccttcctcaaaatttaagtccacttttcatcaatcactgggagaggcaatgtaggaaaatttatttacagaaatgaggaaagcaacctaaaactgggtggataattattaaccaaatggattttattttaaaacaaacatttcttttctgccaaacagatttttatcttggaaagcaaatacttttccagaattgggccagaaatcatggtctgaattgtaatagttgtttgggcactgtccaagtccgatatattgactaccttgctccccactgcaacccagaggcttttcgtaacaagaagctaaagttgtgctgctatagcagctgctgatgatgttttttaagggctgtgtgcccagggtgcacccactggagaggcaataggaaataaaaatagcaatttgttttcctaaagtttagaggacagtgggggaaagcattttcagccttgtcatcagggataacatagttttatattgtgtgcacataagtctaatttttgaagacagaaaatcattgtgtaaggcaattcgatttgagaaagaatgttactgatggtatgcaagaagaaccattgtttccaagaatgagctgagacacgtgtcagatctttctaatagccaggtgttactatggacccctgcctaatggtcagtgtgtcgtcagctgctggcaactcttaccttataaagacaaatattgggattgtgcagagactgaagtgtgaccagaggctgagtgagatttgttacatttgggctatcgattctaattcacaatttagtttttgagccaagccagccgttagtcatgtggattctataaaatgatttatctaaaatctctttatccctgtgttcccttttaacgctgtagccgcttaagcaacagctttacacaaaaggacatacaattagctagtagcgagtatagcccaactacccctgtgcacacttcagcaatcaacttgaagcagtaccagatgaagagagacaagtctttttttcccatctttcaaaggtggctctgatatctgtcttccccctgtccccccaccactgcttggagtatgataggacaacagcaagagctcacatgccaagtgatgcttgaattcatggtaattgctcctccttccaagttctggggtgtaagttagagtctttcattgcaagtttcattttcaaaaggcagtgcaatcaatagtgttacttttctgagtcccaagtctgttgcttagtctcagcatctctgatgactgtgggtctattagcataagctagaactgtaagtggtgaatatttttattatctaaaattacactagaactgttaggccgaaagattacaatttgtcactgaatgtggatgtatggagaattgtatgtagagtatataaaatcttttctatgtctaatttgcattgcaaattgagaagctaaccagaggtcttgaggaaataacataaataaaacatggcttcactactgtaaatgctcaattcatgccagaggaggccgaagccattacagaaggattgtttccatctaaacaattcccatctcacacacttcccttctaaagtggctgccaataggacgggaattgggtggttggggtaggggtgggggtatccgtttagacagctttaaaaaatactcagcagagaaagcctgagagggtgtttctcaagaaagccaaagtcaaggctcaatcctgcatcttgttttatgttgaacatcctcacaactgaaggaaagacagcaacctgctcttcagtttcagccccaaggaaccagagatctacacaaggtcagtaatcagacaaagctcattactaaacgtttagggaaaaattccataatatgaggcagatgccttggttagtttacagacaacattcaggatctctcaaaatgtgaacttcaacttcagtggatatttgttatatttctgcacagcatttatgctctcttcttgtgacaacagcaccccaattctactttggggtctatctcttcattattctacctgcatgtgctttgcgcctacttcataatttccaaagcctgaatatgtggtttagacatctgtgcagtctgccctctagtgattggatcaggatcaacagggaccagcacgtgactgaaatctggtcaatgaaattcatttcctgttttttctggaactgttggagaagtggactgtctcagtcgctgagcttggtgctttgtgtaatgagatgattgaggcttggagctgcagccagagaacagagccaatgggacagaagccaagttgagaggccagaagaaagacacaaggtgcctaactaaacatatggtttaaagccttatatacctggggccagccctattttgtgactgcttgatgaggcaatacattctcttgttgctcaaatcacttagactttctgtgagagatctaacggccatatgcacctttctcaccactgtcctttcacatctcaccatctaccacttccttctttggagccgctgtaagtgaacttggcttagccatgcaaccctgtgttctcatgagtccatgcttttgcttatgctaccacttcattaggaatgcccttgcgttctcttcttttcctcaaggcgaaatcccactaatcacctttcatgttcaacccaatcaccttctctgtaaagggattcctaatgaagtggtagcataagcaaaggcatgcactcatgagaccacagggttgtgtggctaagccaagttctcttcattcatatttttcccctactcctctcaaggcaaaatttaaaacttgccatgctgtgttcatataatcgtttcccttaccctataaacccttaacactttatgcaaatactttttgagactgtctgtctctcccatgaggctttaagactggggactatgtttattcaacattcagaggcaggaaacattgttacgggcatgagctgtctttggatgcagactgcctgggtttaaacactggctctgctgcttcctaggtgtttggcttaaatatattatctactctgtctgtgccttggtttcctcatttatacaacgagggataatgttaatacctatttgtcttataggttagttgggaggatgaaatgacttaatgcatgtgaagtccttgatactgttcctggaagatggtaaaatttcaataaatattagctattattattatatttctagtttctaatagtgcctgatgtaggtacacaaaaatataaatgtaacaatgaaaagaaggcttaaattctttaagtcttatatattaagtagaaaacaaagggaaaaaaagaaataacttaatctttataattttgttttcttaaattcatgtgttcctatgagaaatcatgaatcattaaaggaaatttggctgatttggggagatttgttcatattcattcatttggtgcaaaaacttctattaagagggcattatgattggacttgagagttaaaattaagataatatccttactttcaagaggctcatggtttagtagatacatttgacaggtaaataagtaactataattgagtgaatgtgcaacaacagaagtatgcacacataccatgagggcatagagtaatgtttcctgaaactgctgtacataagactcatctaaggactttgctaaaaatcacagaatctcagaaagggcacccatggagcttctgaaacactgggtttggggtcatgtatctgtacttgtaacagaacttcatgggtaattcctggcataaaagacaggataataactttttgcctgaataggtcaaggaatgctgcatggtgaaggtgatacatgtgctaggtacttacagatgattaggagtttgctaacatttgacatgagtggtactattaagcttcaagaatagtttttttttacaatcaacaaagtgaagagacaaccaacataatgggagaaaatatttgcaaactatctatccaacatgagattaataaccagaacatataaggagctcaaacaactcaatgggaaaaaaatctaataatttgattttaaaaattgacaagagttctgaatagacatttctccaaagaagacatacaaatgacaaataggcatatataaaagtgctcaatgtcattgatcatctgagaaatgcaaatccaaactacaatgagatatcatctcaccccagttaaaataaaaaccagttataatggtttttatccagacaggcaataacaaatgccactgaggaagtagagaaaaggcaagcctcttatgctgttggtggggatgtaaattagtacaaccactaggtagaacagtatgtagattcctcaaaaaactaaaaatagagctactatataatccagctctacctagcaggtatatccccaaagaaaggaaatcagtacatcaaagagctatctggactcccatgtttatttcagcactattaacagtatcaaagatttggaagcagcctaagtgtccatcaacagatgaataaagaaaacatggtacctatacacaataaaatactattcagccataaaaaagaatgaaattctgtcatttgcaacaacatggatggaactagagtacattatgttaagtaaaataagccaggcacagaaagacaaacaattgaactcatggagacagagagtagaatgatggttaccagaggctgggaagggtagtggggataggagtggggattaatgggtacaaaaatataattagaaaaaataagtaagagccagtatttgatagcacaacagaatgattactgtcaacaataatttattgtactttaaaaaatagctaaaaggatataattggaaggtttgtaacgcaaagaaatgatgaatgcttgaggagatgggcaccccatttatcccgatgtgattattatgcattgtatgcctgtattaaaatatctcatgtacctcataaatatatatacctacattttacctgtaaaaattaaaaataaggcaatcagggaactttgaacatgatagataatttatgttaaagaagtactgttagctttttaaagcaccattaaaaaaatgaatagctttgctgatatcactgccaaagacagagcacagagcctgacagttgttctacttatccaaaattatgtcacattttttaaaaaaaatttaagtttcaagttggcagcacagtgaatcacctggaaagaccttgaaatatggtgacatttggggcccatcccctgaagttcaggttcaactgctctgagacaaggccaaacatcagtacttttccaagtactgacagctctttttaatgcttttaaaaggtagtgaaaataaatatacagccaaagagtcactgtttaggctgtacatagtatccctagaaagactctaagtgctggacctaacatcacaggttgtatgctcccagatgccaagacagaccaagtctcttgcttgaataaatgtcaaaagagggtgactaaagtcatggtataatttccaaggtttacatgaacaaattaatgctgttagcacaaaataggatacaaacaacataggtatgccatttaccaggtaattaacagatatataagaaatatttaattcttagtgccaaaaattttcggcaatatggataaaacactaaagggtgtaaatacagtcatctttaaatcctggtatactatgatggtatacaacctcaggtagagataaggtcaagcatctaaatttgagatttttcatgattgaaagacccaggcaaatggcccttctatctaagacctcacttaccacttggcagttcttcaaattcactcctggagatgaactccagatttaaataaagcattatttctgagaatggtactctggaatctcttttttgtttgtttttttttaatatcagctttattgaggtataatatacaatagaatgtatgcattttaagtgtacagtttgatgggttttgataattattatacccatgtaaccagtaaccaccaacacagttaagatatagaacatttccattccccgtttaaagttcctcatgccttttttttttaaaaattaagttccagtgtatatgtgcaggatgtgcaggtttgttacataggtaaatatgtgccatggtgatttgctgcacctatcaacccaccacctaagtattaagcccggtatgcattagctatttttcctgatgctctcccccatctcccgacaggtccctcccaataggccccagtgtgtttttcttctccctgagttcatgtgttctcattgttcagctctcacttataagtgagaacctgaggtgtttggttttccgttcctgtgttagtttgctgaggataatgagtccaagcttcatccatgtccctgcaaaggacatgatctcattcctttttatggctgcataatattgcatggtatataggtaccacatttttaaaatccggtctaccactgatgggcatttgggttgattccatgtgtttgctattgtgaatagtgtagcaatgaacctatgcatacatgtatctttataatacaatgatttatatacctttgggtatatacccagtaatgggattgctgggtcaaatggtgtttctggttctaaatctttggagaatcgccacagtgtcttccacaatggttgaactaatttacatagaatctttttttttttttttttttaaagctcctcagtgacttaatgtaggtgatccaccctggcattagaggatcatggaaatttataatctttggcacttttgtaatgctaagattctacaaataaaattctacgtatatgagtaaactgaaaatattattatcatgatcttcaatatcttcccatgggagtaaaggaataactctccctttctttcttgccctgttgattttttaaatcctttttttgggatgaccaagtcctttgtaatgatcacttattattacaaaccaagataaacaacaccataaagtacttgtggtgatttttttttctccatccattcactctttttgacagacaacagcatcctgctggggcacctcttttccatcactgtgtgtgatcttagtgaggctgtcaatcaggatgccttgaatgtgatccaagttaaaatgatcacgttgtctctctcaagactttgggtattgagctgagctacacaaggatggggaaaaaaagttggggtcgattaattcctggaatagctttcagatgggacagtcaattggatacatagacaccctagctgcccagttccaaccctttctcagctagattttcaatgtgctgaactacctatgttctgccaacaatgtcctgttttgctagctttagccaggatcagtttccgttgcttgcaactgaagaactctataaggtacaatgttataagaaaggcagtaacaccatctgtatagtctggaaccgcaggatctggtctggtgatagattatagctaaggtcagtggaaagtgtgagcgagtgagattatgtgattaaccttggctgctaggtatgtgagagtcataagctttagcaaatggatgacctggatggttatccacttcagacaaaatgttagcaaatgaatagaaacagcagataataagtgagaggggtaggggactaaaatcatagtaagtttaggcagatagctgcaaagtttcaaaataaaacccatctctgaggttaacagataaaatatgtaaaaatgataaacaatatttagaatccctggcttcacaagccaaaagctaaatggctgatactcagttacatgccctcctgctaatcaaaacagagcactgagttataaactagaaagtgtagtaagaaatgcacatgaatctgcatctgaacaaaactactgattgtgaataaatctgcaacatggcttctgataaagcatttactctcctcatttgctcgacctgtagctgttgcattcaaaatacatacacatatacttacacagacatatttatatttgcaatttataatatgtctgaaatgtaatactccagttcatttgcaaggttgctaccaaggtatacggggtataattttatcatccagggcacaatggatacaccagctccaaacatagaagtcactgagttgccatatattactatagaacaagcattttatttcaaacgatgggaacctcacataagttaggggaggaaaggcaaaaatgaattcagtggtgttaatggagttggtcaaatacttgttatttaagtcacaaaaagatataaagtgatacaaaactgaatttgctaaattatcagaagaaaatgaatcccaccaagtgaagaagttaatatggcaaaatggccaatgtttatggaatacttagcctgtgttaaacattgcactgagcccttcaataaacacaatctccattaattttataacaatcccatgaagtagttattattcctatttaactgttaaaaataggtttcggtgactatcggctactgaggatgtatccaatgccaaactcctatgtaagaatgcatacatctaaacacaaatgtggatattttaataagacattcaaagccagaaaatgggtagagatgcatgaaaagagaattggtagcatcaactagtttggttgttcactaagaaagaactgaagtctccagtatttctaaattgggatatgaatatctaccaattggtatctgtgaggtagacttggggggcaggtgtgcatgcaatttaattttccctataaataccacattatgacagcatttccctgtagaagagaggatcacatagtttggttttaccaagagacttttttttttttttttcagtttggggagccatcagagccagtctctctccctcctccgaacctcactcctggaaggtgttttcttggtattagttctccaggacctcaaaatatatgaggatactttaatacaactactgctctgctaaaatggaatgactaacattgaaatgattcccatgtcagtttttaagcagatcagttggacctccagaaaatgtatgaattgaaaagacatgcttcacttagaataatagtctccaatctcatccaggtcaggaatggaaaaccaaacattgaatgttctcactcataagtgggagctaagctatgaggatgcaaaggcataagaatgacagtggactttgggaactcagtgggaaagggtgggaagggggtgagggtaaaagactacaaactgggtgcagtattcactgcttgggtgatgggtgcaccaaaatctcacaaatctccaccaaaacacttactcaggtaaccaaacaccaccattccccaataacctatgaaaataaaaaattaaaagaaatgaaaagagagccgagatctttagagaaacacacgcaccagtacatatgtgtatgtatacatatatgaatatgtgtatatatgtgtgtgtgtgtgtgtgtgtgtgtgtgtgtgttgagttgagggtatagtggcaatgatactactgagtgtttcctttacttagctcttaccccaaaagacatattttctaatcagtaaaataaaccaggtacaatcccatagtgtaggtatttccaaacttcactgaccatcagaataaaaatagccagagtttctctgaatgcttactgtataggaagaaccatgatgaataacttatctgctcgatggtcctcccaagtaggtataatttccctctttcatagatgagataatagactcagtcaggttgaattatttggccattaactcatctagtgagagtgaaaaccataatttaaacataagcagtctttaccaagagctcatactctaccaattgtgctaaaatataatacattattgttggagcctaggaatcagaataattaaaagcccccagatgattcttatgcatccagctcaatactggtccaagaatccactggtaagtctttgatgtgcatatcaatcacctacagattttgttaaattataaatattgattcattaggtctgggtgtgggcctgagaatctggatttctaacaagttccaggtaatgccaatgcctagactacattttgagtagcaagtaaatagggcacagcattcagttatacaatgttttaaattgttctgtaatgaaaactataaattacgtccccagataaattggaagcacctgaagtatcaattttacagtatctccatatgctagtagtactagacccataaaaaaattaagccattcaaataatgcttggtaagtaattcccaagagaagtgctcttctgactctttttaacacccagcacaagaagaactggaacaaaggggcttgcttactctcagagtgcaggtgtcctgatttacttctgcatggaagaggttacagattctgtccctctgtctggtcacttgataggttgtcattaacaatagtcttctttctattacttttttttttttttttttttttgagacagagtcttgctctgtcacccaggcaggagtgcagtggcatgatctcgtctcactgcagtctctacctcctgggttcaagcaattctcctgcctcagcctcctgagtagctgggattacagatgcccaccactgtgcccggctaatttttgtaattttaatagagatggggtttcaccacgttggtcaggctggtctcgaactcctgaactcatgatccacctacctcggcttcccaaagtgctgggattacaggtgtgagccactgagcctggcccaatagtcttctttctaaggagtctaagaaaatagttatgaagggatatcaacaaagtcattagaaagcagaacaaaggtaaaatacacatgttctttgggattaaagaaattaagtgcaaaaaaccccacaattttctcccatcaaatttccattcaatttttttcatattaattattacaaggtttttgcacaatttattctcctatacactttaatctcatgaatggaaaaaactttgcctgaattcttgactcccatgctctttgttctcctatctgatccccaactatgtggaactgtcatcacagaaaaataattgccctggtcactccccagaaagcttgctcaagattttatccacttttgtttcaccaaagatttgatcttggggaaaaatatatccaactcagccagcttttgaaataacccaggatattgtcatcatgcatattttagaaacacttcaaacttaagagtacgctccatctctttccataagtctccccatgccaaacacacagaccagtccatagacttgagattatagctctttccagaagacaatatgcatatgtatgtatatatctgtcttagcccatctggtctactataacaaagtaccatagactgagtgccttaaacaacaaacatttacttctcacagttctggaggctggaagtccaagatcaaggggccagcagatttggtgtctgatgaggactctcttcctggtttgcagatggccatctttcacgtgtccttacatctttacatggtggaaagagcaagggaactctctggagtctctcttttgagggcattaatcccatttattaggattctatcttcatggcctcatcacctcccaaaggtccatctcttaataccatcgcttgggggttaagatttcagcatatgaattttggaatacataaacattcagtctatagccatatcctagagtttctaatacattttggaactcaaatatttcattattgggaagacatgaatcaccaagtctttctccaagtaaaacatattgtccaatattttaccacttgcagtaaatatgtgtgttgccatctggagctgtgagcttcaaaatggaggggacatacactacccaggtgagtcttatttaaaaatgcagatttctagattctatgcccagcaattctgatttagatcaacagtcagacttagaaatctacatttgcataagcatcccatgtagtcttgcttcagaagctcatagttcagaatgagggacagccatgtaaacaaatgactgccatccgatatgataaattgaatgacagaagtgtgtaccatgcatagtgctagctgcaagaggtgggggcacagtaggaattttacttagtctagagaaggatgttagaggcttcttcaaatagtgtatttaagttgagccttgagagagaagagaaaattcagtaggcaccagttgatgggatataaacaaataaatacatctttatttgcatgattgttggagataaagttagagggcagtgggagcaggtagaggcacctgacacaaatagttatgtaggttgtactctacccagctttagggcaccaatctcaccatagtcatcatagttttgtacatttgttgcaataacgttctgacctatggtaacactatatcttgaataaatggtctcagtttctaagttgtgcaaagaccagtgggccagtgctaggtctagaggagaggaagtgggaagactatatccctttttcacagttttcagtctcacgtatatcacttcacaaggaacacagggaatcctggaggaagaaaatactataattacagcctatggtgttggctgcatgtcaaaaagatgtacctgctcaaaatataaagtgaacctaggactgacagaaaagggtcgaataatgagggaagtaggaaaatctgagttggaggaggatcatcaaacatctatttttttttttctccaaatgttgctgccaagacattaatcaaacaacccatatccagtgttcctcagatacagcaacgagcagacattaatcgcagatctcccgaaggccccaccctttcagattccaggcaccatctatgaagagaagtaccttttattttcccttgaggatgctcagctgccactgtctctagcccttatctgggtccttggagccctttactctattgaattgtcttgattttcacaccaaagccttcaatcccagagagatctttccattccatttttgaaggaaatatcactagtagatctgcctccatgagcactttctgggtatggcatatttaccttctaaggaaagatgaggaatccataaaattagtgttagtcatcttacctctgtaacctcttattactttattaccgtcactaccaaaaataatatttattcatcactcttcatgtgctaatgaattttactaactctgtattgtcacgattttcatttcatcctcacaaaatttccataatgtagccattattaaacctcatttagagagaacatcaagattcagagaggttatgtaacttatcctgaattacgtagttaataaatactagagccaggatataaactcaagattgtccaacttgaaaggccatagtataaatcagtatatgatactgcctctgccctctttccttcagatcatgagctatatcattactatcttccgagtgcctttgtgtgaacttagctctttgtatgtattaaccaatttaaacctcacaacaaacttatgcaataggttctattatttccatttcagagatgagaaaactatggcacagagaaattaaattacatgcccaagatcatccatttagtaagtagttggaggtgggattcaaacaattcaaaaaagctgttgagatcttgtttatttcacatttggttcttacatagtagccttaatctaaccaaagccaatatttttaaggtgttttaataaatatctaggaaaatatactgacatccagatttacaatttagttcagagggagagtatagtagaaacctggaaattctaagtctaaagtctttgccttcaaatatgatagtccttggaaactaaatagaattttatagtaaataatcaaaacctgcctacctaacatgccttctagcattaatgttttcattcaattgtttaatgaccgatgtgtgtttactgagtgcctgaagcttcagggactggggactctaaggggattgagacataatccctgccttcagaaagcttacagtctggtagagactcagaaggaaacagtgattgtagtataggtatcaagtgctatgattaattgggagctccatgaagacagagtctctgccttactctgctttatctccacccagtacctcacctattgcctggcagagtgagaatacaaatatttatatatgcatgcatgaataaatgcatgcactgtggtggtgctggggaactgcaggcagggttggggggcaggagctaagtcagctgggaatgagacagagaggacaatggaaaggtttctgggtccttgaagaggtgcttgaactgtgctgaaactgaagaagttagcatcagtaagccaggcaagggaagaggaggatgggagaaacagacaaatagacaagagcactgtaagtgagttgttatgctgatgatgggtctgtgcaaggctttccaggtttggctgggggaacatacagaaaggagaaccagctgacatactaaggaagaacaagggagactagaagcagagtagggagacgacaatgacagagctcaagaggtcagcaggagacagatcatatttcccaagctaagcattttgaacctgactctgaaagccatggaggagccattgataggttttaagcacggaaatgtcatgatcacttttagttgattgcaaaattgtaaacccttctttcctaaccctctgtagggatggctgtgttagataatactacattgtttcaggacttaatgagtagaggtcatctacctccagctgtgttctagacctacctgactataattctccctcctaggttcttactcagattcccttggctctattgagagtatccaggatagtccctagtccttttttctgctacaaaaggcatttcatcactcagatactatctggttacatgtgtaaagaaaagacatacacatgcttttttttgacggagtctcactctgtcacccaggctggagtgcagtggcacaatctcggctcactgcaacctccacctcccggattcaagcgattctcccacctcagcctcctgagtagctggggttacaggcgcaggccaccacgcccggctaatttttgtatttttagtagagagcgggtttcaccatgttggtcaggctggtctcaaactcctgaactcgtgatccacccgcctcagcctcccaaagtgcaagatcttttaaataaaagtcgctcagagtttgagcaggacagaagacagaagcacagtaattagaatggaaaaccattagacctgcatgaaaatggaccaagcaatgtagtcaaaaacctaaccaaattagattctgagctctggttaatgtgtctttcaggcaggggatcagccgtagatcctagatgacagatttttacatatttgaggaaaagtagtaacttttaaaatcaaataaaaagacaggcatgatttcttgcatgctgaaactgcaagccctttttcgttgtggaaggtacacctcacagctcctccctgatgctttaatttatatgatttataaaaccaatgtatgcctattgtaaaattccaggaatagagaaaaaataattttaagtaaaaattattcttcatcccaccggagtcaaccaggcttaacatttttgtacaactcttgccccagcttttatcctcttatgaaaacaatattattgttattaccattgttgtttaaagaaatattaccttagttgtataatttgcttttttccagttatactgtaaatatgtatttgcattatcatttttaaagcacacagagtattccattatgcagttgtaccataattgtatcagtatcatcttcataaacacttaaattgtcccgataacagcaacaaaaacgcttaggaagggggaaggctatgatgaacaccaatgtaggtaaatcttatgtttctatgactatttacttagaataaaattcaagaagttgaatagctgagccagtggcatgcatgtttaatgcctgggctacatgctgatgaattgtctagaaagattgtattcatgtactatttcaccaaaaaagtgtctattttgctctatctgtaacaactttaaatattatttttgattctaacttttgcctacctgataggtaaaaattagcaccacattgttattttaatattttgttcctttaattactaggaagcttgaacacctttccatataactatcaggtgtgtattctttttcataaattgtactttcttgtccttcctcatatttgtttggtgatgccttttatatgttaagagtattaacccattgaaaacccatttttatagcctgaaatttggttcagtcatctacagagagcattcagcccaaaatctgcccaacatcagtactggatatttaaacttaagcaatccatagtcaggaagacactggtcccccatggaggagattttttttcaaaggaatggatcataaagcaaaagggattttctatggtgtccctattagtcaaataaagtggtctgactcactttagctttggcaattcctggtcattgcttgtgtgtgtccctagagaacagaatgaattaaggagtcaccatctaaggtgttttcaacagaaaacactttggcaaaagcttatttagctagtctgggattaattttcttaaccagttagaacttcaaaaagaagggaatgagttaataaactcttcgcaacatccctgcccccatactcccatctagtatggtcttctgagtctgcacatggctggggctcttctttccacacgtgtactctgagccctagaaacacttaggctgtgaagcacaatacacttgtttttttctttgggtcagttcaaattgatcatgccaactcttcccattccctcctctttgcttccaatgtttcctttctcttttgtttttcagaagaaggtagaagaatttggtagacagagagagagagagaaagagaatgtgtgtgcattaaaaccagacaaggaagcggctgggtgtggtggctcatgcctgtaatcctagcactttgggagaccaaggcgggtggatcacgaggtcaggagttcgagactagcctgaccaacatggtgaaaccccgtctctactaaaaatacaaaaagtagctgggcgtggtggcacacacctgtaatcctagctactcaggaggatgaggcaggagaatagcttgaacccaggaggcagaggttgcagtgagccaagatcacgccattgcactccagactgggcaaaaataaaaataataaaaaaaaaacaaccttaaagcaaaaagtccttggagccaataccaattgatgacccaatcagagataccatttcagaattacaagtataaccttatttgattctcatcaccctcaagttcgctgcggaacttgccaaaggcccaaagctagatagtggcagagctgggactctaactcaggtctcaatgacttcaaactcatttttatgagattatgtgtctcataagtcaccatgcctgctacctcttgttttacaggtgaatgaacaaaggcccagtggactgagcaactggctaaggcactcagactttcttagtggagctgaatagagaacacaggcccctttactgtgctgactcatctttgagatgatgatgcaattcaacaagaaaagattcaatgtgtacaaattggattggggcaattattcaagaacaaattgtataaagtgagctacacctcaagctctttgctttgcttcccatttaggggcatttcctatgagtccttatacaactctctgtggtggttataacctggtatcaaatcaaatcaaaatcagaatcagtgcagacaatcattgcatgagatttgctgtcttcatggaggttttgtgtagtgaaacattgggctgacatcgcctagggaatttcatgtgaaaattcctcccaaacatttttattctcagagttcctcttcttagcaccaccacggagtagggatctggagggtgaagtgaggttttttctctctttccccttctcctgtcttgctctctgcctcaccactcactggctcctacctgaacttccaggttagtcctccactcacacttggaatttcttatccttttgccctgcagaacacttaattgaacatattgtgttagttgagcatttctttggggtcccaagtttttccccaaggggtttatcagcaattattctgaacatatacggcaccttcaatttcctgtcttcattttttttcccatagataatgttattatcccaatttttactaatgttattatccccattttaagaagtctgaaggtcaattagagtaacttgccaaaagtcacactgctaacaccttgcacagcctaaattcaaatccatattggtctgacttctaaaattctggctttgtttaatgacattaactccctaactcattgtattaaactcttactatctgtgctaatttctcaaatattgtataaaaggagttgtcctctaaaaagaacaattgtaacagcttgacctttcaggtctcattcagaaggttcttacaaagacagctctctattatgaataatttacccttctcaaggctgaatttcctctgatgatacttgaccttctccaggcatgtaggccatccaaatgtagcccttaagtcagctggacactggggttcaaagatagttttgccttgtccattgctcagtgaagccattcctaagtatgctccccaaaacatttatcctattatcctcttaaacatgagattccacggctaaatacgtcagaaaactgagaaaacaaaaattaagttggtgtttcccagttgcattccattaaacactgttgtgtgagctgttcatagatctgacagtcaaagaaaaaaatgaaaaaacagtttgaggttaaacaattttggcaaaatataaatactctaattcccttttgggagatttatgataaacattagcatattaacgcttctggcatgtcctgctaaatagtttgacttggtgcttcgcagattttttaaccttaggatattttttttatcttgcaggaccagcccgcaacagcccactctagaaaagcttctggtttaagttctcagctcctgtatttatttttatttttatttttatttttatacggagtcttgctctgtcacccagactggagtgcagtggcatgatcttggctcactgcaagctttgcctcccaggttcatgccattttcctgcctcagcttcccgagtagctgggactacaggctcccgccaccacgccaggctaagtttttgtatttttagtagagacagggtttcaccgtgttagccaggatggtctcgatttcctgacctcgtgatccacctgcctccgcctcccaaagtgctgggattacaggtgtgagccaccgcacctgaccggcatctcctatatttttaagggagttgacaaagggtcctcttttgggaatctgggcctggtcctgccatctattatttgggtgactgtgaacaagtcactcctctctggggctcagttttcccatctgtaaaatgaagataatataccatttgtctctaactttccttccaattctagcataccatcacctaaacatatggaattgatggggctacacaccagaacatcatgacaaactgtgtgtttatattttcttaatctcatcctcttaattgaggcccagagaggaataacttactcacagtcactcagttagtttgatggcagaatcaggcttagattcccaaaagaaaatcatccaccaactcccttcaaaatatataagatgaaaatttaagccatatgtttgtttcctccagaaataaaataataatatttttcaagctatagaattcttatacatacacataatttgtccctatctgccagtacatcatagaaggtattccccagaatcacactatcatttacttgttcagaacgttgaggttttctctgattagccagttttcaggataatgggaaagtgcagagagtggttcaggtgaactgcagtgggacctcaggcaagcaactttccctctctgtgacttgtttttttaatccgtgaaaaagaaaataatgacagtgtgccctccattcctctaagataccttgtcagaactgtcagtcatagtcagaaaactctgctgctatatgcctgccctgtcctgaggtatcagcagaagtgtcgctggccccgcttgctttgcgtcagcttccaggtgagtgctgcataaatcctccatttggtagtatgaatgctagtattataagtacaaatataatgccctaatatcagagataatttactttgcactaatgcacttatcttgataataattcttcttaaaatccatagcaggaaagcatgatggttaatagctaggctctgacatccgataccaggtttgaacccagcactgttacttaccagctgtgcatccaggcaaagtgttactcgctgatcctcagatccttcatctataaagtgggaatcgtacgactcactgcaaagctggtacagcaatgcaatgcaataatgtttgtaaagctctttgtacattccccaggcatacaatatgtggtcggttatggcaattaaaaacattatctatttcagacataaaatgcaaggagattgagaagaaaattgtcaccataccaaagccaggaattggaatcctgtacacccattagaaaggaaaaccgtagttggtgttcttagctaatggtcctttggctgcctgcgatattagtgttggccagaggctcgttaatgttgtcattgtttattattgaacactgccacctagtggatgaattggtcacatgcaggtaaggaaatcacggaggttatgtcaggtcacctggtcacacatggaagaggctgttgtgtccatcttgtccacactgatttcagcttgttgacttgcagccatgcccagggagatactggggtgttcctgcttatgtagactcccctctatcttcgcgcagttgtcaaactgacacaaagacctgagaactgtattcttacactgcggctatgtgagcagagccaaagatcggcctcctctgacatgacctaaggcccctccctcaacactctaatccatcataccattttattttatgcaaaagcatatcgttgtctgaaaacattactttctttctgtttcccatccccttctcttgcccctaactagaacggaaggcagccaagtgtggggccatgtgagccttattcctttacgtatccctcgtacctaacactgggcctggcacagcgtaggagcacaaaaatatgtgtagcctatagcataaaaaatcaatgacaatgccaataatcactgctgttattgtttatggttcctactttttgccgggcacagagctaaggtctgtacatagatcacctcatttaatctctataatcagcctgcttagtgggggtaatgtcaccacccacataggatcagtaatttctagggcttagaattgatctttcaatttcaacaagcatggttcccctttgctcagtattataatgccataccttatttaatcctctcttttgaaatccttcttatagtttcacctattttacagatttgaaagctgagtctcatagaagtgaagcaatttgctgaaagtcactcagttcaggtttaaaacccaggtcttgtctaattccaaaggccctgctgttttcactgcaacatactgccctctattagatacatggataaaaaagggctttcttaattcggtcctggaaacccaggcctgagttttggttaagcctttgtaagaagcctttctcccaagctaaatctcatattggtttttcttgtagccaggtctttattggtttctagatgtctcctccacgttcacttcaaagacaaaaattagctacaatttattgaagattttattatgtgccaggcagggttcaaatgatctcatttaatccttataacagccctgtaaaataggttccattgatattattcctattttataaatgaggacactgagggacagagaagttaagtaatttccccatggttacctggattctaaaccagagcgctggtttgaacctaggcaggcagtttccttccaggatacactcctaagcaccagtggccatcctaggggactatatccaggacatttcctttgctgacatcaggtaagggaaggccctcagaaaacctcaggggcagccccactcagtaaagcacttcccagaatgtttaagctcagaaactgtgctgaagtcagaatacatagagatgccaggcatcctgcagctagccctcctccctcccggtttgcagtcccagcctacggttactcttcaattagtttccatctgtggcagcagcaattccctaggggtacatgggccaaaaagagagaccgactcagccaagaaccagaaatatcctcactgcagcaaacaagctagtgatggaaaagaggaaaattttcccttcaaggtctggacatttctcaaagacagcccactcagcttatataagccgcatgcaccactaaaggaacacaaccaaggccccatgaatctagaacaatcttgccaattacgtgttaattgaaagttatgtagaggccatccacatgcccttggggaaacttgacactgtacttattgaattgtctgttctggatcactgacctgggcaaaggggctcaggcaacactcaaaggacagtggcaaagtcattccacattccatgggtatcagttcagagtttccacccttttttgaacctttcctccaaataaataggcagtgatggtgtttagggacattctgggcttccttgtattcattagttcatgttttcatatatttatgtacttgtaaattgacaaatcttgtcttgaatatacatttgctaagtatcacctctgtttcaggttaatgccaggtgctgggaacatcaaagtgggttagatacagtggggtgctggtaagtgatggccaactggcttgctatgtgtcgggctaacatgaatgctggttgcattttcctttacattaatgaataagacaagattgaaactacgaagatctatgtcagtgtcgtctgttaatgacctgagctacttctttgctgaattgaagtgtcaataatagaagagttctttaattttttgtgttgttcacagatactatgacacgctttaaagtttaatctgcattattgacatttctccatcagtttcttgagtctagacaattaactaacaataaatcaagccttggtttatagcatttgccaatcttcatgtgcaaataagaccatcgtggccaatttcaagctaccaatattttgccactaagcatggagttgaggagagacgtacaacatgaatgtatatcatctcaaaagtatagattatagtacaatctagtaattaggaagaaatgagtcttaagcttttattattttcattttgaatatacaatatttacttatataatttgatattttataatggctatgcttaacaaccagttcaaaacaattcaggacgtttaacaagtggcgccagccagcgggtatttgtcaactccagcctaccactggttagacataggctcctacttgaagaagttcacagttgagttggggaaaagctctcatagtatgaactgctttgtaagaagtaagatcaagatgccatcggagcatttggaaggcagatccagtcaagagttgggcttggggaaagctttctgagacaaaaatatctaatctgagacctgaaggaaaatagatattaactatatgaagggtggaaagtgggttccagatggaggaaggccctgtgcaaaggactggagtgaaaccagatcacagaaacttttggaaatacacagtatttcattatggctggaataaagtgctgaaggtaaggtggtcacatcagataaaattggggggaggagagtacaaagccaggacatataaaccatatcaaaaatagtttgtcttaaagatggtgagtacttactgacagtttatataagtgagggcaccctgattggatttcttatcagatcattccgcctgtggtataggaaagagagaggctagacaaggctatacccaggatgccacagccatccaggagcgagatgcaggttgcctgcctggtggcagtggccacagggatggcaaagaacagaagaatcaagagtcatttaggaggttgtgcctgctggacaaagtgattgattatttgtgtgttttttggggtggaaggagtgctgagggaaacaaagtcaagaatgatactcagatttctgacaaaagcaaccaagtaaatgaatggaagtggagatggtggtaggggaacaggtaattaacctgaaggatgatgagttctcttttagatggattacatttatcgcagtgaatgtccaagtggagatatccacgaagcagttgaatttatgtctgaagctcagggcacatatctgggctggaaaatgaatttcggagttttgaatacatagatgctaaccaaagccacgtgtatggatgtaatcatccaggatgcatcagaatcactaaagtttctgggccatttactccaccagcaccatccaccctctttacatcctcccactgttttactcattactgacaccctataatgtaggtatacttattattcccattttgcagatgaggaaactgaggcatagagagaacaactatttcctcaaggctgcacagtaagtggcagtgcccagatttgaaaccagtgagtctggcaccagaacctacaccctgaactataatgttggtctgcttctgtgtcaaaatacagactaagaagggaagaccagccgggtgcggtggttcatgcctgtaatcccagcattttgggaggccgaggcgggcggatcatttgaggtcaagagttcgagaatagccaggtcaccatggcaaaaccccatctctactaaaaaaaattagccatgcgtggtggcgggcttctgtaatcccagctacttgggagactgaggcatgggaattgcttaaacctgggaggctggaggttaacagttagccaagatcatgtcactgcactccagtctaggggacagaggagactcagtctcaaaaaacaaaaaaaagaagaagaagaagggaagaccagaaggttagacccctcagaaatgaatatttaagtcacaggaagaggaatttacaaaggagatggtaaagggaggtgtggtggtgaggaacttgcggctcataagaaggtcaccttcttaaaaactccctcaccacaaattaggtaattgaggagttgccccgtaaaacttacagtcacaatgaatttactaacattcttttctaatcataaaagcaatgttttttttttcctgtaggaaaattagaaaatacagagaagaaaataaaaatcacagtattcagctatctagaaataattgtggtaactatttgttgtatatcccttcagacttttgatctatgcatagaaaaacagagatcccttcgaaacatttttcaaagtctattttaaaattatattttgttgtttccaaagctgcacattttaaaatcaggatttatcttataatcagtggtattccacaggttaatgataactttttgctcctagttgtacaaagaatgctgcatcttttcattgatagcatcatagatttggtgaaatgtggtaggacatatgttcatatctttaaaaattgaaaatgtgctaaaaggtacacagagaaagatctctttccctctcggcatattccagtgtttctccctggagacagatgatattttccagctacttgtctacccttccagatgcattttaatgcacacacaagaaaatataacatgtgtccccttctctttaaatacatggtaacgtactatccactctagggcatcttggcctttttaaaaacttacgctctatgttgggagtcttttttccaattgcaaattttaccttgaaagaatgcgccacaattcattaagtccctagtgatgtgcaaagttatttccaatctttttctatgagaaataatgctatgatgaataatcttgtatattttgcacatacagcagtatacctattaaatttcttgaaatgtaactgctgagtcaagtgataattcagttgttattttgaagatattgccaaattgatcttcttaaaagttccaatttatacttcttccaaaaatgtatgaaatactgttttcctacagcatttccaacatattaggttatcaaactttttatgtttgtggtacctataggtaaaaattacatctttaacatactttttttattttggaataattctagattttatagaaaagttgcaaagatagtatggaaaatccctgtatattccttactcagtttcccctcttggcaacatctcatatctccatggtacactcatcaaaactaagcaactaacattaatatattactattacctaaacttcaaattttatttggattttaacagtttttctactaatattcctggatcccatctaggaggcaatattgcattttagtcatcttgtctccttagtctcacctggtttctgacagtctctccgtcttcctttgctcttcatgaccttaagagttttgagaagtcctggtcagtggtttgtagaatgtctctcaatttgggtttgtcaaatatgtgtcttatgattagaatggggttagtttttggaaggaacacttcacaggtaaagttccctcctcatgtcatatcagatggtaggtgttatcaacatgacttatcactggtgatgttcaccttgtggatttaaggtagtgtttgccagatgtgttcatggtaaagttactctttttccctttgccacacacttatctctggatatgaatcactaagtcaagcccaaactcaagagggagatgttggctgggcacggtggctcatgcctgtaatctcagcactttgggaggctgaggcgggtggatcacctgaggtcaggagttcgagaccagcctgaccaacatgctgaaaccccgtctctactaaaaatacaaaaattagctgggcatggtggtgggtgcctgtaatcccagctactcaagaggctgaggcaggagaatcacttgaacacgggaggcagaggtcgaagtcagctgagatcatgccattgtactccagcctaggcaagagagtaagactccatctcaaaaaaacaaaaacaaaaacaaaatagggaaatcttagtgtaattataattagcatttatcttataggtaaggatatcttttcataagcttaaggaccatctatattttctgaactgttgacatttttctgttgaacttctaatcaatcttatttttgtcagttgttatgagaaataagccttttctctgtaatgcaaattaaaaactttcacccagcttaccatttcttattttttctgttgtgtttttgccatatagattttaaaaattttatgtaataaaatgtattagtttctcttatgagttatggtttatttatcacacttagagatatattacctatttcttgatgatctttaaaaatgttctgtggtatcctttttctgaggttatgttatgtctttgatctacctggagtttatttaggtataaaaatgagtaggatttgattctttttctttttcttgtggttacttggttgtcccagtagcaatttatggcctattttccattattttatcgatgtgcaatagataattttgccggaaaaatgtgtaggggcttcagccctggacaatttaaattcccatgttctttccatagagacagataaagcaaaacaacataaactctcatattttacattattgttcatatagattgacctcaatatctccaagcacaattttcattttgagccactgttggcacattgggctaccctttctttaaccttacttcagcagcagccgaagggcagcgtggccccaggtcatagctaagtggcagataagggtgcagatccttgagtcacactgggttagtggcattactttaaatctacagttagagctacaaaattggggttatgagaagaattccatggcttgtaattcctcacgtataactcaacccaaatttggagagaaattgccacttgattatatgagaggagatagtatttgaggctaggattctttaaggtggtacatgggcacattgacaacagaggtaagtggtataacctacttatatttttaaaacatctttgacaaggttctgtgtcaaaactcaatgagaaacacaagtttccatgttcttggagaggacagttctgtcagggtcagtcactgcattagcgaaggaaacaatgcatatagataataggcactcatctgagaagacaatatttgcaaagcctatagggtaagggatccttgttccccagagttccatcctaggcccatccttctttaaaatctgcagaaataatctggaggcagatgaacaaaatgataattttaaggttttccgtgttattgatttgttttttctagagagtaaagaactaagtagattaagttagaaaagagtaaactcttgtagatctatttggaatccgggcaagaaagtatcatttgagtttaaaggtaaataacagcaataatgcatattttaaaagaacaaaaaagtcaaaatagaaaataaaggactctgttctacagtaggtttagttcacactactactaatgaactaatagtactttctgtgtgctttatactgttctaagtcctttaacatacattaatttatatagcctttaaaaccagccatgaggcagggttcattattcctcccatttcacacattagaaaatggaggtccaaggagtatgagtaaccagttgaaggtcacataggcagtaagtggcagaggtgggtttggatagggcagtcccgtgctggggttggtggcctgaatcactgggcttgctgcctccctaggagggctctgtacaactcaggcaactgtcacattgatctatttcttcactggaagagctgagggtaagtcacattcatctttgtgttttcaagtttagcataatcctaggcacaaactatatgcttaataaattaataaattttgaccacttaaagtataatttaaaaaaatgtgtatggtgaaataaaaggaattttttttttttttttgagatggagtctggctgtgtcacccaggctggagtgcagtgtagcaatctcagctcactgcaagctccgcctacgggttcacgccattctcctgcctcaacttcctgagtagctgggactacaggtgccccccaccacacctggctaatttttttgtgtttttaatagacacggggtttcaccatgttagccaggatggtcttgatctcccgacctcgtgatccgcccacctctgcctcccaaagtgctgggactacaggcgtgaaccaccgtgccccgcctattttttaaatttcataagtttaaaaacttttgcaattgtgatacaacacatagaatgtaccatttaaatacaaagttcagtagtgttacataaactcacattattgttcaaccaatctccaggactttctcctcttgcaaactgaaactctatactcactaaacaactctccattgcaccgacccccagcccctggtgagcactactctagctttatttctaagagtgtgactactctttatacctcatataagtaaaatcatatagcatttttctttttgtcattggtttattttgctttgcatattttcaagatccatccatgttatagcatgagtaagaatttccttctttcttaagaataagtaatattccactgtgtgtatattccacattttgtttatctattcatcagtcagtggacatttgtgttgctttcaacttttggctattttgagtaatgctgctgtaaacatgggtatgcaaatatgtctttgagatcttgcttttaattttttttggctatatatctgaagtggaatggctggatcatatggtaactcaatttttaatattttgagaaactgtcatgctgttttccatagtggtttcaccactacagtgcagaagagttccaattttcccacatacttaccaacaatgattttcttatatttaaatgacagccatcctaatgggtgtgaggtaatactgtgattttgatttgcatctccctgatcattagtgatgttgaacctcttttcctatgcttgttgactatttgtatattttatttggcaaaatatctattcaggtcctttgttcatttttttaattggttttttgttgttcagttgtaggagttctttacatattctgcatattgatcccttatcagatatataatttgcaaatattttctcccattctataggttacattttcactgtattgtgtcctgtgatgcatggaagtttttaattttgaagtcatccaatttgtctacttttatttttgtttcctgtgcctggtatcatatccaagaaatcattgccaaattcaatgtcataaagcttctctcctaagcttttacctaaaagtttcattttttaaaaaatttattattattattattattattattattattattattattatttctgagacacagtcgtgctctgtctcccaggctacagtgaagtggtgcaatctcggctcactgcaacttctgcttcccgggttcaagctattctcctgcgtcagcctcccgggtagctgggactacaggcatgcaccactacgcccaactaatttttgtatttttagtagagatgggttttgccatgttggccaggctggtctcgaactcctggcctcaagtgatccactcacctcggcctcccaaagtgctgggattgcaggcagaagccaccatgcccggccaacagttttatagttttatgttttccatttaggtctttgattcattctgagttaatttttgtatatggtacaaaggtaagggggcaacttgtaattttttccccagctgattagccaattggcacaacacaatttactgaaaaagaaggtttctttctatcaatttgtaacattattttgttcatatatcaaattctaatgtatatgtatatatttctagatgttctattctattccattgagctatttgtctattctgttgccagtaccatatggatttatttaatgtaggctaattttatattctgagtaagcaggcaaatgccccctcactattattcttatttaaaattttcttggtgacttttgcatattcattcttcctgaaaattttactatgaatttttagactactcctcagccaccccatcaacaccttcctacccatcactcccataaaactaacaagcatagagattaaaagaacaggattgacgttttatagtatttggatatttctctctatatatgtttctcctgtagtatagcccatttcatataataacaacttcatctttctctttgctacaggccaacaaatcccaaacaaaacaaaaaaacaaatctggagtcatccttgagtgccttcattctttcatacccgatgtctaacacatcagaaaattttattagattcgtccttaaaaatggtcatcatttttcaccccccgacaaggtccaagctcccattatattatccttggattattgtaatagcctttactttaataacctctttttcttttttagaattgcgatcttgttctgtcaccccaagctggaatgcagtggggcaagcatagttcactgcagtcttgaactcctgggcttaaacaatcctcctacctcagtctcctgtgtaacagtctcttttaatattattattattattattatactttaagttccgggatacatgtgcagaacatgaaggtttattacgtaggtatacacgtgccattgtggtttgttgcacccatcaacccatcatctacattaggtatttctccgcatgctatccctcccctagctccccacccaccaataggccctggtgtgtgatgttcccctcactgtgtccatgtgttctcactgttcaactcccacttatgagtgagaacatgcagcgtttggttttctgtccctgtgttagtttgccgagaatgatggtctccagcttcatccatgtcccagcaaaggacataaactcatccttttttatggctgtgtagtattccatggtgtatatgtgccacattttctttatccagtctactgttgatgggcatttggattggttctaagtctttgatattgtgaatagtgctgcaataaacatacacgtacatgtgtctttatagtagaatgatttataatcctttgggtatatacccaggaatgggattgctgggccaaatggtatttctggttctagatccttgaggaattgccacactgtcttctacaatgtttgaactaatttacactcccaccaacagtgtaaaagcattcctatttctccacattctctccagcatctgttgtttcctgactttttaatgatcaccattctaactggcatgagatggtacctcattctggtttcggtttgcacttctctaatgaccagtgataatgagcattttttcatatgtttgttggccacttaaatgtcttcttttaagaagtgtctgttcatatgctttgcccactttttgatgggttttttttaattgtaaatttgttcaagttccttatagattctggatattagctctttgtcagatggatagactgcaaaaattttctctcattctgtaggttgcctgttaactctcatgatagtttcttttgctgtgcagaagctctttaggttaattagatcccatttgtcaattttggcttttttgccattagttttggtgttttagtcatgaagtctctgcccatgcttatatcctgaatggtattgcctaagttttcttctagggcttttatgattttacgtactacgtttaagtctttaatacatcctgagttaatttttgtataaggtgtaaggaaggggtccagtttcagttttctgcatatggctagacagttttcctaacatcatttattaaatagggaatcctttccccatttcttgtttttgtcaggtttgtcaaaaatcacatggttgtagatgtgtggtgttattcctgaggccttttttctgtcctattggtctatatatctgtttcagtaccagtaccatgctgttttggttactgtagccttgtagtatagtttgaagtcaggcagcatgatgcctccagctttgttctttttgcttaggattgtcttggttatatggactcttttttagttcctgtgtaatagcctcttaagtgataatcttgcattaacttcatccctgtaaagtctattttcattacagcagacaggaaaaatcttattaaaatgttagttcatgcatatcacccttctactccaaactttccaatagttctccatttcacctggaggaaaagctgatgtatttaagaatggcttcgtttctctcttttcccatttctacttactctacttcagtaacattggtctccttgctatttctctaataggacatatacgcttctacctgagtgcctttatacttgctgtttccttggcctgaaacacatttctctcagttaactgcatggcttgcttttttaccttcttaatgtttttgttcatttacatttctgagaacatctctggcccttctatctaatattgcttctctgtctcaatacttccttattcatcattttctgttttctttttctccatagaattcatcattttataaaatttcacacaattttcttgtttactttctgtttccttccactagaatataaactctgtaatagcaaagaaatttacttattttgctcactgctgtatcctcagtgcctacagtagtacctgccacatagtagatgctcaatagatgctcaataaataaaacttaaatgaaccaatgaaccaatattgaatcttcccaccttgaaacacacacacacacacacacacacacacacacacacacacgctagtccctctttatccacaggggatacgttccaagacccccagtaaatgcctgaaaccacagatagtactgaaccatatgtacaaataacaaatgtaatgttttacctcatacatacataccaatgataaagtttaatttacaaataaggcatagtcagagattaacaacaataactcataaaatagaacaattataacaatatactgtaataaaagttatgtgaatgtgatctctgtctctcaaaatatcttattgtaccctactcacctatttctcattgcaattgaccacagataactgaaactccagagagcaaaaccatggcagataaaaggagaaaatggtacgtgtgtgtatatatacaaacacatatgcaaacttgttttattttttaatatggcttggtggttttcatcttcgagatatccacaaaattgaatttaatttttaaatttaattccataatttataggtgagatagatttatatttattgttatggagagatgccaatgatatatttttatgaaaaaaagaaattcagaacagtatgtagaacatgacttcattgtgataaaaataaaaatgtgtgcatgtatctatgtttcagagtagactttccacatctcccaactagatgttgggcatatactgaagataaggtaacagaaggaaatcttgtaattcagggaagcagccagaagttttctgagcacaatgaagcagagatggtattcaaagagaaaaccaattagcaggataaatgcttcagattctttttaatacttgaacctctgtctcctttacaccatccctcccctccctgctagtctcatccagaagggaaatctgatcactgacaacccaccccagagattaagattaggaacagagctggaagaaacagcaacaaggaaaaggaaggagaggaaggaaggctcaagggagagaatggaggctcccatgcctgaactaaatgtgagttgaatccctgttccctgtggaactagatgggctgggaaagacttgaacattaaatagattaatctctcttgtttttttatgtattctaattttatggtaatgtggtctctgttatattgatttacagtatcttttgcatgtaatttgaggctatatgttgtcaatttttggaatgttttatacatgcataggagaattgctttctctaatgtgtagatacaagatttcatatacatacatgtttgttacatgacactagttaattgcattatttaaaaactctatatccttactagttttctgtgttgtaacctatcagtttctgaaaatggaggaggacctttaaacattttttttaacctagatactcaaattcaagaaacaatgaatcctaaaaagactaaataaaaagatatctacatctagaaaggactcagtgaaacttcagaacatttaaaatactgtatttcttactcatttttttttgtttgtttattgtatgtctcccactagaattttaagtcccataagagcaggcaggaaattctgcctattttgttcatagtacctggcacatagcaggcactctacaaatatttgctgaagtaatggattcagttcttcccctgcttcattcagggttcagttttcttcttactgaagttcatacttcaatccctcttttagggagagtcttgggtggtaaattttcttagtcctcacaactagaagtttctattttgtttttactcttcaatgagagtttagctgggtcaagtcctatataatgagttatttttttttcttcagcagtttgaatctattacttaaagaatttttttctggcttttattgttttcgagaattcggttgtgagtctgatattctttggaagataaccagtctcctatctcttggaatttttttgtttaattaaatattttttcctttgagataattgtgggttcataagcacttgaaagaaataatacacagagaacacttgtatccttttcccaacttatctcaatagtaacttcttgcaaaactataatatactatcacaaccaaatattgacattgatacaataaagacagagaacatttccatccccacaaggatccctatgctgcccttttacatctactttcctctcacttaaaccccctccttaagccttggcaactactaatctgttctccaatcctataattttgtctttgcaagaatgttatataaatggaattgagagatacaatatacaaactgagacaatgaatatgcaataataatagaactctgactcataacctctgtagcaacttgcccagaagtcaaaccctaacctctgcagcagttggcccaggtggtcagcatttggtcaatgatggagtttccttattttttgttcctacttccaatttaggacaaatcaaggaaaactaaattctccccaaagtaaccatataaaatacttcacttctaaccagttcttactttcattatttttttcttcctccttgctttgagcttatttgctcttcttttgctgggttcttcaggtaggaacttaaattactgatttgagatattttcttctttctaatctatacatttagtgctataaatttgcttttcatttgttgccaggtcccacaatttttgatatgttgtgtttttattttcattccatttcatatatttattttcctcaagacttcctttttgacccattcatgaagtatgtgatttacttctcaagtattaggagatttttctgttattgatttctaatgtaactccattttggccagagaacaccctccatatgattttaattctttaaaattagatgacgtttgatttatagtccaggttatggtctaggtcccacaggcacttgaaaagaatgtgcattctgctgttgttgagtgtagggttctataaatgtcaattagatcctgtcggttgatggtattattgcattcttccacatccttgatgttctctgtctagttgtcctatcaattgttaaaaaggggttgtcgaagtctccaactataattatagatttgtctatttctcctttcaattatatgagttttgcctaacatattttgcagctctgttgtgtggtacatatgcacttaggattgttatgtccttttggtgtgttgattcttttatcattatataatgtccttctctgtctctttaaatttatttgctttagagtctactttatctgatgttaatgtagccacttctgctttcttctgatcagtgtttgtatatctttttccatccttttactttaacttgtctatattcttatatttgaagtgagtttcttatagagagcatattgttagcttacgttttctcaattaactctgctaatttctgtcctttaattggtgtatgtggactatttagattcaattacatttttatatattaggttttaaatctctcattttatttttatttttgtcctttttggttcattttctttttcttaatttctaatgggttacttgaacattttttagaattccattttggtttatctatcgtgttttccagagcattttttttttttttttttttttgagacggagtcttgctctgtcccccaggctggagtgcagtggcacaatctcggctcactgcaagctccacctcccgggttcacaccattctcctgcctcagcctcccgagtagctgggactacaggcgtccgccaccacgcccggctaattttttgtatttttagtagagacggggtttcaccatgttagccaggatggtcttgatctcctgacctcgtgatctgcccgccttggcctcccaaagtgctgggattataggcgtgagccactgcacccggcccagagcgtttctttgtatacctttttaaacactgatttctctagatattacattatataaacaaaagttatcacactctcctgggggcgtcattttcccagttctagtaaactacagaaatcttacctccctttacactagtttattgtcccccatttataactattttaaacttctcttctacataaatttagaacctcatcagacattgtcataatttttgcttcaattgttaaatataatttagagaacacaacagaaaaaagaaaatctgttgtatttacccacatttttgtatattgccttttttcttccttcctcataaggtaagatttcttcttttataattttttttctctttagaggatttcttttaatcattcctttagggttgattggctgataacaaattgtcttcttttccaacatctgaaaatgtcttaattttccctttattctttctaaacatttttattataaattaataatttataactaaatgtatttatgtggtacaaagtaatattatgatttatgaacacaatatagaacaattaaatcaaattagttaacatatccatcccctcaaatacttgtcattttcataatgaggacatttgaaatttactctcttggcaattttgaaatttacaatacattattaactatattaaacatgcagtgcaatagatctcagaaaaagaccaccacccaacttatttctcttgtttactgagactttgtatgctctgactatcatcttctcattcctccaacctcccacggtctggtaaccatcattctactctctgcttctatgggtttgatcatcttagattccacatgtaagtgagaacatgtatttttctgtgcctgccttatttgacttagcataatgttctccagttccatctatgttgtcacaaatgatacttttcttctttttatagactaaatagtattccatgatgtatatatgccatattttctttatccattcatctgttgatggacacttagactgattccataacttggctattgtgaatagtgtggtaataaacatgggactgcagacatctctttgacaaactgattttaatgtctttgtgaatatccagaagtgggattgctgaatcatatggtagttctgtttttaacttttagaggaagcttcatactgttttccataaatttacgtttccaccagcagtgtacaagggttcctgtttctccacattctcaccaacacttatctttggcttttttttttaataaaagtaattctgacaggtgtgagaggatatttcttgtggctttaatttgcattttcccagtgattacaaatgttgagcatttttcatatatctgctgactatttgtattacatgccttcttttgaaaaatgtctattcaggtcccttgctccttgtaaaattctgttctttgttttctttctattgagttgtttcaatttcttatatatttgggatattaaccctttatcagatgtatagtttgcaaatattttctttttctttttttttttttttttttttgagacggagtctcactctgtcaaccaggctggagtgcagtggtgtgatctcggctcactgcaacctatgcctcccaggttcaagcaattcttctgcctcagcctcctgaatagctgggattataggcatgtgccaccatgcctggctagtttttgtgtttttagtagagacagggtttcaccatatgggccaggctggtctcgaactcctgatctcgtgatccacctgcctcggcctcccaaagtgctgagattacaggcgtgagccactgcacctggccttagtttgcaaatattttcttctcatccataggttgtctctttacatggttagttgtttcctttactgtgcagaagctttttaagtctaatataatccaatctgtttatttttgcttttgttatctgtgtttttggggtcaaattcaaaaaattattgcctaaaccaatgtcatgtagtttttctcctataatttcttctagcggctttgcactttctgttcttatgtttaagtctttaattcactttgagtcaacaccataaaggccatataggataagcccacggctaacattatactcaaaaataaaagatgaaaagtcttccctctaagatcttgaacaagacaaacatgtccactctcaccacttattattcaatgtagtattgaaagtcctttgtcagagcaattaggcaagagaaacaagaaaaggcatttaaatagaaaaagaagaagtaaaattgtcactgtttgctgatgacataattttatataaaaatcctaagactccttcaaaaaactgttaaactaattaaaaaatacactaaagttgtgggatacaaaatcacaaaaattggtatcatttctatacaaaaacaacaaactatacaaaaaagaaatcaagagaacaggaaaaggtagagcaagatggcataatagaaccctctgacaagtatcccccaacaagaacatcaaattgaataataattcatgtaagacaacaccttcacaagaactaaagaaatcaggtgagagatcatactacctgattttaccataataacaagaagaggcacattggagaggggaggaaggacagtcccacattgcctgtacactgctcccccaaacttgggcagtacagcacagtgcagagaaagaatctatcagtttgggagagagagagaaaagtgtgtgtgagactttgcattggaacttagtaccaacttgccacagaaaaatacaacatggaatagaaacctgcagcccttgattccaggccaatgtccacagagggtgtacttagacctatccctggctaaaatggaatctgctgctgcagctggaagaaactgagccctgaaacacttcaccattggctgactcaagtgtcctcaggtcctgaataaattgcagcggaaggcaaattggaaattcaaaatagctattttgaagatgctcaacaaatttcagtaaaacacagagaagcaattcagaaatttatcagagaaatttatcaaagatattgaagtattaataaaaaaacagaaatcctggagtaaaaaaatatggatgaattgaaaagtacagtagagggtctcaatagcagaactgattaagcagaagaaataatcagtgagcttgaagacaggctatttgaaaatacacagtcagagagggaaaagcaaaaagaatgcaaaaggacaaagaacacttatgagctatataagatagtatcaaaatagcaaatgtaagagtcattgcccttaaagtcggagtagaaaaagagaaatgggtggaaagcttatttaaagaaataataacaaaaaacttttcaaaagagaaatatataaataggtaggggaagcccaaagaccaccaagtagatacaactcaaacaagactatcttaaggcatataataaactctcaaatgtcaaaaacaaagggaggatcctgaaagcagcaagagaaaagaagaaaacaacagataaaggagctccaatatgtctggcagcaggttacacagcaaaaaccttatagtccagaagggagtgaaatgatatattcaaaatgatttagaaaagcccaacaactgagaatactatatctggcaaagctatccttaaaacatgagagagatgtagactttctcagacaaacaaaagtttaaagacctcattactaccagacctgacttataataaatactaaggtgggatcttcaatctgaaggaaaaagacacatgtgcaacaagacacatgtgcaacaagaaaacatctgaagaaataaaatccactgacaaaagtatatactgtaaccacccatatctttagtgtaagtaccaaaagataaaactactaaaaataataattacaatgatttgttaaaagataagcaatataaaaagatgtaaactgaaatatccaaaagacaaaatgtagggataagatgagttaaagagttttattttttgtttcttttattgtctttgcaattaaagtcaggttatcatcagtttaaaatagcttattatagctatacatttttttaagcctcatggtgactacaaagcaaaatctataatggataaactaaaaataaaaagcaagtatttaaaacatactaccagacaaaataaacccaaaagaagacagtaagagaggaataaaggaatagaggagttataaaacaatcagaaatcaacaaaatggcagtagtaagttcttactactatttataataaccttgaatatatatggactacattctctagctgaaagacatagagtcactgaatagataagaaacccaactatatgttgcctacaagaaactcatgtcacttataaagacatgcatagactaaaagtgaaaggatggaaaaagatacaccaagcaagtggaaaccaaagagggcaggagtagctatacttatatcagataaaatagactttaagtaaaaaataattttaagagacaaaatgctactatgtattgatgaaagattcaatacagccggaggatataacagttgtaaatatatatgcacccaacactagagtacctaattatataaagcaaatattaacagacctaaaggaagaaattgactgcaatacaataatagtaggagagttcaacacccaacttcagcaatgaacaaatcatctagaccaaaaatcaacaaagaaatattggaattaaacgacagtctagaccaaatagacttaacagatattataaaacataccactaaaaagctgtagaatacacattcttttcaacagcacatggaacattgtctaagatagaatgtattttaggccacaacacaagtcttcacaaatgttacaaaattgaaatcatatcaagtatcctttctgatcacagtgcaataacactagaacaataacaagaagaaatttggaaatggttcaaatatatagaaattaaacaacttgctcatgaaaaactaatgggtcaatgaagaaagtaagaaggaaatttaaaaatttcttggggcaaatgaaaatggaaacaaaatataccaaaacctatgggatacagtaaaaacagtttggaaagagaagtcattgtaataaatgcctacatcaaaatattaaaaagatctgaaataaacaacctaacattatacctcaaggaactagaaaaataagaacaatataaacccagaataagtagaaagaaagaaataataaagatcagagcagaaataaatgaaatagagacaaaaaatttacaaaagatcaacaaaacaaaaagatggttttgaaaagacagacaaaacgaataatcctttagttaggctaataaagacaaaactcaaataaataaaaacagaaatgaaaaagatgacattataactgatgccacagaaatacaaaggatcataagaaactactatgaacaactacacgtaaataaattggtaaacctagaagagagtaataaattcatggacatgtacaacttaccaaaattggatcatgaagaaatagaaaaactgaacagaccaataatgagcaatgagataggcacagtaataaaaagtctcccatcaaagaaaagtccaggaatggatggcttcactgttgaattctaccaaacatttaaagaagaacaaatatcaattctacttaaactcttccaaaaagctaaagtgaaccgaatagttccatattcattctacaaggccagcattactgataccaaaaccagacaaggacacaacaaaaaagaaaactacataccaatatctctgatgaacttagatgcaaaatcctcaacaaaatactagcaaaactaattcaacaacacattagaaagatcatttattatgatcaaataggattcattccagggatgcaaggatggttcaacatatgaaaatcaataagtatgatgcatcacattaacagaataaaaaacaaagactatgtgatcatttcagtagatgctgaaaaagccttcaataaaattcaacatctattcatgataagaacttttgacaaactgagtataaaggaacatacctcgatacaataaaggccttacatgacaaaaccagagctaacattatatggaataggcaaaagttgaaaggtttttctctaagatctagaacaacacaagaatacccacgtttaccactttatttgacatagtactgaatattctagccaaagcaagtaggcaagagaaagaaacaaagggcacccaaattttaaaaagtggaagtcatattgtccctgtttgcagatgacatgaccatatacatagaaaatcctaaagactccactaaaaaactattagaattaataactgagtatagtaaagttgcaggatacaaaatcaacacaaaaatcagtagcatttctatatgctaataatgaactatctgaaaaagaaatcaagaaagcaattctattacaatagctacagaaatgctagacataataaccaaggaggtgaaatatctctacaattaaaaccataaaacattaatgaaagaagctgaaaaagacaaataaatgaaaagacatcctgtgttcatggattggaagtattaatattgttaaaatgtccatattatccaaagtaatcttcaaattcagtgcaatttctgtcaaaataccaatgatattcttctcataaatagaaaaacaatcttaaaattcatgtggaagtgcaaaagaccctgaattaccaaataaattttgagcaaaagcaacaaagctgcaagcattacactacctgacttcaaaatatactataaagctatagtaaccaaaacagcatggtacttatagaaaaacagaccaatggaacaaaatagaaagcccagaaagaaatccatgcacttttaaccaactgttttttgccaaaggtggcaagaatgcacactgagaaaaaacagtcccaataaatggtggtggaaaaactagatagtcacatgaagaagaatgaaactaggtacttatttttcactataaacaaaaatgaactctaaataaattaagacaaatacaaggcttaaaactatgaaactattagtagaaaatataggggaaatgcttcatgaaattggagtaggcaaagatttttcgaataagactgcaaaagcacagaaacaaaaccaaaaatagacaaatgggataatatcaaactaaaaaacttctttacagataaggaaacaatcaaccgagtgaagagtaaaatatggaggggttgttgcaaactatgcatctgacaatggattattattcagaatatataagaaactcaatgattcaatagcaaaaaaagaaagaacaaaaactaaataataggattaaaaataggcaaaaaacatgaatagacatttctcaaaagaaggtatacgaatggccaacaggtatatgaaaaaatcttgaacatcgttaatcatcaagagaatgcaaatcaaagccacaatgagatgtcacctcaacccagttagaatgaatatcattaaaaagataaaaaaaacacaaatgcttgtgaagatacagacaaaagggaattcttgtacactcttcgtaggaatgtaaattagtatagccattatggaaagcagtatggagatttctcaaaaaattaaaaatagagctaccatatgatccaggaatgctattactgggtacatatacaaaggaaatgaaatcagtatgttgaagagacatctgcacttccatgtttattgcagcactattcataatagccaagataggaaatcaacctatgtacccatctacagataaatgtataaatctatgtggaatctaaaaaagttgatttcatagaagtagagagtagaatagtgattaccagaggctagggatgggaggcgggagaggagaaccaggaatggttggccaataggtacaacattacattaggcagaaataataagttctggtcatatattacatagtagggtgactttagcaaataacaatgtagtgtatatttcaagatagctagaaaagaagattttgaatgttgtcaccacaaagaaatgaaaaatgtttaaagtaatggatataatactttacaccaactcaattattataccatatacacaagcaatgaaacatcaacttgtactccctaaatatgtacaattattgtttcaattataaattctaaaattaattaatcaaagaagaaatcaagagaacaaccatattttacaataaaataaaatgaaatacttagggatacatttatctaaggtagtaaaagacctgcacactgaaaactacaaaatattgataaaataaactgtagaagacataaataaatgaaaatattttccatattcatggattggaaatattaatattattaaaatatttattcttgccaaagcaatctacagagtccatggaatccatatcaaaattccaatgttaaaatttttcatagaaatagaagaaacaattctaaaatttatatggaactacaaaaaatcccaaatagccaagacaatcatgagcaaaaagaacaaagagttattaaaccacctgatttcaaactattacttaaagttatagtaatcaaaacagcatggtactggcataaaacacacatacagacaaacagaatagatagcccagaaatgaacatattcatgtatagtcaattgatttttcacaaaggtgccaagaatacccaatgggaaaaggatagtctcttaaacaaatggtgttgggaaaactagacagctactttatttctaaaagatattttcactggatatcagattgtagttctctttcagcacttgaaaaaatgtagagccacttccttctggcttctgtaatacctgatgcaaaatccattgtcattcatacctctttgtatggaaggagtatgggttccttgttactgcttcccacatggccttcagtgactctatgttgcggggagggcttgtttctgttgggtggtagcgacagttctgactctccattaggcctcttatacccctaatagggaggacaaggggcaccttatcaccgccagggtgttgggggagtggaaacccagcatcatcctcatgtggtttacacagacacttcagggcagggggctctcattacaacatagttgggataaagtcctggcttcctacatggaattctctgatctcaccccagtgggatgttgagatatttcattacagacttataatttcattacagactcttataggtgaaagcataggctctccactcagccttggctggcatgggggctatggtagataatattatatgtaggatcaagaaaagctgtggcagctctgtattcagtgaacacctgaattctttattctggtgatgaaaaatcttttttatttttatgtttatttttttagatggagtcttgctctgtcacccaggctagagtgcaatgacatgatctcggctcactgcagcctccgcctcccaggttcaagtgattcttgtgcctcagtctcctgagtagctgggaccacatgtgtgcaccaccatgcccagctaatttttgcatttttagtagagacagggtttcaccatgttggccaggctggtctcaaactcgtaatctcaggtgatccacctgcctcagcctcccaaagtgctggggttacaggtgtgagtcaatggtcctagccttagaaaaaaatttttttgagacagggtctcgcactatcacccaggctagagtgcagtgacaccatgttggctcactgcagcctctgcctcctaggtttgagcaatcctcctacctcagcctcccgagtagctgggactacaggctgctctaccacacctgactaatttttgtatttttaatagagatggggttttgccatgttggccaggctggtctcaaactcctgagctcaagtgatccacctgcctcagcctcccaaagtgctgggattacaggtgtgagccactgcacccagctggtgatagaaaaatctaataaggagtacacagtataagcttcaggataccagtttgactctatacattgctactgtgtgatacacagaagcagaaatttactctttccaagcctcagctttcttatttgtaaaaatgatggctatagtaactaccttaaaggactgcctcctagctcacaacaggggctcaataaatgacacttgctatcatcatcataactgtcatcattgtcattgtaacattaactagaaatatccagcacagtttttttttttaaataaatgtaagtcacatataaactagattctggctccctacgttaggatactataatagttagtagctgttctctaaggatccagaattgctatttaagccaggagtcataaacaggccccagagctgtgtgtgacctgcagaaaacttcttctcattaaaaccactgtattttcccttggggtttggactcacttcaggaatagctaagcaggttgtggcttcttaaggtcaaggcagacagtcaaaaaacctcttctagccatttggctcttactcggctgtgtcccagctgggccagttgggcatgtgacagggcaatggtccatttcaacaactcagtgcagctccagcaggcttttcctacaccatatgttgctagagccaagcaacaacctggtgagatagtgaggatattttgcagggaactggggacaagggtgaaggctcagagaggtaataacttgcgtaacccagcaaataagtggctgagtcaggaggggactcagtcattcaacctatatttcgtgagtaacagttcagtttggcttcctccagaagccaactctgagtcaaggatctggttgagagtgttttttcatgagagacgatcccaggaaatattggtaggggagtagggaagtcagaaaggaacagaaggcccccagtgaataatgaattcttaagcagtttagtacagggggccactggagcttaagcctcctgtagaccatataactcagccttatcccactttagggtgaagaaagccactatagtatttatccaccaaccctgacagtccttggttgaggctgctcccaggagtgttaattccctggggcctatgactctctgcctccaagacccgctctgcccaacacttcagatgctgatgtttggcagccagtcaggcatgcatgtgaatggtgaggagtgaggctctgcacagggcatttactttaatgtatcatatactcagcactgtgccaactgcaagagatgcagtggtagtcaagacagacatagttcttgctcttatggattttattatttaatgggaaagaccaaaaagtatataggcaattacaatgcagggtgataagaggtgcaatgatggaagtatagaattcttgggaacctatataggaggagtccttgtcccaagactgaggtgggtgcagaagagactccctagaggcagtggtatgttagtgatttaagtcaccactgtctcacctgtcttacctttgagtttccacaattctgttccctttgtacaaaataatctccatcttcatctgggcgtctaataacattcttcaagacttacattatatgtcacttcttcagagagatttttctgaatcttcccagtgggttttactttcaagctatatgtttccatagtaatcagtattcatattaagattaaataggagcagtgcctgcctttttaaatgttgtatccccagtacttgcccagtttctgacacacaggcagtcattatttgtggaaagaaggaataaatgacctgtctatagaaaaagctacactctgtgttgaggctggggccacaaggaagtgtgtattgtaattgggggtgtaaccactgacaggctctgccttataagaactgattctctatggctgaacgtgcaggtttgaattcaggaatgatatgggaatttctaagttctctgaagcaaatagtaatactctgccaaaaaatggaaaagaaataaaggttacttttagtatccatctcccaccttcccacaagttcaactccatatttcctgcattgctactacatgccaggattgtcttttgatgacttagaagaaaattctatgcagcttccattctagtgagcaagatagtgagcttaagaatacataagagataaaacattcccaagaagatatgagtaagaccagaacaggggaaatgtcaggaatcatgagcaaaacacaaggtgggcaggcacacaggagagcaagatttcccctccctgacttcttagaggtagcaggaataatttattactgttgggtgtgccagaacttcataaggttttcaaaccagcaatataaaaccagcaatatagatatgccatgcttcaatttgttctgaggcagagttcaaatttcaacactctagtcatgataaaaaatgaaaacactcaatgacaatttttgtgagtggttgggcaggaataactggaatcctggaataaggataaacagtcactcagttatttttcaggaccaaggacagtaggatgtgtgtacaggtgtgctcagaagcatattctcatgcagttattaattaagctaggcctatgacagattcacagataaaatgctctcaggtcatcagagaggaaaaaagtatttctagttggcagacggggaagccttcacagaagacaatttgggctttgctttaaataactgggaaaaaattgagtttaagaggaagtcattatggggcatagcttaggcaaaatcagagtttgaaagtgtagggtataattagataattaggttcttctaagtcgtgtgatgtgggtgggctatagtttgcatggaagaaagtgtaaggaaatagaagtggaagagcaaggtggatttagggaaatggaacaacttcagcaccacactgagaagacgggattgttaccctgttggcactaggcagctcctgaagatccctaaataggagtatggtttgcccatagagaattctcatggctgtatggaagaatgatttcagtagggccagaaaaatgagttaggaggctagaagaacagtgacaaagagggcctggacttcagcagtggcaggagtaatggaaaggaagaaactactgataagtcactatggtacctgggtgaggacagagagaaacaagtgaaaggcaatcctgaggtttccaatatggggcccagtggatggtgtcattaacagcaaggaactcaggagggatcaattctccctcccactgtctcctctcctcactccatgtcccaccaggcctcacactcctggacctttccagatccccagtttctctctccctccaggcctgccctacttggtcaatgccaactcctctgccccactgtctttaggcagactggctttatgactttgggaagaatcacttaacctctttgaccttccatttccaccttttaaaattggaagactcaaacacgggattgcacccaactctaaagttctagattttttccagtttacttctaccagtatgaaatgtactcagttgttaaacattcagagtatccccatcttctcaccaggtactggcatttaaaaaaggcatagtgccttaccaagaaacccagcaacaattgtggggtttcatggagcagccatggagataggtctgaaaaagaaggggataacttggattcagaggggcccttctgattctcaaatccttttccagagccactctctactctgacccctggtaaaaaacacttgtgtctatcaacagcagccatggtatgaatgagggaatccaactgggctgcctgcacaaggcagtaagccctccaggtagacattctgtataagactgactgagcaagcacagcacccatggacatggcctttcagctgtgccttacacatccctgacaatttcaagtacccaacttgaacctactgaatcagaaactggggatggggcccagcacttccctttttaacaaaccctgcagttgatcttgatgcatgccaacatgtgagaccaatacattaaaacatggagtaataaaaggaaaaatactactgctaaataatgcatgaatatattcattattttaagctaacagtagactcagtaatataatgtggtaaaatttttagaatggatagaatttaatttttgcgaataaagtagatatttccacaaaacctagcaacatctctatagacaaaggaggaaagaaattacccagaagccttaggtaaaaaaattcaggtaattaaggcaaatataagtgctgggttttgatttacatcctctaaatgtgtaggttccaagacctactctttctctttttgaaagcaatgcaaagtttgatttaaatgaaatctaaactgaaaccccaaaggtaaaacagataattgagttgtactctagggaaacaaagaggggtcatatctctgcctcccactccttctcacaagtgtgcagagggctccaggcaaggctcattatagcagaaaataactttaagtccctcttcactttacataccccatacaaaggccacagggaaagtatcatattcctgggacaggcattttaattaagatgaaaagaaaatgtgttttgttgagattgtgtttttctctaaaaactgagagtgaagagaagtgaggtaaacctcatctaaaaaagttcctttcagggagcacaattcaggtgcacacagtgaaaatgcaggtgcttcaatcgtctttgcagctgggagactgaagcacctgcccaggaatgtgctcttagtaaatatccttaattgagtcggacaatctgggaagcctatgaaattgccagcccaggaagtgggagtgactcagtctgtgtctgttctgtttgggcagatgcaactaaataagggggctttattgcttcagagcttttcctgaaaagagaagcccacctgtatttgcatgcacatttgcagccttctagaaaaacagaaacctgatttgccagctgttcagtcttctcagaactctgtgagtcaagtctcctttggaaaacatccagttttacagaagtgttcagccagaaggggatttaggtaacttctagtccagtggtttttgaactatttttgttttagaaactaaactcttctttcaaaagaaattaaccagaaatagattaaaatgactttattccacttgccccttcagccttctcttttttcccccttatcactcactgatcctgagggattcagcaaaacctagtttaaaaaccactgattcggtgtttaaaaagactgaagcccaagaagcaaaaggccttttcaaaggtaacaggagtagaaagtgtcagagcgggaacccgggaggcggagcttgcagtgagcagagatcaagccactgcactccagcctgggagacagagcgagactccatatcaaaaaaaaaaaaaaaaaaaaaaaaagagtcaatctctggttttgagatctttcctgtgcaattcttcaggcctatataattgtttatttggctgtgcattcattgtttgagcaaatgtttatgaaacaccttttatgtccaagcactagctagctgctatggactcagtgataagcaaaagaagatgaggctcctgccatcacaaattctacagtagaataaagatattgattaaatggtcacacaaataaatgtaaaataaagaggatgatactaaggaaggtggtaaaaatgatgtctagcttatgatttgtggacagtgacagtgaatattgcattagaccagatctgaatcctcccacatttgccagccccatcattctcagccctggatgcatattacaatccactttggagttaaaaaacaaaatatcaatactcaaggcctatccccagagattctgatttacttagttgggatgagatctgggtattggtcttttcccaggctcctcaggtgattctcacatgccactaaggttggaaatcactgctgttagcaatccctctcaggggaccttatgtggcttcttctctatttgattgtatgacaccaggaataaacagaagcaaaatgattcatctcccagaagggaacagattcccaggaaatcctggtaaatatggcatagaacatgttactgaccacacttggtcagttgaatgggtgggaagcagtgcaatagaatagaaagggccccaaactcacagataaatcctcagatgtgctgctaacatgtccccttcccatgtgtcatatgaaggcattgggccagaccaatggtttacatactgcatgtaaaggccacagggaaagtcttgaaacttgaacttccatcagcttcacctagaagctttgttcaaatacagattgctgggctccaccctcagcctctgatggatgaggactgagatgggacctgaatacctgcattccaaaaaaaaattctcaggtgctactagtgctgctgatttagacaccaaggctgtgatgatggtgactttaacagacagagggattccaagaggaatctattctttaagataacaatcctgtttctatttacattttgacattctatttatcacaaacttttgcattacttttgattcttctaaatatggcattaagatattgtttatcataactgctgagctttttggcatccctttacattttgcacctaggatgagtgcctcattcacttgattctaatccctgctgttagttcaatcactgaactaaatgaccctctaagggctcttcaagtttgaacttctttaaacagagaggcagtagggatggtgacaaagagaaaaagctccggagccaagctcccttgttcctgctcctgtaaatgtgttctgccatttacaagctatgtagccttgtggaagttgctaagcctctctgggcctttgtttttccttatccatgaagtcaagataatattaggttggtgcaaaagtaattgcagtttttgcctagatcccttgcatgcacagttcacaatagagttcatgctcatattgtgaactctattatgatcagtaactattaggttggtgcaaaagtaattgtggatttgccatttttaatggcaaaaaccacaattacttttgcaccaacctaatacttactgatcacataggtttatagtaattgattgagataacacccatagagtacatagtgtgtggttttagcagtgagcaccatcagcaaatgtcccttggtttaatcatctcctgagggatttccctcctgactaggttcacactgatttcttcaacgcctaaggggaatctttatgtttcttcaaggcagcatattataaatcaagttacacagcctcttggttttcctgattttccaatttgtccctggtgggtttgcattttctttattccaaagagttagtgagagatgaagctggctgggcttctgggtcaggtggggacttggagaacttttctgtctggctaaaggtttgtaaattctccaatcagcactctgtaaaaacagaccaatcagcactctgtaaatagaccaataagctctctgtaaaatggaccaatcaccagggtgggtggggccaaataagggaataaaagctggccacccaagccagcagtggcaacctgctcaggtccccttccacgctgtggaagttttgttctttcgctcttcacaataaatcttgctgctgctcactctttgggtccgcactacctttatgagctgtaacactcactgtgaaggtctgtggcttcactcctgaagtcagcgagatgatgaacccaccaggaggaagaaacaactccagacacgccatctttaagagctgtaacactcactgcaaaggtctgtggcttcactcctgaagtcagcaagaccacaaacccaccagaaggaagaaactctggacacatctgaacgtcagaggaacaaactctggacacaccatctttaagaactgtaacactcactgtgaggctctgaggcttcattcttgaagtcagcgagaccaagaacccaccaattccagacatattttggtgaccatgaagggaccatcgcctatcgccaagtggtgagtaccatcggacccctttcgtttgctattctgtcctatttttccttagaatctgggggctaaataacaggcacttgttggccagttaaaagcaactagtgtggctaccagactaaagacgcgggtgccaggctttctgagaaagggctttctaacaacccccaactcttcggagttgggagcattggtttgcctggaaccagctgctgcttttcctgtacttctgggctgagccaagggtcaacagagaggaaagccattcagcttcagggtcctgacaacaagttggttgaccctgcggccatgagcggaactctcaaagtcatgtcgcccaagtgagactcatccatctatcttatctatcctgacccttgcctcctgggtcctaatgcctgtcaaacttcctcttgcctctcttctccgaggctagtcccgcttctaaaaaccactccctgtctctggtgcttttctattttctcctgtaagaatgatttctagtataaactccaggactctgttaccttctttaggcacctgggctcaccgatcagaaagacataatttttgcccaaagccctgttgtagaggggattatctggaattttaggatccctcttcagacaagcaggcctaacaaaagctactcctgaagctaggatatggggagcctcagaaattgtatccttctgttcatataagtgaggacaaaaggcatcactcttccaactctggagatcccttccatcccacagggtatggccctccacttcatttttggggcataacatctttataggaaatggataaagtcccaatactaacaggagaatgcttaggactctaacaggtttttgagaatgtgtcagtaagggccactaaatccgatttttctcggtcttctttgtggtctaggaggacaggcaagggtgcaggttttcgagaatgcatcagtaagggccactaaatccaaccttccttggtcctccttgtggtctaggaggaaaactagtgtttctgctgctgcgtcggtgggcgcaactcttctgatcaccagggtccagggaccattgcgggttctcgggcaagagatgtttctgctgctgcattggtaagcacaactcttctgatcagcagggtccagggatcattgcaggtttttgcgcagggggagaaacaaaccaaaactgcaggtggttttgtctttcagatgggaaacactcaggtatcaacaggctcacccttgaaatgcatcctaagccattgggaccaatttgacccacaaaccctgaaaaagaggcagctcatttttttctgcactatggcctggccccaatattctctctctgatggggaaaaatggccacctgagggaagtataaattactatacgatcctgcaggttgaccttttctgtacgagggaaggcaaatggagtgaaataccttatgtccaagctttcttttcattgaaggagaatacacaactatgcaaagcttgcaatttacatcccacaggaggacctctcagcttacctccatatcctagcctccctataactccccttcctattaatgataagcctcctctaatctcccccacccagaaggaaataagcaaagaaatttccaaaggaccaaaaaaacccccgggctataggttatgtccccttcaagctgtagggagaggggaatttggcccaacccaggtacgtgtcccttctctctctttaatttaaagcagatcaaggcagacttggggaagttttcagatgatcctgataggtatatagatatcctacagggtctagggcaaacctttgatctcacttggagagatgtcatgctattgttagatcaaaccctggcctttaatgaaaagaatgcggctttagctgcagcccaagagtttggagatacctggtatcttagtcaagtaaacaatagaatgacagctgaagaaagggacaaattctctaccagtcagcaagccatccccagtatggatccccactgggacctcgactcagatcatggggactggagttgcaaacatttgttgacctgtgttctagaaggactaaggagaattaggaaaaagcccatgaattattcaatgatgtccaccatagctcagggaaaggaagaaaatccttctgccttctaccttcctcgagtggctatgggaggccttaagaaaatatactcccctgtcccccaactcactcgagggtcaattgattctaaaagataaatttattacccaatcaacagatatcaggagaaagctccaaaagtgagccctgggccctgaacaaaatctggaggcattcttaaacctggcaaccttggtgttttataatagggaccaagaggaataggcccaaaaggaaaagcgagatcggagaaaggccacagccttagtcatggccctcagacaaacagaccttggtggttcagagaggacagaaaacagagcaggccaatcacccagtggggcttgttaccagtgtggtttgcaaggacaccttagaaaagactgtccaatgagaaacaagccaccccctcatccatgtctgctatgccgaggcaatcactagaagacacactgccccagagggcaaagcttctctgggccagaagcccccaaccagatgatgcaacaataggactgaggatgcccagggcaagcaccagctcatgtcatcacccttgctgagccctgggtacatttaaccattgaggaccaggaaattgacttcctcctggacactggcatggccttctcaatgttaatctcttgtcctggatgactgtcctcaaggtccattaccatccgaggaatcctgggacagcctataaccaggtatttctcccacttcctcagttgtaatgactttgctcttttcacatgcctttcttgttatgcctgaaagtcccatacccttattagggatatattagccaaagctggagctattatctacatgaatatggagaacgagttacccatttgttgtcccctgcttgaggagggaatcaaccctgaagtctaggcattggaagaaacaaactcaagctccagccttaagccttcccacaggatgaaacttttctttatacatcacagagagaacaggaatagctcttgtggtccttactcagactcgtgggacaaccccacaaccagtggcatacctaagtaaggaaattgatatagtagcaaaaggctggcctcactgtttatgggtaattgtggtggtggccgtcttagtgtcagaggctatacaaggaaaggatcttactgtctggactactcatgatgtaaatggcatactaggtgtcaaaggaagtttatggctatcagacagctgcctacttagataccaggcactactccttgagggaccagtgcttcaaacatgtatgtgtgaggccctcaaccctgccacttttctcccagaggatggggaaccaatcaagcatgactgccaacaaattatagtccagactcatgctgccggatatgatctcttagaagtccccttggctaatcctgaccttaacctatataccggtggaagttcatttgtggagaatgggatatgaagggcaggttatgccatagttagtgatgtaaacatacttgaaagtaaacctcttcccccagggaccagtgcccagttagcagaactagtggcacttacccgagctttagaactgggaaagggaaaaagaataaatgtgtatacagatagcaagtatgcttatctaatcctacatgcccatgctgcaatatggaaagaaagggagttcctaacctctgggggaacccccactaaataccacaaagaaatcatggagttattgcactccttgcaaaaacccaaggaggtggcagtcttatactgctgaagccatcaaaaggggaaggagaggggagaacagcagcataagcagctggcagaggcagcagaaaggaaagagagaaagagacaggaagtcagagagagagaggaagaaacagagacaaaaagaagaagacagagagaggaagagacagagaaacagaaagtcaaagaaggaaaggaagagacaaagagggagtcagaaagagagaaagagagagacagacaaagaagaagtcaaacagagagaaagagaaatagtaaataaaaaacagtgtaccctattcctttaaaagccagggtaaatttaaaacctataattgataattgagggtcttctctgtaaccctataacacttcaataccaccttgttgtcagtgtaaacaagggaacaagggcataacccgaaaacactgaggccactgacaacccatagccttcctaacaaaaatccttaacccagcaggtttcctaacagggggatctaaatcttaattaattaccatacaaaggtctgaccacatctaggaggaactcccttcaggataggacgatggatggttcctccctggaaattaagggaaaaagacgcaatgggtactcaataagtgataaggaaactcttgtagaagcagagttaggaaaattgcctaataattggtctgctcaaacgtgggagttgtttgcattcagccaaatcttaaagtacttacagaatcaggaaggagccatctataccaattctaagttaatatggactgaacgaggtcttattaatagcaaagaataattggaatcccaaacttacaaggttttcaacaaaagtaaagtttgctaaaaaagttaacggtgtaacatgtattatcctaacttctaatcttatggaaatcagaccctatctgtgcccctcaaagctcaagtccatcaatgcaggggcatacaacgaatacacctacttatagggttaggaatggctactgctacagaaaccagaatagcaggtttatctatttcattatcctactaccacactctcagaggatttctcagacagtttgcaagaaataacaaaatctatccagtaaggatagtaactacaatcccaaatagactctttggcagcagtgattctccaaaaccaccgaggcctagtcctcctcactgctgagaaaagaggactctgcaccttcttaggggaagagtgttgtttttacacaaccaaaaaaagaggactctgcatcttcttaggggaagagtgttgtttttacactaaccattcagggatagtatgagatgccgcccggtgtttacaggaaaaggtttccaaaatcagacaatgcctttcaaactcttataccatcctctggagttgggcaacatggcttctcccctttctaggtcctgtgacagccatcttgctattacttgcctttgggccctgtatttttaacctccttgtcaaatttgtttcctctagaattgaggccatcaagctacagatggtcttacaaatggaaccccaagtgagctcaactaacaactactgaggacccctggactgacccgctggtcctttcactgacctaaagagttcccatccggaggacactacaactgcagggccccttcttcacccctgttcagcaggaagtagctagagcagtcatcgcccaattcccaacagcagttggggtgtcctgtttagaggggggattgagaggtgaagccagctgggcttctgggtcaggtggggacttggataacttttctgtctagctaaaggtttgtaaacgcaccaatcagcactctgtaaaaatgcaccaatcagcactctgtgtctagctaaaggtttgtaaatgcaccaatcagcactctgtaaaatagaccaatcagctctctgtaaaatggaccaatcagcaggatgtgagtgggccaaataagggaataaaagctggccaccggagccagcagtggcaaactgctcaggtccccttccacactatggaagatttgttcttttgctcttcacaataaatcttgctgctgctcactctttgggtctgcactacctttatgagctgtaacactcactgcgaaggtctgtggcttcactcctgaagtcagcaagatgatgaacccaccagaaggaagaaacaactccggatgtgccatctttaagagctgtaacactgactgcgagggtctgcggcttcactcctgaagtcagcaagaccatgaacccacaactggacacatctgaacattagaggaaaaaactctggacacaccatctttaagaactgtaacactcactgtgagggtccgcggcttcattcttgaagtcagggagaccaagaatccactggaaggaaccaattccggacacaatagtccataaggttaatgtaatgaaatgctgaatcttaaactaaactctttagaaaagcaagaaaaacctttggatcgattcttcttatttattgaacatcaatgaaataaatgaacagtacctcccaaagaggccaaggatcactcccatttatgttgagggacaaaaatatttgtataaagaggaagcagagaatgacattcattggatcttgagagggaagccatggtttgtgtaaatgtagtgactagttgtcaaattttttaataaattagtgctcccaacttatggactttttgtcaggctctagtttctttagaaagccatgtgagatgaagggatagggggaggaaacacaggcttatgaaggtctatgcataaaacatttatgaataaatgttaatttattcataaaatattttaattcataaaatatttatgaaacaccttatgaaggtctattcataaatcttcaccctggtgtctatgctgtctttcctcatgcctgctactgatcactgtttgtcctaactcaataggactttccactgtttgccaacatactctgtgaacctactcccttctgcataggttgagatgtttatctatataaaatgggcttccatgcttcttcatatcaaaatcttattcatgctttgagatctagctcaagagtcacctcttctaagaggccttcctcaaccccaccccccactcctatgtccctgtggttgttacagaggagtcagcctcatttaaggcacacctcagatgtttgagggtttctattcccacacatcatctttgataagttctttacatcccactgaaggagctcaactctagtttctgttttgttgattgtcaaactttaatcacagcaaaataacagaaacttagcttttggccagagaacctgatcattctgctactcagttcttatgaaaagcatcagtgtgggaagtgatattcacatcgtccttagattgcaccgtttgggcctctttactgatctatgcttgaatggtgtgtaatctatctgaactaagaaatattataaaaatgatcaccataaaatccattgctgcattacttttagaaagctcttagaaaaaactggccatgtgcttttattacctgctggagaaattgttctcatgattgaagatcaagaaaaactacactatttataagcaactggtgagctttcatcatgttgatagcagtgaattctgttctgttttcctctttaccctggcttggaaaaagcttggagtgaacattgaatagaatgttttgatgtgcattttaatgctgatcccattcctggcttcacattattttcctaattttatttactttttagtctcacctctatttttttcccttttgcctatatacttctgtaagacactttaaatccttgtatgaatgaggtaggggatacatacttagataattcatatttctttgaaagcagataatctaaatcctctttgttttgaaattctaatacttaatctagaacttgacatgttgtatacagttttaaaaataataagacgaaggatgaggtggaaggaaagattaagtttgctggcagaggtatctacatcctacttttacatctagacaaatgatgggaaaactcaagttttttttaggacatgcaagctacaccaaaaattttagaaaaactgaaaacctaaagatatcacttcacatgttttcaattcattttaatattgcacagactttaaggttacatacagatatttggcatacatagacatggctacaaattcaacaactatcccaagtgtaaaattattgttaaagtggttatttcctaactttctgaggcacatttatacatatttatatatatacacacacacatacacacacacacacacacacacacacacacacacatatatatataggacctggagataatttaagcattttttatactcactatagccattctaacacagaggtgttgtgactattaaatgagatgagaatgcactttgtaaagttaagaatcttaatcaagagcaaagtgaggtgtgcgtactcataaatacacactttacaagggcattcatttatctgtcagaaggaatttccaatttttgtggttgacataaaagggctataaatatggtgcataaaagcacacatacacaaacacaaacccagcaatacataaaaacaaataacagttgttactgagtacatgaactacttagagtcagctagactagtgatccccaacgtttttggcaccaggggccggttttgtggaagacaatttttccacagactggggcagggtggaagggggaatggttcggggatggttcaagtgcattacatttattgtgcactttatttctatttttattgtattgtaacatgtagtgaaataattatacaactcaccataatgtagaatcagtgggagccctgagcttgttttccttcaactagatggtcccatgttgggggtgatgggagacagtgacagattttcaggcattagatcctcataaggtgtgtgcaacctaaatccctctcatgcagttttcatagagcttacacttgtatgagaatctaatgtctttgctgatctgaaaggaggtggagctcaggcagtaatgcaagtgatggggtacaactgtaaatacagatgaagcttcactttgcttgcccgccgctcacctactgccctcctgctgtgtggcccagttcttaacaggccacggatcggtagtaatctgtggcctgggagttggggaccctgatctagactcctctatgtgtctcacacttactccatatccagttggttcacacatctggccactcccaacctactctacagctgccaccctggactgagctgcttcatggccagactcccaccattgctctcatccctgctcaaacattcttcacacagaagccggggttatccttcagaaacctgactcaggccttggcacttctctactcaaaaccctccagtggctgcccacgtcactgagggaaaaagccaaaatccttgccacgctcccttcctgtgacctttctggatgcctttccgactactgccccttcttcagcccactccaaccacttggcctctttactgtattttatatgtcacaggcacactcatggcctttgattttgttcttctttgtgcctggaatgctcttatcccaaattttcacatcgtttattttctcatctactccatgtctttgcttataatgtcacctcagtaggaccttccctttcagtcctatttaaaattataaatgccccccccatccctacataggagctttccattttcttccattgcttaacttttgtctgtaaaaattatcaccctttaacatgtcatatatatcaccatatatatcacaaataaactatatataactatacaactaactatataacttgctgtctatgcacaaaattattgaaagtattatgtaaaattaccttcagactatgtctataaggaatatataaaacaaaatgacaatttgagttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcacagatagctcttattattttgaaatatgtcccatcaatacctaatttattgagagtttttagcatgaagggttgttgaattttgtcaaaggccttttctgcatctattgagataatcatgtggtttttgtctttggctctgtttatatgttggattacatttattgatttgcgtatattgaaccagccttgcatcccagggatgaagcccacttgatcgtggtggataagctttttgatgtgctgctggattcggtttgccagtattttattgaggatttttgcatcaatgttcatcaaggatagtggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcagctgtgaattcatctggtcctggactctttttggttggtaagctattgattattgccacaatttcggatcctgttattggtctattcagagattcaacttcttcctggtttagtcttgggagaatgtatgtgttgaggaatttatccatttcttctagattttctagtttatttgcatagaggtgtttgtagtattctctgatggtagtttgtatttctgtgggatcagtggtgatatcccctttatcattttttattgcgtctattagattcttctctctttttttctttattagtcttgctagtggtttatcaattttgttgatcctttcaaaaaaccagctcctggattcattaattttttgaagggattttttgtgtctctatttccttcagttctgctctgatcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgcagttgagcggttttgagtgagaatcttaatcctgagttctagtttgattgcactgtggtctgagagatacctgtttgcagacgacatgattgtatatctagaaaaccccattgtctcagcccaaaatctccttaagctgataagcaacttcagcaaagtctcaggatacaaaatcaacgtacaaaaatcacaagcattcttatacaccaacaacagacaaacagagagccaaatcaggagtgaactcccattcacaattgcttcaaagagaataaaatacctaggaatccaacttacaagggatgtgaaggacctcttgaaggagaactacaaaccactgctcaaggaaataaaagaggatacaaacaaatggaagaacattccatgctcatgggtaggaagaattgatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatctcttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacgaaagccaaaattgacaaatgggatctaattaaactaaagagcttctgcacagcaaaagaaactaccatcagaatgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattagaaagtcaggaaaaaacaggtgctggagaggatgtggagaaataggaacacttttacactgttggtgggactgtaaactagttcaaccattgtggaagtcagtgtggcgtttcctcagggatctagaactggaaataccatttgacccagccatcccattactgggtatatacccaaatgactataaatcatgctgctataaagacacatgcacacgtatgtttattgtggcatttttcacaatagcaaagacttggaaccaacacaaatgtccaacaatgatagactggattaagaaaatgtggcacatatacaccatggaatactatgcagccataaaaaatgatgagttcatgtcctttgcagggacatggatgaaattggaaaacatcattctcagtaaactatcgcaagaacaaaaaaccaaacaccgcatattctcactcataggtgggaattgaacaatgagaacacatggacacaggaaggggaatatcacactggggactgttgtggggtagggggaggggggagggatatcattgggagatatacctaatgctagatgacgagttagtgggtgcagtgcaccagcatggcacatgtatacatatgtaactaacctgcacaatgtgcacatgtaccctaaaacttaaaagtataataaaaaataaaaattaaaaaataaaaaaaaatgaatttcatagactgggtcctatccccaagatatctcattatgtatttgcaaatattcccaaattaaaaaaaaatcccaaatcccaaacacttcttgttccaaggattttggataagggatacttaacctgtatatagcaggtaatttgttaattgtcttccaactagaagaactccaagagggcagggatttttgttgtttttgttcaccgatgtttcctagtacataaaacagtgcctgacacagagaaggtgcttaataaatgttcatcagatgaatgactgaaccacttccagaccctcctttccccaattttatagaccacattcgtctcatatcattgccctgttttaaaattctcattgaatttatatgactgtaaaaggaagttcaccttgcttagttggaacaatgtgaacctcctacatgaaccttctactgacatttgaattttcttcatcaatattcttttgctccattcaaactgatctcccttgctttgctttgtgcgtgctgtacactttcccacctccatatctatatttgccaatctgaaggtccaagttttactcatatttcaatgcctaaatcaaaagccatctccttcatggagccttctctgattcctccagcaggaaaccatctgtctctgccttctctgagtcttacggttggctgactctcataacacaacacagtattgcagagagcatagctatggttaagcataaatttgcatgccttcacagtgtgaccgtgagcatgtttcttaactcttgaatctttattctcttaatgtaaaataagaatgctaatatagttaatatattcttaatataatataatataaaataatgtaatatacattcttaatataagaatgctaatagtttacttgcagtatgattatgagattatttgagataatggaaatcccttattttctcaataaatgatatctattttcagtatcatcaccatcatctcttccttgaaatacgagtatattatttcctgttacattgtaagtttcttaaaaacataataaatgtcttaatttgtctctacacacacatagatactcagtaaatatgtgttaagagaatttgagaaccaagaccatcactttgtcccctaagttaaaacaaaaatacttgctaaaaagttggcccagcacagaggccaaggcaggtacattgcttggtcccaggagttcgagaccagcctgggaaacatggcaagatccatctctacaaaatttttttagaagttagctgggtgggcatgatggtatgcatctgtagtcctagctactcaggaggtaggagaattgtgtgaacccaggacttcgcggttatagtaagctatgactgcaccactgcactcctgcctaggtgacacagtaagactctgtctcaaaaaaaaaaagatgatagcagttttgggggggacaatcatcttctaacaagtaactctattcctttatgactttgttttacttctaagacgttgttagcatagaatttgaagcttactaacattaggttttcttattttatttccttgtatataaaaaggacttgtagttaaaaaatatccacctaagcttttctaaaataagtctgagaaaacataggggacacagtcacatatacagatacattgtggaatcaatatatgtagtgaggaaaatagaagcaagtctagggtgctatgggaacacaaaggcagtatattcaatccttctgtgttgggaaaatattttctagagaagatggcagctgagctaaactactagagatgagtgaaaactagtcaaaagaaggcaagagaatgggcattctatccaggcagaaaacatgtcataataaaaggcaagaagacttgaaatccaaaatagcatgatatatgctggatttcataagcatttaggcatgatcacagcttctattccagagcaaggagtaggaaaatgcaaagttggagagaaagttgttggccaagttacagaatatcctacatgtcatgctctagagctccattttgcaggtaaaggagaaacatgaagtattttaaatgggaaagaacatggtcagatttaagttttggatagattgctctggctgcagggtggaggctagatctgaggaatacaagaataaaggcaaacaaacaaaaatgcacatcagggctattgaaaaactccaagctaaagaaatggaatgcccaagccagagaagtaggataatacaagaggcgatggagtcaaaaactgtgggcaatagaatcagcaggatttggtgattgctttatgaatgggtttggagggaggaacctgggtttctatttggatgattgtgcagacagtgatgctaatcataggacatctttgaagagaaagagcagaacacaggctgggcatgtgggagggagatgacagttcagtttcagtcacactggaacgtctgtgcttagcatcttaaccttaggggagggagagattcgagctggagataacatttgttatcattagaaaacagagtggttcaaaccatgggagtgtgtaaactaactcaaggatgaagtttacgtagagaacagaattctggtgaacacagcatttaaagcagaggaggaggagcctacagaggaagcatattaggaatgcaaagagaaagagaagagaaaaatcaaatgaaaataaatttgttgaagctaagagggtagaaaatttcaggaaagagggattgatcaatggtatcaaatgcagctgcagtgtaaagtaagatacaagcaaaaaagtgtttcttagctttggcaaaaggcattgtaaattaggtttagagtgagaaggaaaacaagacagggttaagcctgccacttggaaaagatgatgtcatgtaaacaaatgacagtgaaagaaaagcttccaacattcctgttgcttgtctatcctaacaaaattaaggatcttcaagctggaaaggtaaagcaatgtctttaagcagcaattaaggctcaagataagttagaagatgataaagacaggaccatgtagttttgcatgtaggaaatcttccaggcccagatgaattatagtctacgacacacacatgcatgcgcgcgcacacacacacacacacacacacacacacacacacacttagaagcgttaagcatcatagataggaatgtcaaaaatgctaagaggctggaagctaataaaaagaaaggggacctcagaaaacttgtcaaatatataaagtactattatatggaatagaaagagtaaatttattttgtatgacttcgaaaggcagaacctaaataaaagtgtagaaattgcagaagcacagatttccactggaaacaactttctatcatccagtcatgacatagccaccatgaaaggcagtattttcctgtcttggaagtattcaagatgaggttgatggccatctgtcaggagggatagttggactcgatttggaagggtcaatatccagtattcatgccttcacctctctttaaaagatctcattttttatatatattttttaaaaacacttttccttattgagcttagaaaatcaaatatatttgtcatcactggattctattatttctaaggtcctttctgaataggaaatgttatgtatctagattctagaaaatatagtaaatgttgatgtaacgatgagaaacccagcttagttaactaaattatttgggacctggagaggactggaacagagttggtgttgtgttagtttcatttgtcatgggaccccttgcaggagaacaagggttatggactgaattaggcagtgctccatgctggctttggactaccagcttttaaaacaaatatttagtgatgtcctcctggtgccagacccaacactaggtaaagctactgtggtaaaaacatgtaaagacagacatcaggcaaactcagaacagaagatgatggtggttattattttaaaaaactccctcttggccagttaaaatgaattagaatgatcaaaagcattagcactgagttcttgctttgtatagttcagcctacaaatcaaatactgctctctgtttattactgcaagatcataattcacaaaggaatgttcagagaggtcagtatttatgactacccgaagtgtttcatttgcaaaaattataaatggaaaatctggcacttagttagaaatgtagatcttctggtacataaatttgccccattgatttttatgtatttcttaaactgtgcactgttgatttcaatattgttttggaacagattgaccataaatatttaaataactgctgttcaacaaagttactcaaaacagtagctgtttgaagatacaactgtgatctgctgaggtcaagaaaagcaaattaaaatagaaaagattcagaataaattgttacttggaactgttttatcaaccaaaacagaagaaagttaataagatcatccttgcaatttattagtaccaaaaatatgtttggagtggaatgtatgtatacaatatccaccaccaacatgaaggtgggaggaaaggaagattttagatttcacaatgacctgaatgaaaggattgagctacaaaacctggtgaagtgagatctaatgctggccaaatagttttactttgttttttgttttgttttgtttttttttaaaaagtctatctattactttgaaagaggatatgttaaaagcacagagtgctttgcatctgggatctactaccaaaaatatagcaaggtggctcttgtcttaacaactagtctaagaaatattctcctatgtgacctgaatacctactcttttcattgtagcatgtaagagatgttaaagccatcacttaaagatgatttaaaatatttcctagagaagcctttctcagcctccgaggctagatctgattcttctgtatgagagctatgggaatacaccgctcagatctcgtttcaaggaaaacatgctgtgagggatgactgagtatagcatgggtactagatctggccattccttatcaacagaggatttctctagaaggcagtctttgctctgggcctccctattaacctggcctagatgttctcagagctgcattcaactctgatgctctttctacccaatctttcttcgtccaccctctccttataaagatgttagagttgcatcactttctatagctttccccactcagattttctctctctttttttctccatagtcattccttctaataaatcctgtgacacattcaattccctcttggtatttgatcctggagaatcaaaactgacactccattaatgtaccctcagagttccttgtaccatttatttaaagcccacatattttgtaatgatatatttatatgattatttaataaataattttcatcctatcagaccactgactttcactggggtaggaaacatgttgacttcatccctaggtctacaaaaccacctagaaattcatatgtgatttataaatatgtattgagtgaatatatgcattaaaaaatagtgatagtactatactatcataaaagatttgggggttgcattaaagaagataaacaaaaaagtggtcacaatagactttagcaagaggaggagaccaggaggggtggagaaagaaaacaaaaagtgaaaataaatcaacagtgcttgaaaagttgcttgactgtatctttctgcttatagggttttgatagagattgacagagaaggtatattcaatactgcaaggatctcagagctcagatgataagaatctggtattactatacttgttttaacttctaatgagaacagtactgatgagcccagtcaatattaatcacattcttgaagttcaggcatttatattcttaactgaaaaatgaaaacattttccacatcaaaccaagcaaattccatgaataccaagggcttaggaaagtattttagttcgagaactgtataactaaattttccaggtctattatgatattctatatgctatattgtcattaattcttatagtcactgaaaaacttgtgagcttctttgacacacagaattggtagtgtatgttaacagaagtggagttgaaacaatacttttttgacttttgtttctgatcatggtggggtaactggtaccagactagctcttccactgcaaacaactagaaaactgttgttgtacaaaatgtaggaaagacatccctatttttgaatatcaaacaatgaacaacacagaactgtaaccacctagaaaaggaaaacaaacagacttaattgctctttcagtttgaaggcctttgatgaaccctggggtaagaaaggggcacccaaggaaaacatgacagtcttacttagctgaggagacagagatgatttcaggcagtttcatgcagccataatttggaggcagatactggagaggtgagagtggagaaagagtttgagaaatctgcaatagaagtcctattgagtctttggttgaatactaagatgcacatgtgcagtgtgagactccacaggcttggcaaagagtgactatcagtgagcctaaaatactggggaggtataaattaatcaactatgagaaccaccccaaactgagagagcttccatgtgagatgttgaagggagacccaagaaaggctataccttagcagcagggctaaaatagccacagggtgatagctaatctagattcattcaagcaaaccttgcaaacaggccttaaaaggagcatgattattaatgaataaattaactgctatcagaatgaagcccaatattttttaatgggagacatctagatactcaacaacataacattaacaatattcagcatcatataaaaatttctagatatgcaaagaagctatgattaagattaaaatcagtcaatagaagcaaactctaaaaatgataaggatgatggatgatatctttagtcaaggacttaaaaaatctattaagattatgttcaatgacaacaaataaaacataaaaatattgaggggagaaatgaaatctatgaaaaaaatacctaaaggaacttccggagttaaaaaatacagtgtttgagatgaaatttactggatgagcttcaacacaactcaaacacaaaataagttaaaaaaacaataaaattgaagatggggtataaaattattcaaactaaaacattaaaaagtggctaaaagataaatgaacagaacataagtgttgtgtaggaaactatcaagtcattgaacatactgcaattggagttctagaaagagagtaaagcgtgggcagaaaaaatatttatagaaatcatagctaaaattttctggccaggcgcggtgacactctcctgtaatcccagcacttgtgggaggtcgaggtgggtggattacgaggtcaggagattgagaccatcctggtcaacataatgaagccctgtctctgctaaaataaaaaaaaaaaaattgttgggtgtggtagcatgcaccttagtcccagccattcgggaggctgaggcaggggaatcgcttgaacgtaggaagtggaggttgcaatgagccaagatcatgccactgcactccagcctggtgacagagcaaggctccatccaaaaaaaaaaatccaaatttaataagaaaataaagccatagaactaagaaattcaataaaatttgcttaggataaatacaaagaaaatttttctaaggaacatcataataaaattgctgaaaaccaattacaaagataaaaatcttaaaaataggggaaaaaagtccattacatacaggaatacacattaagaattaccattgacgtcgcatcataaacagagcaaaccataagataatgggagaatctagagtgttgaaaaaaggaaaaacaaaacccagtctagatagaaccagtgaaaatattcttatatccctcaaaaatgaaggcaacataaagaacttttcaaaaaagaaaaaaagttgagtgaattcattgtcatgcataagattttagatgtgaattcatatctaaagaatgaggaataaaggaatgacaaaaattagaaatgataaagatgtcagtaaatataaaagataattttctcatttttaatttttttaaaaaagaataacaatgaattgtattatgccatatgtacatatattatatttagacacatatgtatacatatatcatgtgtagaaataataacaatcagaaagggaaagacatgctgttgtaaggttcttacattatacgtaagtggaataatatgctgcgacaagtgtattataaatcctagagcaaccactaaaacgaaaaccaaaacaaagaggtatagcaaggaattcagtagaggagatagtatgccaaaaataattaatatgaatgaagtcagaaaaagaagaagcaaggaacaaaaagcagatggataaatagagaaaatagcaagatggtaaatttaaaaatggaatgagctcaccaattaaaaagcgtagattgacagattggataaaaatgcaagacccaactaaatactgcctaaaaatatacactttaaatataaaacataggtaaaaagtaaaaggacagaaaaagacctatgatgtaaacaataatcataagagggatatcttagtatcatataaagcagatggcaggctaagctatattgccagggccaaaatgggacaattcatactaactgataggtaattttatgtgtcagtttgagtgggttaagggatacacagatagctggtgaaacattatttctgagtgtgtctgcaagggtgtttctagaagagattagcattggaatcagtagactgagtaaagaagatgaccctcaccaatgtgggctggcatcttccaatccattgagggcccagacagaaaaaaaaaaagtagaggaaggacaaatttgctctttcctggagatgggacatccatcttttgcccccaggcatcaaaactccaggttcttgcgtcttcatctgcagaatttacaccaatgccccacaggcccctccagttctcaggtcctgcacctggggctcggagttccatcattggctcccatcattcttggcctttgggcccagactgagttacactactggctttctttattctccaaattgcagatagcatatcatgggacttctcagcctccataattgcgtgagccaattctcataataaatcccctcctctatctatctatctatctatctatctatctatctatctatctatctatcacctactggttctgtttctctggagaacgctaatacactgataaaagggtcagtacatcagaaagacattaatatattaaatgcagattggccctataaaacagcttcaaaaatgtaaataaaaaactaactgaagcaaaaggagaaatagacaaatccacaataatatttggtaatttcaacattcctctctcagtaattgatagaacaagtagaatgaatatcagtaattacgcagaagatgcaaacacattattatccaatttcacttatttgacattgaaaaacacaacacacaacacctaaaaaaatacacatttttaaaaagtatatgtggaatattcaccaagagatcatatactgggctacaaagtgaggctcagagaatttaaaagaactaaaatcacacagagaacactctctggccacaaaagattaaattagaaattaataacaaaaatagagctggaatgtcctccaacattaaaaattaaacagcacatttctaaataacccagtggctcaaaaatgtcagaagagaaattcaacaatatttcaactaagcaatgatgacaaaacagtgcatcaaaatttattacttgcagataaaggcacacttagaagaaaatttatagctttaaatgcttatgttagaaaatataagttttaaaatcaatgatctaagcttctaccaccataagaatacggaaaaagaagaactgagcaaaccaaagtgaagaaaaggaaggaaataaagataagagccagaataaaaaatggaaccacgaataggccctttgaaaaaaacaataaaattgattaacctctagttggactaatgaaggaaaaagagaaagagaaaaaaaattgacgatatcagaaatgacagaagggatctcattataggtcttacagactttaagaagaaaataagtgggtattatcaaccattttatgctaatgaattttccagttcagaggaaatagacaatttctaagatacaatttaacaaaactgatatgtaaagaatctgaaaattcctataatctactagaggaatcacatttttaataataaaaaatcatccccaaaatgtggatccaaatggttgcaataataaattccttcaaatatttaagaaagaaataccaatcttatgtaaactcgctcaaaaaatggagaagaaagaaacaatccctaacatgttataggaggcaagcattaccccaacgctaaagtcacgcgaagacattacaaataaaaaaaaaaccccgaaataggagaaaatctttataaccttaagttaagcaaagatttcttagatatgacaccaaagcatgatctataaaaaagacattaataaactgaacttcatcaaaattaaaaacttctgctatgtaaaagataccgtgaagagaatgaaaagataaaccataggccatgagaaaatatttgtaaatcacatacctgataaaaggacttggatctagaatatataaaggactctcaaaactcaattataagaaagcaaacaatccaattgaaagatgggcaaaatatttgaacagacatttcaccaaagaagacacagaggaaactaaaactggaaacagatatggtaatccatgacaaaatgttagcatttagaagtaagcaaataagaacataaaaagataccctgcttccttagtcattatggaaatataaattcaaactgcagtaaaataccactatactcttagtagaatgaataaaaataaaaagactttctctaccaaatggtagtgagaatgctgaggaactggaactttcatacattgctggtgagaatgtaaaatggcacaatcactgtagaaaacaatttgacagtttcttaaaatgttcccctatcgtatgatcaaaccattctacacctaagtacctactccagagggaaaaaggatagatctccatataaagaattgtccatgaatgttcatagcaagtttatttatataataatagccccaaactggaaacaatccaaatatccatcaacagataaagtacggtatatccatacaatgggacacttctcagcaataaaaagatcgaactattgctacacacagtaacattgatgaatctcaaaacaatgatgctgagttaaagaagccaggaaaaatacatactctatgagtttatatatataaaattctagaaaatgcaaactaatctacagtggcagaaagagggctagggaaagggatggattacaaagaggcacaagaaactttttgagggtaatagatattttcattctcttaattagtgatagtttcatgtgtatatatctctctatatatgtcaaaacttatgtacttgtgcattttattatgtacaatttactgtaggccaactatacctcaacaaatttaaaaagtcattttaaatagataactatttaaataaatatttctcaaaaatatacaaatgaccaataagcacatgaataaatgttcaatatctttagccaccagggaaacaaaaattaaaaccatgagaagatactactacacactcactagaattctcaaaaagagtggcaattgcaaatgttggccattatgtggagcaactggaactctcatacactgctggtgagagtgtaactactttggaaaatagtttggaaatttcttataatactaaatatgcactaaccacatgacccagcagttctactcctagtatttactcagaggcaatcaaagcatgtgttctcaaaaagctttctaaaacacagttcccggtagcttttttcataatagaaactggaaaccacacaaatatctatcatcaagtaaaagaataaaaaaattttggtatattcacacaatagaatactatgcagtgataaaatgaaggaactactgacatgcaataacatggatgaatcacaagaacattttgctggaataagtcagacaaaaaggaacgcatacaatacaaatccatttatatcaagttctacaaggataagccaacatataatgatcaagtcagtgtggttatacaacattgcaaatgtactaaataccactgcattgttcatctgaaaatggttaattttatgttgtatggatttcacctcaattaaaaattagtgggccgggcgcggtggttcacacctctaatcccagcactttgtgaggcagaggccggcggatcatgaggtcaggagatcgagaccatcctggccaacatggtgacacctcgtctctactaaaaatacaaaaattagctgggagtggtggcatgtgcctgcaatcccagctactttggaggctgaggcaggagaatcgcttgaaccagggagtcagaggttgcagtgagccaacatcgcgccactgcacccctccagcctggcaacaaagcgagactcggtctcaaaaaaaaaaaaaaaaatttagtgtggatggctaaggagattcactctaaatggtcactaagtaatctttttgggatgattgaaatgttctgtatcttcactgtggtgatgatcaatgggagtatatatgtgttaaaactccttgaattatactctttaaaatgggtgcattttattgcatataaattatgtcccaacaaagttcatttaaaaatacattttctcaacttcactttcaattattggtgcttaagtgtctcttttgggcgatgagagataagagaagtccgtggttggggcttccaggacatctttttaacaagaggcaactctgctgtcacggactttgtggcttttgtctgtacttcaggcagatgagacccttgaagttgactttatcaacagctttccatgctctctgactgctggttgggtttagcctataggaattcccaagaggagataagagggaaggtgggagatatttacacacacgtactattttctgcaaggtcttcagttggctttacctcttaacagaagaccttggctcctctagaaacaaagaactcaataggacttctcatttttcggattcagtaacctcttctcccttcttgatcctgcaggaccaaggctaataataatttagcccctgattactgcactatgctttttaaattgaagagtaacaggtatacagaaagggcactgaatgctgatttttttcacccattttaccaccacctagatcaagaaatagaatgaatactcaaaaaacacctttggattcctacctcagtcattccccattttatcccaaagcaaacaccatcgtaacttccgatattttgtttttgaaatgtgtataaatgaagcaatacagtatattttcattcttgtaagctgtcctttgtataaatatctcacaatttacttggtcattctattttttatggactttgagttgttttcatttagggttatcatgaacagtactgctatgaacattcttatacatgtcttttggtgaatatatgtatgtgtttctcttggatatatacttagtagaacagttggatttactgtatgggtatgtgcagttttagtggatttacccattttccaaagtggttgtaataatttatactcgcactggtagcatatgagatttttagtatcacaatatccttaacaaccattgatatttttagtccttttaattctagccattctgatcagtatgtcgtggtattccattgtggctttaatgtgcatttcctgataatagaattgattacattttcaagtacttattctcttttttgaaatgcctgtcaagtctcttgcctattgttctattgagctgtcagagtctttcttatttgtagttccttataatctgatgttaagtctgttggtagtcacctgctttgctaacctatttttctacactgtgtcttgcctttttagtcttttaactcctttttttgatgaatagaaaaatttaactttaatgtagtctaatttatcaatatttccttctatgattattatcaccttttatgtcattttaaacgttttaacctacctaaggttgtcaatattttatcttatgttatagtctagaaagtttagtgttttattttacacattttaaacatttcatctgaaattgctttatgtgcctgtggtagggaccaagattatttctccccaaataatttcaaattttctccacaccatttattgaaaagaccacattttctccattgctctgcaatgccatcttttcaaaagattggcaatccatataaatgtgtttctggactttattatattccattgatttgtttgtttgtcctgtatccaatacccaatatcttaattattgatgctttataagatatcttaatagatggtgttctagactgaactgtgcccccctgcaaatttatatattaaaaccctaacctcccaatgtgacaatatttggataaagggtctttaaggaggtaaataaggttaaataaggttataaaagtgaggtcctgatgcaataggactggtatacttataagaaaaggaaaagacaccaagagtgggcacgcataaaggaaaggccatgtgaggtcagagcaagaaggaagctgtctgcaagccaagaagagaggcttcaccagaaacccatcccgccagcaccttaatctagcctctggaactttaagaaaatcaatctctattgttgaagctacccagtctctgatattctgttatggcagccccagctgactaatataagtggaaaattcctctactattcttccaattgtgttggctggctttttgtgctttacatttctatataaattaagaattagcttttcagtttccacaaaaacaatcctgaaatttttattagaattgcatgttgctgtatatcacctaggaaagaataaacaactttacaatattgagtctttccatctgtgaacatgatatattcctccagtcacttgtcttccttactttctgctaataaagttttttggtattgatgttttgaccctctgtacttagatttattcctaagtagttgatgttatgttgctcttataaatgatataaccccccaaatcattttaaatgttttttattatcatgtgaagatataagttcattttacatgttaattaggtatctaaacaccttgcaaaatcacctgttgattctaatagtttgcctataagtactttcatattttctatgaaaatatcccattaaaaagttcccttctacatgaagcttgctgagagattttttttcatgcttattgataatataatttttaaaaattcagttctagaactagcctttagctttttagtccatttacaattaatgtaactaccataggtttatttgttttattttgggctaggaatgtatttttaacttctgaaatttccctctattagcttgtaactgatgaattattttaccatttaaaaaatattgattgcaccagaaattgcaacatacatctattaattattaaagtctaatttatattagctatcttactacttccccgaaagtctaagagagcttaataactttaactcccttaatcccttccttctgttatttgtgttatttttgtcccctgttttaaactttacatgacgttattatttctgttcatttttctatcaacatacaacacttttcattatggttcactcacttctgtattttaaatgcatgtctctccttgcaataaattatctcatattttactcgtttaaaaacatctttatggccgtgcgcggtggctcacgcctgtaatcccagcactttgagaggccaaggcgggcggatcacgaggtcaggagatcgagaccatcctgactaacacggtaaaaccccgtctctactaaaaaatgcaaaaaattagctgggcatggtggcgggcccctgtagtcccagccactcgggaggctgaggcaggagaatggcgtgaacccgggaggcggagcttgcagtgagctgagatcacgccatggcactccagcctgggcaacagcgagactccacctcaaaaaaaaaaaatctttattttgcttttatcttaagggttattttattagatagagcattcaagagtggcagttggctcctttcagcattttaaagctgtgactattgtctttggggttccataatttcatttaaaattcagctgtccaactgtttttgttttcatagtagtatgtgtttctctctatttttaagattttggttttctttttagcagttctactatgatgtgtctaggcattgcttttttttttaatttatcttgactggagttaataacagttcttaaatctgtagttcaatggttttcataaattttagaaaaatctcagctggtatctcctcaaatattgatattgctcattacctctctgtcatacttcttagacctcaataaaaaatatgttactatgtcccttgtatctttaggcttttttcttattttctatcctttatacttaggcacatagaccaatggaaaagaataaagaaccagaaataaactcaaatacttacagtcaactgatcttccacaaagcaaacaaaaacataaagtggggaaaggacactcttttccacaaatggtgctgggataattgcctagccacatgtaggataatgaaactggattctcaactctcaccttattcaaaaatcgactcaagatggattaacaagctaaactgaagacctgaaactataaaaattctagaagataacattggaaagaaccctctagacattggcttaggcaaggatttaatgaccaagaactcaaagcaaatgcaataaaaacaaagataaatagctgggacctaattaaactaaagagctttttgtacagcaaaaggaacagtcagcagagtaaacagacaacctatagactgggagaaaatcttcacaatctatacatctgacaaaggactaatatccagaatctacaacgaactcaaacaaatcagtaagaaaaaaacaaacaatcccatcaaaaagtgggctaaggacatgaatagacaattctcaaaagaagatacacaaatggccaacaaatatatgaaaaaatgctcaacatcactaatgatcagagaaatgcaaatcaagaccgcaatgtgataccaccttactcctgtaagaatggcactggaacagaggtgtgtctatctcgtttggttacatgaataagttctttagtggtgatttgtgagattttggttcacctatcacccaagcagtacactctgcaccatatttatagtattttagctctcacccccctctccctctttcccccgagtccccaaagtccactgtatcattcttatgcctttgcatcctcatagcttagctctcacatatcagtgaaaacacagatgtttggtgttccattcttgagttacttcacttagaatatagtctccattctcatccagatcactgcaaatgctgttaattcattcttatttatggctgtgtagtattccatcttatgtatatataccacagtttctttatccacttgtttattgatgggcatttggattggttccacaattttgctattgtaaattgtgctgctataaacgtgcgtgtgcaagtatctttttcgaataatgacttcttttcctctgggtagatacccagttgtgggatttctggatcaaatggtagttctacttttagttctttaaagaatttccaaactctccttattgttttccatagtggctgtactagtttacattcccaccagcagtgtagaagtgttccctgttcactgcatccacgccaacatctactgttttctgattttttgaaaattatgagaccatgctatagtgacaaatgaaaaccttaggttaataaaataaatattaaatactcaaattaagaatgcaatcagtggacctaaaagctgctgtactataacagtagagaagattactgaccaggaagtcaggccaataaatgtttggtcctgggcctccttctattttcaatttctactttttctcttaataaccacccatgtgcatggctttaactaccatctatacctctcattctgttctcttcccaaaactcatggcctatttgatgtcactccatggagggatgatacacaactcaaagttaatcttactaacttctcccattagaacataagttgcattggaacagaggtgtgtctatcttgcttgctactgtatgaccagtactcataacttagtctagaacatagtaacagatatgaatgactatttgtggaatgaacccgagaagatactcatagctagattgtacttctttttgcttagatgacttctgactggaatggggttgggaaggttttagggggtttgggatggagacagatggtgggttgggaggtaatgattcatcctcattctttgctatctataagcctacatagcaagtcaagccttcatcacagggatgccactcatatttccctcattgacaccatacttaaacttatccaatttactagcaatcctatcaactctgcctccaaaataattgatccaatatctattcatttctttacatcttctctgctgttgcattaatccaagcctctgtcctttcttgtccactgtgatagcctcttattggtattcttgcctcctactcttatttccctatcatttatctccacacagcaaccaaataccttaaaaataacaaaaaaaattaagtccttgacctactttaaactgcaaaggtttcctattacactgaaaataaagctaagtttcttactatggtgtttaaggccatatatggcctagcgcctaccttccatactgactctggcttcatcattcttccccttgcaaactaagctctagccacactgctctgctttcttttatgctaacatagtaagctcattattgcttaaggtcccttttacttgcttttccctctgtctagaagatcctctcccctggtttttgtatggctgatgacctcatgtccttcaaatctttagcttcctggaccaccatatttaatggccactcaatctttcattatcacactatcctgtattatcttcttcacattttttatagctaactcaagttattttctagaatatttttccttttattgtctgttttattcattaccattttcccagcatctaaaataatagtgacccataataaaataatgacccatagtaggtccttattacttatctgtggaatatcgcagtgaatgacaatgaaaggaatatactctcaagctctcatgccactgctcttctaaatgtcatttctttggaatgagtccatgtttattttttctttacttaaagggaaataagtaaagtttaaaatccgtaattttttccctataccctgtctcttcttatagaactattacatatttcttgtaataataatgattgtatatgttcaattgatcttttattcctgtcaatgtgctagattatctcatttatttattacatcaaccctctaaattagatcctattataaagtgtactttatagataagatgtatgagttttggaatgtttccattagtttctcaagaccacaaagctaaccagtatttcattttactttctcaagtgaactttaggaaccaggtaatgataagatagactttggataactgatgactgaaacttttttaaaacaacccttttggtaatcagtgatggtggtagaaggagggaggtgtggggtggggggaggaagaggaagggagagagaacacttcatatcatgacagccagataaaactttggtagcaatctctgaactcagctcatttaacatcattcccagaaggaaggtgcattagttcgttctcacacagctattgtataaataactgcctgagactgggtaaattataaagaaaagtttaattgactcacagttctgcatggctggggaggtctcaggaaacttacaatcatggcagaaggcgaaggggaagcaaggcacatcttacatggtagcaggagagaaagagagagagtgaggggagaaggtgccacacttttcaaccattagatctcatgagaactctatcacgagaacagcaagggggaaggcctcccccatgatccaatcacctcccccgagttcccttcttcaacatgtgggggttacaatttgacatgagatttgggtggggacacacagccaaaccatatcagagggacaaaccaaagtcaggtcattctctctgaattcctttgtcttctgttagaacaacccactaataagtagactctcaaggctttgggttcaggaaaatcagaaagactgactttgcttgaccatttaatcttggggcttagcttgacatatttattctgttatccaagaaacaaaattacatgcaaagtagaaagtcatttacatctgccaaggagtttagtttgaaataggagagaatggaaagagaaaaatagttaagaaaaatcttaggaagataaacaacctcaaagaccaagagtctgtcttaatataactgcaaatgttttaatgaaaactgaagggaaaaaaaaacagtttggatgtctagataattgattaaaattttaattttctacctggttgtttggtactataaaaatataatcatgctaaatcacttcacaaagtgttgtaataaatgttgctttttctcaatggattttcttagaattttagtgttctgtattactattttgtgtataaagtacagtgattattttttaaaatttccaacttttattttaagttcagggatacatgtgcaggatgtgcaggtttgttacataggtaaacgtgtaccatggtggtttgctgcacacatcatcccatcacccaggaactaagcccagaatccattagctattttcttcctgatgctctccatcctcccaccctccaccttccaacagaccccagtgtgtgttgttcccccaatgtgtcattgtgttctcatcattgagctcccacttataagacataacatgcagtatttggttttctgttcctgtgctagtttgccaaggataatggcctccagctccatccatgtccctgaaaaggacatgatctcattcctttttatggctgcacagtattccatggtgtctatgtaccacattttctttatccagtctatcatcgatgggcacttaggttgactccatgtctttgctattgtgaataattctgtaatgaacatatacatgcatatatctttataatagaacaatttatattcatttgggtatatacccagtaatgggattgctgagtcaaatggtagttctgcttctaagactttgaggaattgccacactgtcttccacaatggttgaactagtttaccttcccaccaatagggtaaaagcattccttgttctccacaacctcaccagaatctcttgtatttttgactttttaataatagccattctgactgtgagatggtatttcattgtggttttgattaaatgcaattattttacgcatttggaggattaaccctgcccttaaaatccattgacccatagcattagaaagactttttgtgaaatttagtaatggcttaatttgtgtctagattagccagtgatggttgcaatggagaggaagtatgaaaaagaaaatcaacaaattctattaagctattgaaatgtgtcagaaattttgctaacccctccatgaattagctcatttaattccacgttaatcctatacagtcttattatgactcaagtttttagatgagcaaactgtatgccagagaggtgaagtaactttgcccacgttagcatacagtagagcacagggaacccaggcagtctaacgagagtttaaccactccagcatacagctcttgaaggaaactacagtagcttcagggaaaaaaaattatttttgcctaagatagttaaatcacagcaacaggggctgtggaaccaattgtctgaaagagtctataccacaggcttatttaggtaaccagtattcaaatcagaaagggctaaagacagagtgacttctggcattatgatgcaagaaaaacatagctacatgtgagtaaattgttaggcaaaaaaaagtaggatgggaacttatccttgaatctctgagacagacaaaggggtgtgtgtgtgtgtgtatgtacatatatgtatatgtatatataggtatgtaattataaatatatatatgtatcaatatatacataaatacatttatgtattcaggttatttgtttcctaacattcatttttgtgctaacattcattttgagaattttacattggggtgtatgtgtgtgtaaaagtatgtgttgagtgagcaagaaacttttgtgtatcatgggatatgtatctacgccatctgtagaatggcacagaatagtactgaaaaccaccaataccctaagagtggtgtgaggagggatgagtcagactgggagcagcatttcctaactgcccactcacaggcacattgccagaaggctttatttattctctaggttctagtcttcagattcataagaacagataatattaatttttataagaattagagtgattaactacaagactgtactctccagggactctgttttatttacccttgtttaccagcatctaatattctgcctggcataaagtcaagacctaataaatgtttgttgagggaatgagtaataaagttatataatgttttgtatttattagatcagttcctgttggcgaatcattgccctcctgggtcacggagaagctggcactcagattgtgttatgggatacttttagaaccaaggttctttgacccattagcaaacccacttcctggtatagtttttaggggtttatagagacataaattcagtaaacaagaagttattgagctctattatttgaacactatcagagggaactggggatggctcattgaacaagcaggccaaatccttgttctcatagagcttacattcttataagttaagcaacaaaataagtaaatgcgtaacatgaatgggtgataaaagctatgaaaaatcagggaaaggagaacgagtttgatggaggaatactatatagtgtcccctggggattgaattctccagggcctagaatcaatttaatgagaattttaagtgacattattaaattactttaaacacttcctttattaaattacattgataatttttcaaagatttcaactgcacccaaattataaagttcttgggaaactattttctactttatgtttagaattctgttcaatgagtggctggtgcgataaaaggatggcaacaatgatcaagaaaataaacttctagaggaaacaaggaacgaattataatagccaacatattttggatactttccctatgctggtcaaaactttatgttcattatcccagtttatcatcaaatgatttctgtgcaataggattattattatcttctttttatggcaaacaaggcacagtaagattctgtaagttgctcaacgtcacttagctagtaggtagaaaaatccaggattgaacccaggtggtctgatctagggccaaattatccccttgtaggattaagtaaactgcctccagaatccaagttttctaactgctaagatacactgcttctttaaaaagtataatgaagtaggagggcttaagtatttgagattattgattttttttaaacacaactgcaacccccaccatgaaaagatacagtattccacaaagacctttctattccttgaatactacattgaatttattccagcctttgtccagtcctctgtgcttgcaggtccctctgcctggaatgctccccactgggctcttcgcattgctgaccctttcccatcagtcaagcctcagctcaaatgcacctcttcagagatgccttccctgtctgcccaattcctggtagcccatcacccctcagtcactgtaatgatttaccctgtttttatgttcccagcccttatcactatgttaaaagttactgatgttccccatggctattttcccctactaatatgcaagtgccatgaggtgggtggcagtattcattgtaattggtccagagcctgatctctgcctgtacatcacagaggcttcaaaaacactgaagaaatgaatgctgtcccttgggtctgaagacccagatagatcccggggggctctacttctgtgcaggatcatgcatctgcccacattctgtgcagaattagagtacaagatgggaaaagagagatctgcaactggggcctgagaaatacttaccagtaagcacccaaattagccacaactgctcagaaacctaccacggagaccatctatgaaggctacttgcaggaggaccaatttgaaggcaacttctgcagttaagtatatgcaagttcatcatttcaattttatctgaatctgcttgttcatgtcttatttttagttcccaccttaatttggatctaatgcttgccatgattaatcaaccatttcctcccaccagaatgtaagatgagagcagagatccatctgtcctttacagtgctgtgtactcagtgtctagaagcatgctgaacacatagtaggtgctcaagtaatacttaataaagggaccaacaaatggcccaacactaaatttcctctgtagacaaaggcaagtggaagagcagaatgaaacatttattgagtcccttctaagccccaggcactgttttagatgttttacgtatcttatttcatttgttgaccctgttaagtggcaagctttgagagcctcacttataaaaagctaaaattcatggagtgaagatgcctttcttcttccatgccataaaatcaggtcttgctgggcaagtgggtttttaaatgaacattgggtatcactggaagcctcaaactctaatcagtttggtgaggtctatgctatgacctgataatgttgtttcaaataaataattattcaaataaataattttgtatgataccctagcatatctgaggatcaacagagaattgtaatgagagctttggccactgcctcacctataggatcacttccatttatcatctcagctctaatttatctgaatcaaagtttaaaacaatttccaaacagaagactagaaatactgcaaataaagtgaatttggaggaggctgttcccagcaggtacagaaagcttagcccaggtcagttagacagggacaaatgcaagctggcatagggtcatgcttgagattggactggagaaattgtaggagaaccagttcataataaatgactgtcccaaatcccccgccctgagctcaaaatactcaggcttggccctttacttagtgatgcttcaggggctcagtgtgagcaaacatgtaacatataccctggccctgaatgaccttgttaggtactccgtgtgaggaaggtagcacttacgagaacattcttgaaggtttaataacagcgaagtcttttcagctcattctgtgtgtaaatagggccaatttcaagaaaagatgagtttccttaaaaaaaaaaaaaaaactgtaaaataatagtgccattacacatacctccctcagccatttaaaaataccttgaggctggttctctcctgagggcttatcaagacacaagcctgccaagtgaaaggtagtcgattctttatagtgtatccttgaggtgttttcccctcttcacagagttactactcaggtcagcacattgttctaaggtattcccaggaatgtcagaaacagtcaaaccactttgcatgtaagtacagaggccaaaacaccactctggagtccacaggctggttcagtcctggtagtttacactaattctctgtgtggttttgggaagctcacccaagggttttgggttaaccgctctgcaagatggtgggcaggatctaaaaagggcttccatgtcacttccaactctggctgtctgactcgatgaggactgccaagggccagtgggtgccctcctctcctcacaggctgtagcagccatctagaaaatagctctgttcacaggcaagggagaaaattgacattgttcctttgcttctgagttcacctgtaagacccttccttcagcattctgcagctatgctctctccaactgagacttagagaattgggcattataaacagcaaatctaatccccttttctccaccatcattgttccctggtgctaagtccagagtttccataccctgaactagacatggaaggagggaggagactacgcaaagttcagtggtgccattttttttttaactttgtcatcctaggacaaagtttcttgaagtattacacttagagttttttccttagaaggcactggggtacttcctgaagacggtgattcttgggcttagctcaggatctactgattcagagctttaggggggctgtaagtccccagatcttcattttctttatttttattatttgctttttattcatttgtttaacccttttctaccatagcttcatggtgtctaacacctcagtgacaaagctttgttgatgacagtgtaatgcccaaccttgtttttactaacgctatttttagactctccctttcctttaatcacctagccttgcttccacctgaattgaccctcccttagctaagagagccagacagactccatcttggctctttcactggcagccccttcctcaaggatttaacttgtgcaagctgactcccagcacatccaagaatgcaattaactgataagatactgtggcgagctatatccgcagttcccaggaattcgtccgattgataacgcccaaatccccacgtctatcaccttgtaatagtcttaaagcccctgcacctggaactgtttactttcctgtaaccatttatccttttaactttttgcctactttacttctgtaaaattgttttaactagacccccccctcccctttctaaaccaaagtataaaagaaaatctagccccttcttcagggccgagagaactttgagcattagccgtctcttggctgccggctaaacaagcggactcaattcgtttccaagtgtggcgttttctataactcgctcaggtacaacaacagggtgggggattgctttgagatctcctaattaaaaatgccataggactacccagatttttggttactgagtacaaatcttcattttaagccaaatactgtagataattcttatttatggtagctaacatttggaaactactgtcctagaaaaaggtagacaaaaacttttagccttttgctgctactaaccatgatgattattcattcatccaacaaagatttatcattcactactatatgccaggtaaaataatgagcaaaaacacaaagtccctgttctcacggagccagcagtctagcaagagaaagaaatgataaacaaatacataatatgtcaagtagtaagaaaatctaggcagtgagatgaagggtgagtgatgggaggtgtgcttttcagacaaagtaggcaggaaggtttgtatgtaggatgattgtgcaaagacaaaagaagtaaggaaaagaaccatgtggctgagggaagagcattccagacggagggagccacaagtagaaaggccctggagaggggatgtacgtggtctgtttgaagaacagcaatgagtccagtgtggctggagtgaggtgagtgaagaggagttagaggagatcaggggctaataccttgtagcttgtttgcgttatttctaggctgcagaatactatacagtctggattgtggaacaatgatttgcagtgataatatattatacacctgttcttagtcttttgtccttatttatgctgtaactccctgttcctggctgaactcctgaagacaacctaaaataggtcttttgcttgagaattggggcaaagaataagaaagctttgggagggaggtgctatggactaaattgtgtccccctgcaaagtcatagtttgaagccccaacccccaatgtggctgcatttaataatagggccattaaggaggtaattatggttaaatgaggttattaggggtgggaccttaatctagcaggactggtggtgtttttgcaagaagagaaacgcagagaaaagaccacgtgaggactcagttgagaagacggtcgtcagcaagccaaggagagagaccctaggagaaaccagcctgctgggacctggatctgatactttcagcctccagaactgtgagaaaataaactactgttgtttaagccacccagactcgggcattttgatatggcagccttagcaaactaatacaggagggtaggaccaggaggtctttatttaattattcacctatttacttcctcagactttgctgcatgctcagtatgtgcaaggcactgtgctgcttctttgcatgcattattttatttaatctcacagcaatactgaagtaagctttatgaccatcaccttacagataaagaaacagaggcttacttaggggcagtcagttggccaggggacatgttggagcttttattcaaatgcaggactgtaacagtaaagcctgtgttttccctacatctcagaagcgggagaacagaggtgtggagccagcctacctgggtccaaatcccacctctcctgcttgctaactatgtgactttgggcaacttacttatctttctgggctttggtgtctgcatctgtaaaatggggacaataaatgctttcccttaactagactgtaattagcactaagtgagctaatacattaaaacattagaatagggctagccacctaaatgcttattaccaccctgaagtcacagggccctgcttgaaggaatttgaaatctttaggctgtacagagtatgaaaaccctcctcattctcatgttgagttttcatgtggaaagggcctcaggtttcttatttagtagttctaagaaatagatttcagtgcaatttaaagacttaggcatacttggcattgtccagaagtagaatggccaggtttgagagggagcaatctctctgttgctatctggtcaggaatgttgtgagggggttcagggcacctgtgaagggctggcatagatgaattcagaagtcttctcttgcatagaaattttataattctttctaatgggatgggaataggtgtgctacaagactggggcagctctgttttccttgcataatatattttctttctttcttttttgtttaaaaagtgaattgtgttgcctttagacagggcttgaactcacaaattcataacagccagtatcatgctttttttattttttaagcttctgcaggattttacatttggggttctgactcacatgcttaagcatcctgtcatctgggttgtaggacgatgaaaggattattaattaaggtagacatggcatcctaaccttggcttgtaagactgactgttggtcaactcccctgagagggctgccttgctgtttctataggaatatatgcagcagagcatatgcacaattctagatggaggctttgacacagcagctatatcttgctgaataaacatgatatgaaaacattcttagtggttctgtcctaagtctgcctttccttttcttccaaacatcatgcttttgcaagtggtctgcctggaagagcaaattcactcctatgcctggaatgtttactgctattccaaacagaacagaatgtgtttctgccactgcttattgagaataaaaaattctttgtctggatgtcaagacaataaacaggtgtccatgtttataaagcagttctattcagatacagtcacagatagacattcaggaatttgagggcatgcctagagccatttacaactctacataatgtaacagtaaggactgtttctagtgaccacttatctctgttttgtgtgtcccaccccttaaaatacattcatgtactgcataatgacattttggtcaataatcaaccacatatacgatggtgattccataagattttcaaattgtatttttactgaatcttttctatgtttagatatgtttaagtctggaaatacttaccattgtgttacaattgcccacagaattcaggactgtaacatgctgtacaggtttgtagcctaggagcaaaaggctataccatatagcctgggtatgtagtaggctctatgatctaggtttgtgtaagcacagactgtgtttccccagtgatgaaagtgcctaacatgcatttctcagaacatatttccatcattaagcgatgcatgactgagtgctaatctgctcttagctcttctaatgtattctcctcacagcagtcccaaaaatcttttcatgccgcaaatatgatatatatatatttttaaatgtacacccctcgataatttacagttgctctctgggttaagatgaaactttgtaatttatgttacagagacgtacagggtcacatcacttgatagcttcatctccactgtaccccatcttggtctctgtgctccagctacattggctttccctcagaatcttgctttcaccatgaccctctggggactgggccttgcaaatgtactctcctttgcctaaaatatcctctttctcatgcttcctagttaagtttgactcatccttcggatctcagctcaagtaacacttctttagggaagctctcctgatcttcgtgtgcataataaagcctcgttagatcttgtcctaatgtcatatcctctccactgctgcatttgtcacagtttacattaatttcttagattaatttatttgccttccataagagcaggaaccatatccatttttactacctgtgaacccatcacccagctgatatctgacacataatagagatgttctttatgtgtgtgtttgtattttttgaataaatgaataaataaatgaataattgctcttacaaggcagttgacagaatactgaatttgctcccaaaatttcccaaaaagtgacattctcgtgtatcaacaataagatccagagcaggctttcatacatatcttcgaagtcatacatttctttgcctcctgtttgctttttctactaactgtgcttttgcagacacttgtgaagataaaggccttggccctctcagcccatcttttctctcagctcaatctgccagtgaggaaacaatgactcagaaaactaatgagccagtccctctaatgatggcaatgatttcactgctggtgatttttctattagttttataaaattgagtgaaaatgaaggaattgccttggggcacaagaaccaaagacaaaaaatagatccagaaacacaaatcaaaagagcactgatcagtgtatgttacaggcaaacagtagtcaaggtgatgtaggttgaaagagtcaaagaatgaaaacaggagccggcattttcaactaaatatttcatatcactaatcctccctcactatttttacctgtaaaatgtggataataccatgcagacttaggataatcatcctcctgtgataacacagggagaatgcctggtgctcagttggtttttattaaacttgagtctgcgtcctccctctgctaagttccttatggattatactagaaactcctgcaaatgggttaccactcccagcttctgatttaatatgggaagatttaagatggggacatacttcccaaagcacatatcacttaatctgacaccaacaccaccaagtttcattatattgtcatttgactctgaggcatagcaggattagccaatttctcaagggacatcacatgtgaagaggactggaatctagatgaccctgaactgcaggcccagggttcttcctatcaccatgttgtatcaaaacacacaagcatagagagggatagggagagatttgttaaaggacacaaaattacagctggataggagggataagttccagtgttctataccactgtatgatgactatagttaacaataatgtcttagttacaaatatctgggaggagaatattaaacatttctaacacaaagagaggataagtgtttgagatgatgaatatgctaattaccctaatctggtcactgttcatggtaggtatcaaaacttcactacataccccatgaatatgtataattatttgtcaattttaaaaaaatttcttaaactccaccccccaaaatgtacacaggccaagaattgatttctgaggcctctactaatataaagagtattaataatagctaatttttattaagctcttaatttgcactgggtaatacactatatacttggtatgaatgatcacatttactcaccaaagcaattgtctgatatatgcaaaatttccccccctttttatagatgataaaattaaaggccaggaaataaaatgactttctgtgtattaggtagatgttttagccaatacctgaatataaactcttaaagcaaattcacagctaccttgaagcaaataagtgctcaacatagtttcactgaacacttaggtggatgacagtgaccttgattcttcccatggcagccacttttctgccagatatcagaagccttcaccaaaagtaacctcttttcagctgcagatctactgtcattttagagagattttctcccagagcccttcccttgtagtatatttctctatcctggccattgttgagttcttacctctgactgtacataagattcacttggggaagctagaaactgagattcctggggcccagttccaggggatttaattcaatagggctgtggtagagatagccctgtgtatttgccaaggtgattctcacgcatagccagggttaaaacctactgttagagttgtgtgcgtatgcatttttccctcctgctagactgtataccttaaagaatagatgagtgttttttatcttttaattacccatgtgctaagaacaatgcctgaaatgttgtaggcagtcttgtagggcagcaaagagcctggactctggagtcaggcagtatgggtgcataccctgatctatcacattttggctgggtggttttcaataggttactcagcctttctgtgtcttatctgctcacctgtaaaaaatgaaaatggggaaaatgaatagtacttatctcataatatttttgagagatagtaactgtgaagtacttagcacagggcctggtaagtaatgagcctacaataaatgctagctttgtaggtaagcaaaacatttaatggactatccttagttattgctgtggtgaatgcagtgggaaatatgaaagaagaatatgatgccccattcattgaatattcacaggcattatgctaggtgttttacaacactttttttcactctcataacaatactttgatatattttcattagagaaggaaatacaccagttgagtaatggaaggtcatccagcaggtaattacgagtgctgagattggaactcaggtttgtctagttttgaaacccatttcccctactttattactaagacttaatataaacattcactcatacattcgtgctttcaatccacaaatatttattatatgcttaatatgtgggagaaactgttctgcctactggagatatagaaatgtataaaacagagaaagcctttgctttcatgtcacttatattctatagtgggaaaggacaggcaaaaaacaagtaaatggatgtataacaggtcaggtaaaaataagggctgtgaaggaaaaataaatagggtaaaactagctgggggtgagaggagaggcagagagagagagaaatcgatcttgagagaaagggaatgagcatgtgtgtgtgtgtgtgtgtgtgtgagatattttacataggaaggccaggaaaggattctctggtgaagaaacatttgaatgatggatgtgataagacgcaattggattcctgatatttttaggaggtgaagcccaaaggatgtaccatagaattgtaagaatgatatgagagaaagaaggaaattgaggatggctccaatgtttttgtcgagtctctaggagaacagagttccctcttatttcctaggctggagaagaatactgcacaaacagggctttttttttaggagggaaatcaacaggtctgttttgagatctctactatgcatctgattggaaaggttggctaggaagttggatgtacaagtctgcattttaggtgagagattggagttggatatagaaattaaatcaatgatatataagcccataggagtggatgagatcacttacgagcaagtatatgttaaggagaagactgattcctgggcttcaatatttacagtttaggaagatgataaggaagcagcagggagtctgagactgcaagggagagggaaacagagagaaagagtgggttttgaggccaagacaagaaatcccttcaggaaggatggagcaatcatctgtcagtgttgctgagggctgcagtgggaagaggcctgcaaaggcatgactggactctgcaatgtggtggtcattgttgactctcacaagagcaattttggtggcatgatagaaagtgcaaatcagaggagaggtggtgacagtgagtgtggatgacactttcaaggcatttttctgaaaagaggagcaggtgatggggcagcgggtgaaggaagatacaggctcatgagatcagtgtttaaaatgagatgatttatagcatgtgtgtggactgcaaaacgtgatcctgtagagagaaaaaccttggtgctgacaaagtaggaacaagtgcaggagtgatgtgcttgagtaagagagaggggagatgacccagcttaaagtggaggcttggccttagatgaaagcagggataattcatgcattgtacataaaattcaaaaaatatgtttcagacataaagcaatatcaaacaatgtaaggtttttgtcttccttaattctcacaataactccttgagttgagcattactatttccatgttacagacaaatgccgtgtgcacttggaaaagactttaaatgtaggtgtgcatttataagatgagaatgatggatgagaaaatgagtagtcagggaaagctgtgggtggaggtgcatttgacgtgggctgtgaagagtgggttggttctaaatatgtgaaagggactgagaagagaatttcaaacacatgaaaaataagaatccataaatatgaaaaaggtacaaaatatagtagtaatgaacccattcttagcatgtaccctggaactagactgcatgggttctaatcctagcccttgcatttaacagctgtgtgaacttagactacttaacttgtctgtgactcggttttctcatggataaaatgaggataacagtgttgaccttatagaattgttagggataaacacacacacacacacacgcatccatacctacattgatatacacacggtgaaattgtgcctagcaaatagtatgcatcctatgttttacttattcttgtattattattatttataatataacaaagaattagaaaaatatgatgttatttttccctctgtgtgtgtgtgtgtagatttccagcaaacatgcttccgggtgtcactggaagatacttgctttaagatatgtcctcctcttgaaggagcattgttgatagaatatgggtcagtttgtttattcactctccccaccctcccattgagtccttcatttaagaaggatttcttgagcatctactcagagtcaagctctgcactaaaccgggatgccaagactgaagatgagtagggcagaattcctgtgcccaagtagcttctggccactcaggagacagacatgtaaatagactgtttcaatgtaatccaaaggctgttctcatactcagaaggaaatgtgcagtgtgatataaagattaagagtaccaatttcggattcagagagtttggacttgagtcttggctctaccacttcactagctgtggttctgaataggttgcgtctgagtcagtttcctcatctataacatggagacaatggcgtttaataagactgttgtgaggagtgaatgagatgggacaggcacagcccttagcacacagccagtggtccacagggttcatggtgctgaagctgcttcttatttcttctttccagtctccttgtggtttgtgtgactcataataacaacttcatttttggagttgttgaagacatcttcctagaaagacttgactcaagctgagttttcaagcatgggtagagaatagcagcatggaaatgagataaagacaatttcgggaaaggaagaagcacgtggcaagtcacagtacccttgtccctttaggaaaagaaagcgtccctactgatttcttagataacaataacaggccctccagtgcctggtgccaaattaggtccaccagaaagtaccaggcaaggttccttatacttcactgactctctcatttctgttttgcttcctttttttttttttttttttttttttttgagatggagtctcattctatcgcccaggctggagtgcagtagtgtgatctcggctcactgcaacctctgcctcccgggttcaagcaattctcctgcctcagcctcccaagtagctgggactacaggggcccaccaccacacccagcttgaatggcttctttacagctatgattggaattttgtttctccaattctgataccacttttgtagatgaatcctcccctaccaaggggaaggagttatgtgcttccttaatgaggtccacagagaaggaaagacagtccaatcctctttgcaaaaccctgattatggatctgcactatttggttgccctggcttctgtttgtatcttcttatttcaagttaaagaacattataataaaactagttccttaaagtatggttacagaaagctccccaagccacaatgatgaaaacaattttcatgcatgtaggagtgaatgcttttcagaatatttttcacatatggttttggaaatttatccatacaacagccttggtatttgtcatctttcattcaacaaaaatttactaagcacctataatgtgcctggtattgttctggttctggaggtacaacagttacatgtgggtcctgcttccagtacagcagggagacagagactaacaaaacagtcacattggtttgctcataatgacaaattagggtaagtgctttgaagtaagaaacccagttctttaaaagctgtgatcagctgagcatcaggatggcttctgagcttgagctgagagttgaaggttggaattaacaaggcaatggggcagaaggaaaagaaaagcagcccaaaagtctatggtggaagggagaattttgaggaaccaaagaaggcctgtgtgtctggggaccaggcaagatggagtatgtttgacctcaggcaggagagtcgggcggggctcagaatatgcaggccccgcttgccatggaaaccatagagaggttttaaatgtgagtgtttgtgttttagagtgtggggtggtaagataatcatatttttaaaaattattctgactgctacatggagaaccaaatctcctctaatgtatgaaaaagcaggcgtgagggctcagagtgagggaggggaagaaaaaggaaccaatagttgtgaaccacatattgttgatttaccctatatacaaatgtgttactatatataatgtgcttagataatgcctttgatacactaaatacaagtgaacgctggttattactattattattatcaccctgctatgtcattttgaatgtatttttttgcaactatcctgtggagtattgttacctatatttttaaatgaggaaactaagcctcagagaggttaaataagttctcaatatctctcatttgacatgtaacagagctaagattcaaaacctatggccttcctgcattaaaaaaaaaaaacacacgcgcacacaaaaaaagcaaacaaaacaaaacaaacaaacaaaaacaatgacaaggagaagttgggaagacaagccaagttttctaattaggatggttctatcccctaagaagcccagaaattgttgaagctcttaaattagttctagagtttctcttaaggagattgtttgggctatttgtatttatttgactttcacagagatattcacacactattcattctgcactttttcaaattaataaaatgtgaagttcacagccatattttttttctagcacagactacagggtgacacgattgccaacaatataaacacacacacacacacacacacacacaacctcagatgtatactgatcacttttttccccagacaaactttaagtaagtgtaaccagtttctggtggcaaagtgatgtgtttgaggaaaccactcattgcttaaggtaatgtgaaaaataaagcaaacttcaatatctaagaaaacacgtggggcatgggactcaaaaacagacggcacctatcatgtgtggagcattacaaagaactttattcagtggtaacagttcatctcaacatccttgttatagataaaactgggcatagagcaatcaagtgacctggcactgctttcttggtaccttggtacataacccatgtcttttccactatgtcccagagcctcctccacgatgttaatgtttggcaaatgccattttccttacccattgtctttattaggtttacaacaaatttaaatacatgcctttccaccctcccaccctgaaatctggtgatagtgggtgaagcagaaattgttttgacataagcaaaatgaggtttccattttaatgaaataaatcagtgaaatttaattttcacaaacaactttaaaagttcttgttgtagcaggtttttttctatatgatatagaatgtttcgtttaattaatacacaagacagcaactgagtagaccaagtgtttaaattttcaaagtctaagcaggcaggagaggacaggaggaccaatcagaaatacaaaagtcatctaggcagtttctctatggctttagatctttagtatttgaaaagttctcctggagattttagtccatgccattttttcattcctctcatcccctcaatatggataaggacttactaagtttttctccacgaggaagaaaagatttctcagtggaccatttccttttgccaccaataaatttttaaagggaaatgtccaactgtaaaaaaaaagtccatgagatatcaatgtctatgaaaaataccaccctcagtctcaattcaagggtgatcccaaatgtctactcccttccctgaaggtacggataaaaaattaccttatgatataatacaagcttccttcattataaacacacagcccccagtctcaggattctacctggaggatgaaaacaagagtgggttttcagaacaggctggtcgccagctcagttccaagagagtgtggctagacatgagttggagtcacaacacctcagcatcctcaacccttttcaatcaaatgccactagtaggacaatccttaagcctgaaaaatgtccagccagttgcttttcttgaaattgttctttttctaggatatgtcagatctaaaacacaggcacatcacatatagaaggtatacaaccagcttctgactatagaaatgtggaattctgcagtgcttagttgaaagggaattgccagaatgtttacaaggcacacatacacgtatgcatagcatgctaggttagaaggcagcagagaaggtccccagaaaaaaacaggaaatggggaaggtgtagaaggctcagcctaccctctctttaaagcattaacttaggacccccagaaaccacatttcatgtaagtgctgaaagtcagctgtgttcttactgctctgtaacccaagtacagactccaagtgaaccaatccaacaatcaacactccacagtgatgtactaagctaattctactttgctaattgctttcttgggcatgcaccaagttatcaaacagacagtgacaaaacagagagctcggacagatgtatgtggcagcacctactgatttttgttttcttgacactggttccaatgacttgtttgcatgttaaatgaaacaaggaaaattggcaaaatatttctgagttattttctaattagctgtgtcagctttgagattacctctgcaacattattctgttcttcagaaaacacttccctttccttgtacaagacagactgatttcagaagcagatctaagtctgttggatacaagcttttgccaggaatgacagtcacctagtagctacagaaagcagcatcagcagaacccgtgggaagtcagacaccagcccacttttcccacccacccagacactctccctctctggtctgtaccttctgtgtggcagctggaagaaaggatggtgttcggaggtctgaagatgtaaggcaggtaacgagagaagcatttcatcttccaaataaaaaataaaaatctaaataaaaaaacagtctcctgaatccataaggattctctcggccttttaagctggctacatcaccaatatgtttatgtaggttctttcccagatttgcaaagctggggtgcccgaggaataactggagatgggtcccattttgccatcagcgccaggaagcactgccttacatttctgcatgcagctcaaactcagaagcccccaagcaagccgggatatagcctcttcattggctgaagctcctctgaacaggatttgctgagtaagtcagtcctgcctgtaaacacacgctgaaatgctctgcctgaaacctctaccttttcccgtgtggtgagtttctcttttcgcaagagaaatccagcaggatatgggagtagtgaggataagtgaccatctcttatttagctgaaagatcagatgaaacaaagacagcatagtgttctgccctggagagagatggctgttaaaaggagccacccgtaatgccatggatctcaggaatattaaagtacagtgcaatgaaatgggtctctgtccttgcttaatctagatttagttctattttttaaaatactaaagcccaaacaataggaccatttatcatttaggtgaagccaaaagctggattgagtagtcggtgacagagggctaacacagatagattctgtgctccactactgcctctttcttcccctgccagccttaacagtgaagcaataacttagttctgagttattcactctccaaatagaaagccacaacgcaagaatagagactaaacccaaaggaactgacccttcatcaatctgtgaaccctgatggcattaaaaaacatggaaaaactaagttgatacaaggattacacaactttaccaaaactctcactgagatttcaaatgagagagagagagaaaaagagagacagaggcagagacagagacagatagactgatattatttaaggacatgaccaaccacaagatataagtaatttgggatggggaattggtttggttttggtccatgaaataataatgactttggaaaccttatcactggaaggcaagaaagcacagggcttcagtttggggtttataagttctgtcaaagacactattgtatataatgaagagaaagagtcaaatgtccttcatgctgcattcagaggcacaaggaaatgatttaaatgtccataaaagaaaaccaacatttccctgagaaagatttttaaaaataaaataaaagtgtgccttgaaaatctgatggaataatttttaagcctttatgggctctcttccttacaaaaatatttaactcagcattggagaaatgtgctggtctccccaggagggaaaaaacaaagtcattagagtgccaggacagaccatggtcatgtcaatccattcccccaccagtatgccacttctctggcccttggactactatggcatggtgacaaactgctggcagtgtcgggccatttagttctgcaataatcatattacctccttagacccagggacttggcaaggtagggccatcctaagtaaggtgctgtttaaacagtgcctaagtggtctggtttgtttttgtgggtaatttcaaactagtgacagaagactatatgcaggagtgtctccctaagagatacttcatatctaacctctggccagcagtgagggagtagaaggagtgtgggctttgggttcaacctgaccctgacagtttgtatcccagtgcattcacttaatggccaggtagaaatgaacaaattttaacactgcaaacctcagtttctccttctataaaatgggaagaataacaaggttttcctcatgtattcttgaaagaagtgagacaataggcatagagatctggcacattgcaggcacgtgataaactaccaatgttgctgctgttagccttctctgagcttctatgccatacaccaacctaagagtagctgaagaggagatgtgcttaagaggagtgaggctgcagttagacagccagggtttaatcctgcctttgacattgacttgctgtgtgatcttgggcaacttacttaacatattttagcctcattacaggcctaacaaggataataatagagtcttaaacgacactgttgaggatatgataggatagttcatataaagggcttagctcagtgtctagcacattgtaagtgcttcctaattttaattactattgtctataacagtagtatcagcccttaattacagcatattactttatttacttacctatcttatctaaataatgaaagtacaaactcttgagggggagatcaacgtctaattcatctttatatccctactgcctcacctagtgcctgcacaaagtagatagtaaatattaggtgagtaagtgaatcgatgaatggataaatcaatatatatgggtaaagcttctggaagatattttatactttttatgtggacgtgaaggtcctttacagcacaaatgaagtggatttgagcctatcataaagctggaatatatcattcaaacaaaggcattatggaatttatagatagacatgcttcaactttaattgtgtatttcagtcttaaataaatggtaggcacttagcgaatactttctaagtcaatagtaggcactcagtaattacttcctgagtgaaaaaaatactcactgaggatgctggccatagctatcctcaaagaactcaataaatacaaaacagaacaaacaaaatgtgtcttctccattagaagcaaaataaacaatgggactagaactcaagtcccaaataggcctctccaaaccagccaatatctcttgacctcaattgaaaatatgttttcaattgaaatctaaaatgattgatttagtgtaaggcctaggcacctatctacccacatgcagaatgggcaagaggcagagagaacaaatttgaaatttctttggacagtgaatctgctgcaggtagtttgcactgcaccatttgaactgtttcagtgtgcttcttgtctctttgattctctcagcaatcccattttatagaagagaaaacaggctgagggaatataataatttatccacaggagatctcatatttccacactggaatcacctgatgagctaatgaagaatgcagatttcacagtcctcaagccaatggatccagattccctggggataagaagtgattcttcctttaaagtttgagaacctctggagtaagatgtttaatttcatgctctggcttgacaagtttgggtaacggaaagttttccaaatacgcttgtcctaaatcatgtatccaacaatttattgccaccctgacgatatatcaggctgagtgatggcaacataggatatgagataccacccctgctctaaagaagtgcatattccagaaaaaagaaagactaatgaactgttttaataaagccacatatgggctatgacagcaggaagaggatacgaaaagattctttgggattataaagccccaaaaagtcaatgttacagatccatgcttttgcattaggcattatttataaaaaatgaaaagaaacacctcctgttaaaaggcaattatcttactgggaggcatagcaaatgaagagttagcagtcattaactctgtaagtggcattagtctcggatatacctagtgtcatcacagataagagcagggtcaccaggagaggaatggtgtcattataaggagaagggaggatctaaagcaatggcagaggtttctggagggagagctcaagagcagaaagaggtctctgaaagggaaaccagcagcctcagagaaaggaaagataaaggtgacccatttaggtgccatgtgagaaggccccttgagtgtggcagagcagagtccagtgacaagaaatttctccagatgatttccgcatgtcaggttctgacagtggcaaacaagcaattaattgggagtttcttgagtgctgtgctctgaactaggctgctctaagcttttctttagactgacctcctgggagagcagaagcaaccatttctgccctgccaagtccagctagagcccctgccttggggccaatagacttggagtctcctaactgcctgttttcactggttccagtcctgttgcctacctcactgaagcccacgtcttacagaaaagttaccctgataattctctctttgtatgtttttacaacctcttttgggggaagtttcatcctcacagtttttcattttgctatgaaagaaactaaatcccaggaaaaaaaaattagcttatttaatattaatcaggatgagcctgcccaggtttttacttttaagtcaaagcaaagcaaattcctactcattcttctaatcttaaataaagtgccatatctccagggagaggtttcttgatgcctcagactggatcaaatccccctcttacagactcccacataccatgttcctcttttaaaatactcgttcattattgagcatatttattgaatacttacttaggccaggcactgtgcatggtgccaaggaatcaatagtaaacatgacagataaaatacctactctcagccaggtgtggtggctcacccgtctaatcctagcattctgggaggctgcagtgggcagatcacttgaactcaggagtttgagaccagcctgggcaatagggtgaatacccacctctaaaaaatatacagaaaattatccaggtgtggtggtacccacccatagtccctgccacttggggggctgaagcaggaggatcacttgagcctgggaggttgaggctgccgtgatccacgttcacaccacagcactccagccttggtgacaaagtaagtgagagtctgtcttaaaaaaaagaaacaacaaaaaaacaaaacaaaacaaaaaaatgaaaacctactcctctcttcttcgggtataataaccattcccaacatatacagctcctgagctgctgtgaggatcaaatgaggtaatccaataaagtgcttagaattctttgataattgctgtttagtatctgacaccctggccagaccctaagttgcaagaaggtaaaaattggactttttttatgctgaattctgagatcaaagtttgctgcctgaagcataagaggagtttgataagtacatgctggattgaattgagctgaattgagttgaactgaataaagaaaattctgacaatttccatcacacttcctacacccactagccagtgtgtgaaattcacaacttgttaaattctgacctgaaagaaagaggatcctctttgtggttagttcatttacccattcattcatacaatataatcttttttagcagctattaaatgccaggcactcttctaggtgttgaggatacagcagtaaataatatattaaggtttagctctttgagtttatattctcaaagaaagaggtaggtaataaacaaacattacatgaacaaggttattttaggtggtgaaaagtagaatgaaggaaataaagtgggacatggattagagagtgactgctttgcttgatggtcagggaaggcttcttggaggaggtgacatttgagctgaaaatgaaagacaaattaatggccaaggaatgggtttggccctctcatttaccccactgtagcctgcaatttatcctcaccgagatttcctcttctaatttaactaactacctacagattttaaaaataatttatttaacatttgtttcactgctttaatataagctctacagggacacagggtatgttgtctttctcgctcattgcatcccttagacctagcagagcagtcaggagtgacttgattcatatttctgattggcagtctggactgatgattcagccagctctcttggcatgtgactaaagcaagagagaggtgggaagctacagataagactgaagaggactttgaagatgggggtcggctccatttagagcagctgctaccatgcagcaggggaagaaaaaaagcccagtgcctcacaacagaagattttggctctcattaaaaagaacgaaagaaggaaaagcacaataaagccaagcatgttttgcaccaaattttatatagtaactctcatagtacctagaaagagtagacaaataaaatctcttaatttataaagagaagtcagagcaggtaggcaacaggatttttgtttgtttgtttgtttgttttttggttctgagccatggaaacatgatttgattttaatagatgatgataatacagtcatgtgccataatgacatttcagtcaactgtggactgcaaatatgaaggtgttcccgtaagattataataccgtatttttcctggaccttttctatgtttagatatgtttggatacacaaatgcttatcattgtgttacaactgcccagagtactcaggaccatgacattcaggactgtacagccttgtagcctaggagcaataggctgtaccatctaggtttgtgtaagtgcactctaggatgtttgcacaatgacaaaattgcctaatattactcttctcagaatgtttccccatcatcaagtgatgcatgacggtagtagtaataagagcaaccaccaaatctatattcatctgagttcttcattcatctgaggattcattcaactgagtaggttccagttactctgctaagtgctacacctagaatatctcattgaatcctcctgaaaaacctaaaatacatatcattattttatctgtttatagatgaggaagtttacacagagacattaaataaagtcaactgcaagcaagtggaggaggtaacattccagtacaggctttccgcttattccttccctcaggctgtcccatgccaccgtgctctctgagttgcctggtctgaacattatctcccctactgtctagtacaggacacggcaccaagactgacactaagattttgtatctgcttatttggaacttgtgggtatttgattagggctgggcaaatttacttctgacctatttgaaagaaagagtttgccaatgactaccgtaatcatgtagaagaaatctagcaaaatccacacacctacctatcaatgcctccagagatccaatatgtgttgaaagtttgctattcctaggacatggtgccaaggactgtgagattagatgcatgtatgggcatagaatgtaaaagggagggagggagggagggagggagggagggagggagggaggggggaagaagggaagggggaagagaggaaggagaaaaggaaggaagagaagggaagggaagagaagagaagggaaaggaagggaagggaagggaagggagatagaaaagaaagactaaattaagtaataaatatataaatattacagaagggccaaaagagatgcatagtagaaaactctcacacctaaatggaacattgggacagaatccaagaaaacttcctggaggtggtagcatctgagataggctatgaaggagaagaagaatttgcacgtgtgaagatataagtgggaagagccttctggtaagaggttaacagtaacagttttactaaaacagctaaaattcactctttctcctatttattataagttaatggaattataaaacatattttaaatatataaagcagatttcagttgctgtatttgggctatgcacttattagctctcatttggaaatagtggactttaatatttcttgtccaagctggataaaaaatgttccaattattcagtgtatataatgcctcaaagccttcataaaaagaaagcattccaaagtaaatccagaatgtgcttcctgttctgcagaaaaaaactgtcctatctgcctccttcccagacatctctgcattttaattaaatcatgaatattatgaagaggaaccaatattctgatatgaaacaatattttaaaaggattgctgtgactctgatatctattttggccttagagccttccccaggattaggcagcatatttcttcttggacagatgagaatgttagaggatttgaaaggaacgcagcacatgaatccaggtggcaagatcttagttttctgacctgtaggctaacacttagagatacagaataggcatttgagtaagtggttttaacgtcttttcaagaaaacacttttaactcagttttcctcttgattctgagaggccataatagtaaatcttttaggaggtagcagaggagaaaatgttgtacctgttgttcttacagtaaggggccagatttgctcattcagcgaggaccttcccctgggcgtgtcacactgctcacagcagcctgcatgagagttctgtttggcctgcagagtattgtattttctaattcaaacttcatgcctttaaacagggtatgtactcatcagttcctctacatctggattacatctggagagatttacacaattaccttcccctttgctgtttcagtctatgagctttgctttatggcagggtttctcaacctcagccctattgatattttggacaaggtaattgttgtgtgcttgtgtgggggagatgggtctgtttgaggatgtttagtagtgtcactgtgctctacccaatagaggccagtagcacacttcccatcccccagtcaggacaatccaaaatgttttctgacatcagtgaatatccccgggggtgcaaaattaccctcccacaccctatattgagaatcactgctttacagcaatacggcctcagagacctgggctgtgataatggacacattaattgcatattaggcagcataacgagggtaaataatattttgattagaataaagaagaactaagatctgtgtgtaattctttataccttagtttcctcacctcattctcccacaggtctagtatacaaatcaaaacaatctagcatatgaaacaatatttgtaaatgtgttttgaaaacttaactatataaggttgttgccatttggtcttacctagctctttaggcatccactgataccagcacattgaaaaatagcagctctattccaggataaatcatttaaactataaggcattccataaaccaagtacactgacaaggagttgaacttagcagtaagaaataccagtttgggcagtagaatgaattttcttggagtatcctgtcttcttggtttttcttgctgattggaaagctagtattctttcatttacttaatcatgcatttattcaatatgtatttgctaagcattagcatacaccaggcatggtgctgggcactaggaatgcttacacaacttgtagttgtatatcagcaagtagttgtagcagacatgttagatataatcctgtcttcatgcagagtatggactagtagagaaaacatacaaggagcaagaaaattataatgcatttggtaagtgtatgatggagaacattcaggaccttctacaagggccacaaagctcagagttcagggttaagaaaggcttacttgggaaaatgaaaccaacactgagatttgaatgatgaatgggggttgccagaaaaagagagagtgaaaatatttctggcaaaggagacagtatgtgtgtagtgctggaggtgaggggatatggcattagaggacacatggagcagagagtacgtgaggagaatggtgagtgaggctgggggtatcctaagaaaatgaaacctaatgaagctttttgggaggcgagtgacatatgtacacactggagatgctactctggatacagtgtgaagaatagactggaggtggtcaagacaataaggagagggggagtaagccaaagaggctgctccaatatccagagaagagaagatggtgtccaaactaagatagtggcaatggggttggagcgaggttgagggattggagatactgacctatttagagaaaagagggaaaatgacatatgacttagtgatagagtgcatgagtatgagtgttgaaggaagttaggaaggcagagccaagaatgattcttgggtgtttgggagggctttcggaggaagaaactggagtttactacagccattgctactattgacaaaaatgaaagagtttatggggtgcctgctgggtgcgggtccgtgagctaaatgccaacaagcattatctcctttaaatcttgtaacatccctgtgagataggatgtattattctcaggacccccaggctcagaataacctgatcaaggacccacacctggtaataacaggttcctgattcgggctggaatcaaacccaacagactgactcccgagtcaggttgttaagcctgctctcttaactaccacatagaaccattattgattcccttgaatgtttactttctgggtttaaatcataggttttctggtgactaatgatagttttggaggaaccattcaatcatttaaactcttcaaatctcaatttcctctgccaaaatctaggtattggaatatctccttcagagggcccatggagtgagtaagttagtgctaacattaataatgacagagcaagcatttattgaatgctgactgtattccatgctgcattgtaaattctttacatgtattagctaatttaatcctcacaagagccctggatgtagcttcaattattatccctatgttacagatgaagaaactgaggcacagatacattaaatgccatactcatatagcagatttgctggaatgcaaacctgggtgagactttctggaacctgtgctcttcactatggtgtcatgcagcctctgctaagaagtgagaccttagaaagtgtttgacacaccaagagcctagcacctggaatgttggatgtgctcagcgctgaccataatttttcttcaattttaagtttatcaacttttcaataagtgtcaggcaccgtattagacaaataagaaagatatggcccctgtcttaatgcctttcttggactgctagaaagccatttctaatcatgatttttttttgtatcatcaagcctcccttgcccatgagaagttgggaaatgtcagcagtttctgaggaaggctttagagaagaccagggaagccaggcttcatcaagagccaaatacatggcctgaaccactctgctgatgtgattagcctgggtgttggccaaaagaccacaccaaggcccttggtgggctactgtctttcctcctttaatatttgtgcatttaatcaccacctaggttaaagaaaacagctgattgataaaatagaggtagaaaatgctaacatctgctagacggtcaggaggtttttatttttaattgagaaaaagttgtctacatttacggtgtacaacatggtgtttaaaaatatgtacacattttgaatggctaagttaattaacatacacattatcttacatacttattatttacttataagaacactaaaaatctactcagcaattttccagtatacaataccttgttattgactacagttaccatgttgtacagtacatctcttgaatttattcctcctatctgaaattttgtatcatttgtatcctcaacctcctcttaccccaacccctagtaattatcagtctactctctggttctatgtgcttgacttttttagattccacagatgtgagatcatctggtatttgcctttctgtgcctgtcttgcttcacttaacatcatgtcctctagattcatcagtgttgtcacaaatgacaggctttctttctttttccaggccaagtaatattccctttgtttttccaccagaagggatatcagagagagactctaatcccttaatgccacaggggaacctgagtggtggaaacattaagtggtaaagtggaagaggaaacttccacataacttcattctgtctgttttcctttctgtaccccactttctctgtctataagtgggcagatcttctaaaaaagatctcccagtttccttcaaaggaaattccctcaaattccaatatgctatgaatctaagtgtttaatcgcacagttacctatttgttcattaacatcatgtgggtaaataatacttggattaggtgtaagaagtcctaattaattgttcatgtttgttgatgatgtagagacaactagctgtctgtaattttcttccacttgctctgacatcgtgtctgtagaactggagcctagaaccctctacaggtgtttattgctcttcccaaagatgaaatataatctttgtgtgcacccaggtgtaaataatctttttagtaaacacatggatctgatggccattttaagctcatttagagagagtttactaaacttagcaaatattaaatattaaaaaaataatgatccgggtggtagaatgatgagtcatttttattttcttgttatctgttttcattagtatcacagctaacatttacttagcattcactctgtgtcaagcgccgtgctttgtgtcgattattttatttcatcctcctgacaagcctatgaaggagaaactactactttcccattttacagaggagtaaagtgaagctaaatcaaatcaaaataaagttatgcagtctattcaaagtgacacagaaagtcgtttcattgggattcaaacccaggccatctgttcataggtcattctcttaactatggtaaagtctttctaatgccctcaagtttctgttagaaacacaaagagtattactttatgtgaaaaaaaatgtaagtttttaaacagtaatatctgagttgtttttaaaataaagtttgttatttattttttctgttttagtttcatgaatttggtttaaactgctattaaatagcaatatttttaaaagacatctttggcatgctgtaagatactttttagaaaaatattctctcaggtacacctgatgagaagctgcgctttacatgaatcattgactgaagaaagaaaaggaatatacattctgaaccatgtgtgaataataagctgtaaaaaattgccatcagttttccttggaaaataggcacttaatatcaatatttggaaatcattactgcttgaatatcattggtatagacctgccaacataaaattacctggtatatttgattaatggtgtagagtgagaagcacacatggacaaacgactgtgccataattttgggaaaggttgctttaaatcgtaatcagaaaaatcactcatgaaacaatagatgataatgacccttaagaaacagctaatacaattatggaaatatcacccacagtaaaaaataaaatgaaaaaacaacagatcttatgttcctttaactataagctgaaaggacatggtcaggtctaaaggctgccaaatttaagtgatctcaacaatgccttgaaaattgcttttgggcgctgaacaaaactgtaacatttacaaattccagtggtgatcctgggcaaagatagcacagtgaacttcagaccacagacagcattttactatgagaggtgaggtatgaagagctctacgtcagaagcgaaaacaaaacaaaaagagttgagtttagaggtgaggtttaattttcacaatacaagtataaggaagattacgttactgaaaattctccactgaggtgaaatgccctaggatttaggtcctaaaacatcagagtacttccatccttagactcctgaaagcttcccattgtacccagaataaaacacaattatttaccatggcttgcaagctcacacctgaacctgcctctgcttccctccacaacttcaacataaactcttcccttactgaccaatccaggcatcctggccttccttctggccatgcctggattgcttctgtccagggccttcacacttgttgtctcctgtgtctaaacactgttcccatggattttttgaacatggtttctactcattatttgggtcttagcttaaatgtcacctcttcagaaaagcctcacagaaaagccatctaataatgtagcattccccattccctcatttagccactcccacatgaacacattttatactgtttttttttttttttttttttttgagatggagtcttgctctgcctcccaggctggagtacagtgacacaatcttggctcactgcaacctccgcctaccaggttcaagcaattctcttgcctcagcctcctgagtagctgggattacagacgcctgccaccatacctggctaatttttgtatttttagtagagacagagtttcaccatgttagtcaggctggtctcaaactcctgacctcgtgatctgcctgcctcggcctcccaaagtgctgggattacaggtgtgagccaccacaccaggcccattttatattctttatagcatatgtcatcatcagaaaatgtcttgtgtttttgtaagcttgcattttccattgtccacctctgcactagaatgtgagctccattaataccacagaccgtggctattttgagggcttctgtgttttcaacacctactgcccatatatatttactgaataaatggatgaataaaattcaatattcttacctgcaaccaaattggtataaagttatttatacactcttttttaaagctctatataatagactaaaaataaatatactaagaaaaaggcgtaatccttacttgaaaccttgagcaaaaaaccaggaaccaccccacaatgtccacgtgcttaattatttattattggcttttaaattccattaactaatagcataggcagtaagtaggatgatgctgagcctgcttaatgagcaacatttacaaaaaggcaaatgctcttctcacacaccctgggccccagcttcaagacaaatccgtctagagaagcttggtgtctggatttgcctgagccaaatgttttaccaagaacaaggccaatgacccaccacccttggcacagtggtagcaatagaactggttaagccttatctgtcttttttttcctgtagctgatactattgtcggactaccttgaatcacatcctcattccttgctgcaaagccgagattttgttgtggcatcctccactcaggcatgatgatcctataccaaactcagatgcaagcccatttgtataaagctagttaggctaatcccattctccttgccaatggatggtttagaagtgggcatctgctgtgaagtggagattgcagtggtccgagattatgccactgcactccagcctggcgacagagcgagactccgtcttgaaaaaaataaaatgaagtgggcatctgacttagactgtggcaaaggggacatcaaaagaaattttctagggatatctgatggaaaagtttcctttatttaaaaaaaaaaaatcagaatgtcctttcgcttgacattgttggtttatgtgagtatgacgcccagaattgtagcagttgtcttgggaccaagctgacattccaaggacagcaaggcagggagatggagaggatctgagtcctctatgctgtgcttcacctagggaatttatcagctctgggggctccctgcctcatgacttattatgtgaaaaactggattattgcaataacctttcaaccgattcctgcttctgacagtggtcccttaattgagctgctgctagaaagagcgtttttcaactagtggctctctatttcattcaggcaggagtccagctatttataatggtttataaggtccccatcttgcatctgtctgccatcatctgtctccatctttcacaacttcctcctttgcctactcaacttcagacacactggccacaagtccagtccttaaacataccagataagcccttgcctcagggcaattgtactggctgttccctctatctggaactctcctccccagatattcacaagacgatattttttttttgccttcttcaaatcgttgctcaaatgtcatcttttgcatgaagtcttgaccatcctatttaaaagagaacaccatatccctgaaccccatattggtttattttcttacattgatagcctcatattttatattccacttgtttattacgtctattgtctagcccctccactattgaatctccagtgcctagaatgccaagcacatagtaggtgctcagtagatatttgcagaagagatcattcttttactgttccagatattttgatagcagttttctgttggagctgaaagcatcttgaaagcatgatggatttcccttgagttgccttggtgtcctatgccctgcattttcaagacagtcaaccatgtcttaaactcacagtcagtgcatccaggggaagatgagcagtaaaaaaatttctggtgtaggattcaaaactttgctttctggtctctataagacattggacaatttaaaacttatctctagctgccttaatctcctcatatctatgaagaaaattaggtctactatctataatatctaaactaactttttgtctgcaatgtgggattataagactgattctagttatgtcctatgggttataagatgtatatgacccatatatgttaaaagtagaaaagtcctgtgtatctgtaatgaattgttttgaatgaacatttttattctctaaaaatatccattattgttgtattagtggtagtattgatgttttttggttagttgacatttattagttactgaaggctattttcagtcaataaatatttattaagcccctgcttggtgtcaggttactttccaagattactcaatcacagtagctgagaataacaactctgaggtcagactggtgtgtaaatggatatgttgttaaactttctgagtctcaatttcctccaccgtaaaatgggcttaagctggcacctgcctcatatcttagtgttgcagcaaaggtggaatgagataacgtgttgaaagcagttattaaggagtctgatctcgtaaaacctgattaaatggaattatcattattattactctaccctgaccaggtattgtgcagcactttcaaagatcttattaacatatcctttcatcctcccaagctggcaatcacccagggaacctgagcaaatagcacaagagaataattgaaccatgaataaaatgtgggtctgtgtacccagaagtcctagctaattcctgtttctactttaggtctcatattggcttccaatctagccagtcttactctagcaagccttccctgctctgttcctagtgtgggttgggtgacttactctttttctagcactttccacaatcacactggattgtcattaaaaaccatgtggtgatgtcctcaggaaagtgtacagtgcttaatggaggggagcaacagggttttgtccatgactggcctcatcgtccagcccagtgcctggcacatactaggtgctccataaatatttgttaattaaacacatttaaagtgattggcattagggaaagggtgaaataaatagccatggagtttttttctccttcttggctaggaaatatttaattacctaatgcttacaaagagaacaggatgtttgccttcaatgttatgcaaagaacccgcttcccttcctccagagctcacttctcaccaactcacctgcagagtacagcaagcctcctcatatcaagacattctccatcacagctgagaaaaaatgctttcatcttgcacaacttgttcataatcactccaatttttcttctggcagattggagcgccatgcaaagtgaagttgcataggaaatccccctgtagcctactaggtgcagagaagagatctccacttctttttcacacacagagggaaggttttcactcccttcagtgcccgaggcagagaacttggctgcacagtatctcacatttattggcattctggtttcctttaaatgcactcaaaacaccttcagattttctatcttctctgctcttagaattgccctctgatgtaaggaaagaaagaatagaatttctcaatgtgtctcttggatcaaactattagaattatttgggatgggcggggcgtggtggctcccgcctgtaatagcactttgggaggccgaggcaggcagatcacaaggtcaagagtttgagaccagctgggccaatatggtgaaaccccatctttactaaaaatacaaaaagtagccaggggtggtggcaggcacctgtaatcccagctacttaggaggctgaggcaggagaactgcttgaacctgggagatggaggttgcagtgagccaagatcgcgccactgcactccagcctgggcgacatagtgaggctctgtctcaaaaaaaaaaaaaaagaattatttggaatgcttgtgaaatacacaggtcctttgactccatcccagacctagtgaatcagaatctctagaggtagaatctagtaatatacattttaacaccattcccaggggattcatatgcacaataaggttggaaaattattcagtatcctgcctaaggtcactaagtgggtaactgaaccaagtttaaagtgagagattatctgattacaaattggtgcctaattaaaaatcctcttgagttgttgatttagaaagcttctgtccaaaaagacaggattccttctgcctgaaatgggaattcttttcattgccagcccttcaccctgtattcaggagcgggaagagcaaggcaagtagggctccattttctatcatttaggctaagatctgtggggtgaagttataattattgtaactaaacatctaaacatctaagaaagcgtatttgtcaatcactgacatctttctataaaatgaggtgaaggctacaagtctttttactgctttgagacaacccagttggtttttatttatttattttttttctggtgacagcaaagagtcacaatcactgaagggaagctgaaaaatcattcttataatctcgaatttcttaaacatccatgcaaaaggaaacattactgcaaatgttatagttagaggattcctctttgcaaggaagtcacagttgttggcttttactttagggtatatgaaatacacctcacatcgacagtcaaattgatgtttttctctcattagaaagcagaatcgatagagtacctcatccttccctctacatgagtgatcttttcagagggagggaaggaaaaaatgtgatgcccatgtagcaaaacagaataaatgccacaattatttcccatgaataagatgaagtgacctatgttgacagacatcaaagaactgcagagtgaggaacaaacaaagcaccctagaattgcagtatcagaaagaaaatggttatatgctgtagctgggataaaaacagaaactgcaccagataattctttttcccttgtacaaaatcagacaccaagtctcaagaagttatctgatatcgagtgggaaatttttaccatataaagtacttctaatgaggaaataatgtaaaatttcatgcaatgaaatcatatgttatatgaaatatgcctgctaagcaaatcaaatacaagcattgcacacggtaaatcagaacttttaaatgtgtaagtgtcttgcaataactcaactaagtcaagaatgtttagatggcatcctaaccaccagcataacagtgtaagtttaggtcatcaacaaattgtttgttgactgcatgtccacatgatctgcataagttatgtgatctcattcagttcattggtgccaaataccatctgcatgctgaggcctcctcaggttctatctctatctctgagattgtctctctaagacatatatatgactcatatatatacatacaacttccttcttgatgtttatacctttgtacctcatagctacttcctattaattgtgttcaaaatgaagctcatgatttttctccccaaatatctttctttttcaggtttcccagtgttagtaacggtgtccaccaaccacccaattgttcaaagctaaaacctgaaaactatcttaattccttagtttacttctcccctaaaatctagcctattgcctccaaaacatgcctggagcctgttatctcttcatctgcaccttctccactctaataaagccacattgtctctcatcagacttcctataaagcccaaggaatactatttttgagaatgtgtcccagggatataatcacagtagctaatcatgattagtgaataatgtctatgtgttatgttgtttaaaatatatttctaattatattatcataagaattcttcaatagctttattatcccaattttacatatcaggaaatagaatcatgaaaaatttgaggtaacttactccattcccataagtagtgaagctaaatttgaaccaggtatttttaactgtgcaacatatgctcttaatcactatatcacactgcgtttcctggataaatgtaaagattttactattaggtgttcataacaatgttataaatattgaaaatctaggtaaataaactagggtatatgtacctcttattgtatgaaagatgatcctatatattgttaagtaaaaacatcaatttacaaaatagtatttccattatgactccattttggtaaaaaaaaaattgatattgtctggtgtaaactaaccaattccttgcacagtatttgacacacagtacttgtttcttgagtgaatcaattaatgatcatatatgcataatcaagaggttagaaaaatataaacttttaacagtgctgatctgtgggttgtaggtttatgaatgacatttattttctgatttttattggttaaatttaaacttttctacactgagaatatattgtttaagtaatcagaaaaataaaagaataaacattatgtttttaaaaattatttaaggtttgtcttaaaatggtttcttcccacaagtctattttgctccaccaaattttgtgtgatattcctacctctttggtagtctgagcattgtagtctttagcctaagcacttttatctgtagctcattttaccttgtgttctatttgatgtgatgctttactcttctgggccatgctctgtctcctcttcagtggtgcatttcttgagagcttggactatatttgatttatctttacaaccctctcactttctgagacagtaccctggatatagtaagcactcactaaatgcttattgttgaactcacagtatcattcatttaaagtcctatagaataatttgacatgtgaagaaattctagtctgctacttgatacccaagatgcacataagtatcttgcaccaagatgcaatttgaacatcttataacaatctattggtaatggcctgatatatatatacaatacatatatattacatacatatgtattatatatgtataatatataatatgtaatattgtatattgtatatgtattatatgtataatattgtatattgtatattattatatatgtataatattgtatattatatattatatatgtacaatatacacatatgtatgcataaatataatatatacatatacgttatacatatatgtatgtgtgtatacacacacacacacacacacacacacacacacacacccacacccacacccctagcccttatagccataatgggtaactatacgattatccccattccacacctgaggaaaactgaagcatggagacattaacttgccaaggtaactggctagtaagtgatagaactgaaatagaaaaagccattaataggaataagtaacatggaagggaaagctgaataatttttattgactttgagcgtatagaaaattagggtagattatgccaattaaaccccttcactttcctttcaaccagatttttaactagtagcaagtgaaagtcatttattaattcactcaacaaatactcaacttccattgaggcagtgctagtggaggttaaatgacatctaagatatgttggccagggaacctccatgccagtggctgtgtgtttgtgaccaacctaattcttctttttaaaaagtttctgcctgtattcactattttaaagtgcactttccaaacaaaatagggattgtcattttgatcctgactctgacccaattgacagtcagttcaagcaggctacttttgtattatgcaacacaaacatttcaacctatcttcagttcacgtgtattcataatgatcgtctaagggcatatgtgtaaaatgcacattccaggccctcattctagactactaagtcagagtctctattttcaaaacaatgtttaaagagcaggggctttggagtcccaaagactgggtttgaaaactgtctcacccatttataagctatagtgcctttggcaatgtacttaatattttttgtttgtttgcttgacttcaatatcctcataagtaatgtaggaataaaaattcttacctgtcataaggttttggtgaacactaatttagaatgagggtctaattataatatttatattaatagcttacaaatatcgagtacttacaaagtattgagcactgacgccaatgctgtatctgtattatcttattaatttgtcttaagcaaataataaacctgcaactggtaagacctatagttagagcagacactagaattctcataattgatgggaagccagtcacaacgacaagatttaagtgcagagtaagagaataatggattacttggaacaagtcatctagacttgtggtgcccaaagccagtccacaacatcagaattaactgggtaaactcattaaaacacattgtattggccaggcgcggtggctcacgcctgtaatcccagcactttgggaggccaaggcaggcggatcacgaggtcaggagttcgagaccatcctggctaacacggtgaaaccccatctctactaaaaatacaaaaagaaataaaaattaaaaaaaaataagctgggcatatttggtgggtgcctgtagtctcagctacttgggaggctgaggcaggagaatggcgtgaacccaggaggcagagcttgcagtgagccgagatcatgccactgcactccagcctgggtggcagagcgagactccgtctcaaaaaaaaaaaaaaaaaaaattgtatcaccctgacccttgaaactctaacttagtagctcttggagacctcagagtctctattgtttaaaaagttcaaatgattttgaatcatggccaagatttaaaacaaggcattcacttgagcttcattttcttaagatccataaggttagagagtaggtcatttttttctttcttttttaaaaaagtttctaatgtctagcacagtgctgtcatgtagaagacactcaaaaatcttcttttaggtgacataaaatgggattgataattttctatctgtcttcataggggctttagaaggatcttttgtaaggctctatttgacaattcatctcaaaaatagatgagtttatatacaaatataattttagattcagtaatcccactactgattctatatttaaataataaaatcagtacatagaagagaaatctgctctcccatgtttattgcagctctagtcacaataggcaaattatgaactcaacctaagtgttcataaacagatgaatagatacatacagtgatatatatatatatataatatgtgatataaaatgggatatataatatatataatatacacacaaacacacacacattttatatatatacatatatatatatatatatatatatacatgtgcaatggaatattactcagccataaaaaagaataaaatcctgtcatgtggcaacatggataaacctgaaaggcattattaacatagttcacttaatagtgaaataagccaggcacagacagacaaataccacatgttctcagtcatatcaggaacctaaaaaagttgatctcatagaagtagagaatagtgaatagtggttaccagaggcctgggagggtggtaggaagatggaaagagattagtcaataagtataaagtcatagatctgaggaataagttttgttctatagcacagtagggtgactatggttaacaatatcatatggtatctctcaaaacagctaggagagaggattttgaatcttctcaccacaaataaatgataaatatatgaggtaatggatatgctaatcatcttggtttgatatcattacacaatatacacatatcaaaacatcacactgtaccttataaatatgtgcaatcgtatcaatttcttttaaatataattttatatggatttatttattaattttagtgtgttttctcccactttgtaaacatagagtatttggtttttggtcacccactattagattctctacaaaggaattatagcaagattttaaataaactgcctctttcaaattcctcagattaatctttgcttgaattactttttactcagaattgaagtgctgcagaatgacctgaagttcacatgcatttatgcatgttagtttgagtatagtgttcaatcctgtcaactgttcacttcatcattctttaaaactagttttagacctgtgttataccacatctggaatctaaacctaccatcaaagcagcaaaatctgtttcaggcaagccctactgcattctgctagaagagctaaaccgtgatttaaaatacccagaagtgctattctagttccttccaattgcctatcatccagtgttttgtaacgcagacacccttagggagagtcatggaggtctccaagcccaggcttataaaagaagaaaataaagaaaattaaaaagttcttcaggaggaggaaaactaatgcattatcccaggtaaagggccctggaataggaaagtctcctgagaaccagaaaggcaattatatgctaagattgggattcaatgttctcgtaagtcatatgactagacttgacttcttcagtctccctctgcacttcatgtattgccaatggtcctccacatagaatgaaagggagagaattatggctgaaagtcttaaaatgtctggactcagaattctacagcgctgacagatcatcctgaaacaaggcttgcctagtttagcctctgtctctgcaaatctactttactgaaagttcatttcagtgccgctcattggtaggaataaaataaatttcaacagaaaaaaaaaacaggagagaaagaagttattaaatccatttctagcctagaatgcaattttggggtgtgtggggacttagattcatgaaagtaaagatgaaagtttttaattttgaaatcagcacaaactcccaaggaggcaaggaaaagggcatggggatttctcctaccttctgtggttccaatctcgatagtgcctttcacttggctgaagcaccatagtgtgtcctgggtgagtgtcccaattcctgaaaacaacacaaggagacacttcaggttaggtaagagctcccagttgttcttaagagaccaacaagaaaagaaatatatagcagaatctatgcatttctaaaaggagacttgcacaccaggtatcatctcgtcagagaagagaccctagtgagtcctgagaggacggtcagtctgcaagtaccacgtcctgctgtgaatcactgctctgtctcctccgtttgaccaggccaggaccagtttgaactggagcaattggagtttgtcccttctcaggccctggcagcgtcctggagtggttacgaaggacttgcagtcatcccctgtgtgact
